(12) United States Patent
Kunsch et al.

(10) Patent No.: US 6,420,135 B1
(45) Date of Patent: Jul. 16, 2002

(54) STREPTOCOCCUS PNEUMONIAE POLYNUCLEOTIDES AND SEQUENCES

(75) Inventors: Charles A. Kunsch, Gaithersburg; Gil H. Choi, Rockville, both of MD (US); Patrick S. Dillon, Carlsbad, CA (US); Craig A. Rosen, Laytonsville, MD (US); Steven C. Barash, Rockville, MD (US); Michael R. Fannon, Silver Spring, MD (US); Brian A. Dougherty, Mt. Airy, MD (US)

(73) Assignee: Human Genome Sciences, Inc., Rockville, MD (US)

( * ) Notice: Subject to any disclaimer, the term of this patent is extended or adjusted under 35 U.S.C. 154(b) by 0 days.

(21) Appl. No.: 08/961,527

(22) Filed: Oct. 30, 1997

Related U.S. Application Data

(60) Provisional application No. 60/029,960, filed on Oct. 31, 1996.

(51) Int. Cl.⁷ .................................................. C12P 21/06
(52) U.S. Cl. ................ 435/69.1; 435/252.3; 435/320.1; 435/325; 536/23.7
(58) Field of Search ............................ 536/23.7, 24.32; 435/320.1, 69.1, 252.3, 325

(56) References Cited

FOREIGN PATENT DOCUMENTS

| EP | 0622081 | 11/1994 |
|---|---|---|
| EP | 0687688 | 12/1995 |
| WO | 9310238 | 5/1993 |
| WO | 9506732 | 3/1995 |
| WO | 9514712 | 6/1995 |
| WO | 9531548 | 11/1995 |
| WO | 9605859 | 2/1996 |
| WO | 96/08582 | 3/1996 |
| WO | 96/16082 | 5/1996 |
| WO | 9633276 | 10/1996 |
| WO | 9743303 | 11/1997 |
| WO | 98/18930 | 5/1998 |
| WO | 9826072 | 6/1998 |

OTHER PUBLICATIONS

Rudinger (In Peptide Hormones, J.A. Parsons Ed. University Park press, Baltimore, see entire document, especially p. 6, last paragraph, Jun. 1996.*
Martin et al., The EMBO Journal, 11(11):3831–3836 (1992).
Altschul et al., J. Mol. Biol., 215:403–410 (1990);.
Pearson et al., Proc. Natl. Acad. Sci., 85:2444–2448 (1988);.

* cited by examiner

Primary Examiner—James Ketter
Assistant Examiner—Richard Schnizer
(74) Attorney, Agent, or Firm—Human Genome Sciences, Inc.

(57) ABSTRACT

The present invention provides polynucleotide sequences of the genome of *Streptococcus pneumoniae*, polypeptide sequences encoded by the polynucleotide sequences, corresponding polynucleotides and polypeptides, vectors and hosts comprising the polynucleotides, and assays and other uses thereof. The present invention further provides polynucleotide and polypeptide sequence information stored on computer readable media, and computer-based systems and methods which facilitate its use.

88 Claims, No Drawings

STREPTOCOCCUS PNEUMONIAE POLYNUCLEOTIDES AND SEQUENCES

This application claims benefit of 35 U.S.C. section 119(e) based on copending U.S. Provisional Application Ser. No. 60/029,960, filed Oct. 31, 1996, now abandoned.

FIELD OF THE INVENTION

The present invention relates to the field of molecular biology. In particular, it relates to, among other things, nucleotide sequences of *Streptococcus pneumoniae*, contigs, ORFs, fragments, probes, primers and related polynucleotides thereof, peptides and polypeptides encoded by the sequences, and uses of the polynucleotides and sequences thereof, such as in fermentation, polypeptide production, assays and pharmaceutical development, among others.

BACKGROUND OF THE INVENTION

*Streptococcus pneumoniae* has been one of the most extensively studied microorganisms since its first isolation in 1881. It was the object of many investigations that led to important scientific discoveries. In 1928, Griffith observed that when heat-killed encapsulated pneumococci and live strains constitutively lacking any capsule were concomitantly injected into mice, the nonencapsulated could be converted into encapsulated pneumococci with the same capsular type as the heat-killed strain. Years later, the nature of this "transforming principle," or carrier of genetic information, was shown to be DNA. (Avery, O. T., et al., *J. Exp. Med.*, 79:137–157 (1944)).

In spite of the vast number of publications on *S. pneumoniae* many questions about its virulence are still unanswered, and this pathogen remains a major causative agent of serious human disease, especially community-acquired pneumonia. (Johnston, R. B., et al., *Rev. Infect. Dis.* 13(Suppl. 6):S509–517 (1991)). In addition, in developing countries, the pneumococcus is responsible for the death of a large number of children under the age of 5 years from pneumococcal pneumonia. The incidence of pneumococcal disease is highest in infants under 2 years of age and in people over 60 years of age. Pneumococci are the second most frequent cause (after *Haemophilus influenzae* type b) of bacterial meningitis and otitis media in children. With the recent introduction of conjugate vaccines for *H. influenzae* type b, pneumococcal meningitis is likely to become increasingly prominent. *S. pneumoniae* is the most important etiologic agent of community-acquired pneumonia in adults and is the second most common cause of bacterial meningitis behind *Neisseria meningitidis*.

The antibiotic generally prescribed to treat *S. pneumoniae* is benzylpenicillin, although resistance to this and to other antibiotics is found occasionally. Pneumococcal resistance to penicillin results from mutations in its penicillin-binding proteins. In uncomplicated pneumococcal pneumonia caused by a sensitive strain, treatment with penicillin is usually successful unless started too late. Erythromycin or clindamycin can be used to treat pneumonia in patients hypersensitive to penicillin, but resistant strains to these drugs exist. Broad spectrum antibiotics (e.g., the tetracyclines) may also be effective, although tetracycline-resistant strains are not rare. In spite of the availability of antibiotics, the mortality of pneumococcal bacteremia in the last four decades has remained stable between 25 and 29%. (Gillespie, S. H., et al., *J. Med. Microbiol.* 28:237–248 (1989).

*S. pneumoniae* is carried in the upper respiratory tract by many healthy individuals. It has been suggested that attachment of pneumococci is mediated by a disaccharide receptor on fibronectin, present on human pharyngeal epithelial cells. (Anderson, B. J., et al., *J. Immunol.* 142:2464–2468 (1989). The mechanisms by which pneumococci translocate from the nasopharynx to the lung, thereby causing pneumonia, or migrate to the blood, giving rise to bacteremia or septicemia, are poorly understood. (Johnston, R. B., et al., *Rev. Infect. Dis.* 13(Suppl. 6):S509–517 (1991).

Various proteins have been suggested to be involved in the pathogenicity of *S. pneumoniae*, however, only a few of them have actually been confirmed as virulence factors. Pneumococci produce an IgA1 protease that might interfere with host defense at mucosal surfaces. (Kornfield, S. J., et al., *Rev. Inf. Dis.* 3:521–534 (1981). *S. pneumoniae* also produces neuraminidase, an enzyme that may facilitate attachment to epithelial cells by cleaving sialic acid from the host glycolipids and gangliosides. Partially purified neuraminidase was observed to induce meningitis-like symptoms in mice; however, the reliability of this finding has been questioned because the neuraminidase preparations used were probably contaminated with cell wall products. Other pneumococcal proteins besides neuraminidase are involved in the adhesion of pneumococci to epithelial and endothelial cells. These pneumococcal proteins have as yet not been identified. Recently, Cundell et al., reported that peptide permeases can modulate pneumococcal adherence to epithelial and endothelial cells. It was, however, unclear whether these permeases function directly as adhesions or whether they enhance adherence by modulating the expression of pneumococcal adhesions. (DeVelasco, E. A., et al., *Micro. Rev.* 59:591–603 (1995). A better understanding of the virulence factors determining its pathogenicity will need to be developed to cope with the devastating effects of pneumococcal disease in humans.

Ironically, despite the prominent role of *S. pneumoniae* in the discovery of DNA, little is known about the molecular genetics of the organism. The *S. pneumoniae* genome consists of one circular, covalently closed, double-stranded DNA and a collection of so-called variable accessory elements, such as prophages, plasmids, transposons and the like. Most physical characteristics and almost all of the genes of *S. pneumoniae* are unknown. Among the few that have been identified, most have not been physically mapped or characterized in detail. Only a few genes of this organism have been sequenced. (See, for instance current versions of GENBANK and other nucleic acid databases, and references that relate to the genome of *S. pneumoniae* such as those set out elsewhere herein.)

It is clear that the etiology of diseases mediated or exacerbated by *S. pneumoniae*, infection involves the programmed expression of *S. pneumoniae* genes, and that characterizing the genes and their patterns of expression would add dramatically to our understanding of the organism and its host interactions. Knowledge of *S. pneumoniae* genes and genomic organization would improve our understanding of disease etiology and lead to improved and new ways of preventing, ameliorating, arresting and reversing diseases. Moreover, characterized genes and genomic fragments of *S. pneumoniae* would provide reagents for, among other things, detecting, characterizing and controlling *S. pneumoniae* infections. There is a need to characterize the genome of *S. pneumoniae* and for polynucleotides of this organism.

SUMMARY OF THE INVENTION

The present invention is based on the sequencing of fragments of the *Streptococcus pneumoniae* genome. The primary nucleotide sequences which were generated are provided in SEQ ID NOS:1–391.

The present invention provides the nucleotide sequence of several hundred contigs of the *Streptococcus pneumoniae* genome, which are listed in tables below and set out in the Sequence Listing submitted herewith, and representative fragments thereof, in a form which can be readily used, analyzed, and interpreted by a skilled artisan. In one embodiment, the present invention is provided as contiguous strings of primary sequence information corresponding to the nucleotide sequences depicted in SEQ ID NOS:1–391.

The present invention further provides nucleotide sequences which are at least 95% identical to the nucleotide sequences of SEQ ID NOS:1–391.

The nucleotide sequence of SEQ ID NOS:1–391, a representative fragment thereof, or a nucleotide sequence which is at least 95% identical to the nucleotide sequence of SEQ ID NOS; 1–391 may be provided in a variety of mediums to facilitate its use. In one application of this embodiment, the sequences of the present invention are recorded on computer readable media. Such media includes, but is not limited to: magnetic storage media, such as floppy discs, hard disc storage medium, and magnetic tape; optical storage media such as CD-ROM; electrical storage media such as RAM and ROM; and hybrids of these categories such as magnetic/optical storage media.

The present invention further provides systems, particularly computer-based systems which contain the sequence information herein described stored in a data storage means. Such systems are designed to identify commercially important fragments of the *Streptococcus pneumoniae* genome.

Another embodiment of the present invention is directed to fragments of the *Streptococcus pneumoniae* genome having particular structural or functional attributes. Such fragments of the *Streptococcus pneumoniae* genome of the present invention include, but are not limited to, fragments which encode peptides, hereinafter referred to as open reading frames or ORFs, fragments which modulate the expression of an operably linked ORF, hereinafter referred to as expression modulating fragments or EMFs, and fragments which can be used to diagnose the presence of *Streptococcus pneumoniae* in a sample, hereinafter referred to as diagnostic fragments or DFs.

Each of the ORFs in fragments of the *Streptococcus pneumoniae* genome disclosed in Tables 1–3, and the EMFs found 5' to the ORFs, can be used in numerous ways as polynucleotide reagents. For instance, the sequences can be used as diagnostic probes or amplification primers for detecting or determining the presence of a specific microbe in a sample, to selectively control gene expression in a host and in the production of polypeptides, such as polypeptides encoded by ORFs of the present invention, particular those polypeptides that have a pharmacological activity.

The present invention further includes recombinant constructs comprising one or more fragments of the *Streptococcus pneumoniae* genome of the present invention. The recombinant constructs of the present invention comprise vectors, such as a plasmid or viral vector, into which a fragment of the *Streptococcus pneumoniae* has been inserted.

The present invention further provides host cells containing any of the isolated fragments of the *Streptococcus pneumoniae* genome of the present invention. The host cells can be a higher eukaryotic host cell, such as a mammalian cell, a lower eukaryotic cell, such as a yeast cell, or a procaryotic cell such as a bacterial cell.

The present invention is further directed to isolated polypeptides and proteins encoded by ORFs of the present invention. A variety of methods, well known to those of skill in the art, routinely may be utilized to obtain any of the polypeptides and proteins of the present invention. For instance, polypeptides and proteins of the present invention having relatively short, simple amino acid sequences readily can be synthesized using commercially available automated peptide synthesizers. Polypeptides and proteins of the present invention also may be purified from bacterial cells which naturally produce the protein. Yet another alternative is to purify polypeptide and proteins of the present invention from cells which have been altered to express them.

The invention further provides methods of obtaining homologs of the fragments of the *Streptococcus pneumoniae* genome of the present invention and homologs of the proteins encoded by the ORFs of the present invention. Specifically, by using the nucleotide and amino acid sequences disclosed herein as a probe or as primers, and techniques such as PCR cloning and colony/plaque hybridization, one skilled in the art can obtain homologs.

The invention further provides antibodies which selectively bind polypeptides and proteins of the present invention. Such antibodies include both monoclonal and polyclonal antibodies.

The invention further provides hybridomas which produce the above-described antibodies. A hybridoma is an immortalized cell line which is capable of secreting a specific monoclonal antibody.

The present invention further provides methods of identifying test samples derived from cells which express one of the ORFs of the present invention, or a homolog thereof. Such methods comprise incubating a test sample with one or more of the antibodies of the present invention, or one or more of the DFs of the present invention, under conditions which allow a skilled artisan to determine if the sample contains the ORF or product produced therefrom.

In another embodiment of the present invention, kits are provided which contain the necessary reagents to carry out the above-described assays.

Specifically, the invention provides a compartmentalized kit to receive, in close confinement, one or more containers which comprises: (a) a first container comprising one of the antibodies, or one of the DFs of the present invention; and (b) one or more other containers comprising one or more of the following: wash reagents, reagents capable of detecting presence of bound antibodies or hybridized DFs.

Using the isolated proteins of the present invention, the present invention further provides methods of obtaining and identifying agents capable of binding to a polypeptide or protein encoded by one of the ORFs of the present invention. Specifically, such agents include, as further described below, antibodies, peptides, carbohydrates, pharmaceutical agents and the like. Such methods comprise steps of: (a) contacting an agent with an isolated protein encoded by one of the ORFs of the present invention; and (b) determining whether the agent binds to said protein.

The present genomic sequences of *Streptococcus pneumoniae* will be of great value to all laboratories working with this organism and for a variety of commercial purposes. Many fragments of the *Streptococcus pneumoniae* genome will be immediately identified by similarity searches against GenBank or protein databases and will be of immediate value to *Streptococcus pneumoniae* researchers and for immediate commercial value for the production of proteins or to control gene expression.

The methodology and technology for elucidating extensive genomic sequences of bacterial and other genomes has and will greatly enhance the ability to analyze and understand chromosomal organization. In particular, sequenced contigs and genomes will provide the models for developing tools for the analysis of chromosome structure and function, including the ability to identify genes within large segments of genomic DNA, the structure, position, and spacing of regulatory elements, the identification of genes with potential industrial applications, and the ability to do comparative genomic and molecular phylogeny.

DESCRIPTION OF THE FIGURES

FIG. 1 is a block diagram of a computer system (102) that can be used to implement computer-based systems of present invention.

FIG. 2 is a schematic diagram depicting the data flow and computer programs used to collect, assemble, edit and annotate the contigs of the *Streptococcus pneumoniae* genome of the present invention. Both Macintosh and Unix platforms are used to handle the AB 373 and 377 sequence data files, largely as described in Kerlavage et al., *Proceedings of the Twenty-Sixth Annual Hawaii International Conference on System Sciences*, 585, IEEE Computer Society Press, Washington D.C. (1993). Factura (AB) is a Macintosh program designed for automatic vector sequence removal and end-trimming of sequence files. The program Loadis runs on a Macintosh platform and parses the feature data extracted from the sequence files by Factura to the Unix based *Streptococcus pneumoniae* relational database. Assembly of contigs (and whole genome sequences) is accomplished by retrieving a specific set of sequence files and their associated features using Extrseq, a Unix utility for retrieving sequences from an SQL database. The resulting sequence file is processed by seq_filter to trim portions of the sequences with more than 2% ambiguous nucleotides. The sequence files were assembled using TIGR Assembler, an assembly engine designed at The Institute for Genomic Research (TIGR) for rapid and accurate assembly of thousands of sequence fragments. The collection of contigs generated by the assembly step is loaded into the database with the lassie program. Identification of open reading frames (ORFs) is accomplished by processing contigs with zorf or GenMark. The ORFs are searched against *S. pneumoniae* sequences from GenBank and against all protein sequences using the BLASTN and BLASTP programs, described in Altschul et al., *J. Mol. Biol.* 215: 403–410 (1990)). Results of the ORF determination and similarity searching steps were loaded into the database. As described below, some results of the determination and the searches are set out in Tables 1–3.

DETAILED DESCRIPTION OF ILLUSTRATIVE EMBODIMENTS

The present invention is based on the sequencing of fragments of the *Streptococcus pneumoniae* genome and analysis of the sequences. The primary nucleotide sequences generated by sequencing the fragments are provided in SEQ ID NOS:1–391. (As used herein, the "primary sequence" refers to the nucleotide sequence represented by the IUPAC nomenclature system.)

In addition to the aforementioned *Streptococcus pneumoniae* polynucleotide and polynucleotide sequences, the present invention provides the nucleotide sequences of SEQ ID NOS:1–391, or representative fragments thereof, in a form which can be readily used, analyzed, and interpreted by a skilled artisan.

As used herein, a "representative fragment of the nucleotide sequence depicted in SEQ ID NOS:1–391" refers to any portion of the SEQ ID NOS:1–391 which is not presently represented within a publicly available database. Preferred representative fragments of the present invention are *Streptococcus pneumoniae* open reading frames (ORFs), expression modulating fragment (EMFs) and fragments which can be used to diagnose the presence of *Streptococcus pneumoniae* in sample (DFs). A non-limiting identification of preferred representative fragments is provided in Tables 1–3. As discussed in detail below, the information provided in SEQ ID NOS:1–391 and in Tables 1–3 together with routine cloning, synthesis, sequencing and assay methods will enable those skilled in the art to clone and sequence all "representative fragments" of interest, including open reading frames encoding a large variety of *Streptococcus pneumoniae* proteins.

While the presently disclosed sequences of SEQ ID NOS:1–391 are highly accurate, sequencing techniques are not perfect and, in relatively rare instances, further investigation of a fragment or sequence of the invention may reveal a nucleotide sequence error present in a nucleotide sequence disclosed in SEQ ID NOS:1–391. However, once the present invention is made available (i.e., once the information in SEQ ID NOS:1–391 and Tables 1–3 has been made available), resolving a rare sequencing error in SEQ ID NOS:1–391 will be well within the skill of the art. The present disclosure makes available sufficient sequence information to allow any of the described contigs or portions thereof to be obtained readily by straightforward application of routine techniques. Further sequencing of such polynucleotide may proceed in like manner using manual and automated sequencing methods which are employed ubiquitous in the art. Nucleotide sequence editing software is publicly available. For example, Applied Biosystem's (AB) AutoAssembler can be used as an aid during visual inspection of nucleotide sequences. By employing such routine techniques potential errors readily may be identified and the correct sequence then may be ascertained by targeting further sequencing effort, also of a routine nature, to the region containing the potential error.

Even if all of the very rare sequencing errors in SEQ ID NOS:1–391 were corrected, the resulting nucleotide sequences would still be at least 95% identical, nearly all would be at least 99% identical, and the great majority would be at least 99.9% identical to the nucleotide sequences of SEQ ID NOS:1–391.

As discussed elsewhere herein, polynucleotides of the present invention readily may be obtained by routine application of well known and standard procedures for cloning and sequencing DNA. Detailed methods for obtaining libraries and for sequencing are provided below, for instance. A wide variety of *Streptococcus pneumoniae* strains that can be used to prepare *S. pneumoniae* genomic DNA for cloning and for obtaining polynucleotides of the present invention are available to the public from recognized depository institutions, such as the American Type Culture Collection (ATCC). While the present invention is enabled by the sequences and other information herein disclosed, the *S. pneumoniae* strain that provided the DNA of the present Sequence Listing, Strain 7/87 14.8.91, has been deposited in the ATCC, as a convenience to those of skill in the art. As a further convenience, a library of *S. pneumoniae* genomic DNA, derived from the same strain, also has been deposited in the ATCC. The *S. pneumoniae* strain was deposited on Oct. 10, 1996, and was given Deposit No. 55840, and the cDNA library was deposited on Oct. 11, 1996 and was given Deposit No. 97755. The genomic fragments in the library are 15 to 20 kb fragments generated by partial Sau3A1 digestion and they are inserted into the BamHI site in the well-known lambda-derived vector lambda DASH II (Stratagene, La Jolla, Calif.). The provision of the deposits is not a waiver of any rights of the inventors or their assignees in the present subject matter.

The nucleotide sequences of the genomes from different strains of *Streptococcus pneumoniae* differ somewhat. However, the nucleotide sequences of the genomes of all *Streptococcus pneumoniae* strains will be at least 95% identical, in corresponding part, to the nucleotide sequences provided in SEQ ID NOS:1–391. Nearly all will be at least 99% identical and the great majority will be 99.9% identical.

Thus, the present invention further provides nucleotide sequences which are at least 95%, preferably 99% and most preferably 99.9% identical to the nucleotide sequences of SEQ ID NOS:1–391, in a form which can be readily used, analyzed and interpreted by the skilled artisan.

Methods for determining whether a nucleotide sequence is at least 95%, at least 99% or at least 99.9% identical to the nucleotide sequences of SEQ ID NOS:1–391 are routine and readily available to the skilled artisan. For example, the well known fasta algorithm described in Pearson and Lipman, *Proc. Natl. Acad. Sci. USA* 85: 2444 (1988) can be used to generate the percent identity of nucleotide sequences. The BLASTN program also can be used to generate an identity score of polynucleotides compared to one another.

COMPUTER RELATED EMBODIMENTS

The nucleotide sequences provided in SEQ ID NOS:1–391, a representative fragment thereof, or a nucleotide sequence at least 95%, preferably at least 99% and most preferably at least 99.9% identical to a polynucleotide sequence of SEQ ID NOS:1–391 may be "provided" in a variety of mediums to facilitate use thereof. As used herein, provided refers to a manufacture, other than an isolated nucleic acid molecule, wich contains a nucleotide sequence of the present invention; i.e., a nucleotide sequence provided in SEQ ID NOS:1–391, a representative fragment thereof, or a nucleotide sequence at least 95%, preferably at least 99% and most preferably at least 99.9% identical to a polynucleotide of SEQ ID NOS:1–391. Such a manufacture provides a large portion of the *Streptococcus pneumoniae* genome and parts thereof (e.g., a *Streptococcus pneumoniae* open reading frame (ORF)) in a form which allows a skilled artisan to examine the manufacture using means not directly applicable to examining the *Streptococcus pneumoniae* genome or a subset thereof as it exists in nature or in purified form.

In one application of this embodiment, a nucleotide sequence of the present invention can be recorded on computer readable media. As used herein, "computer readable media" refers to any medium which can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories, such as magnetic/optical storage media. A skilled artisan can readily appreciate how any of the presently known computer readable mediums can be used to create a manufacture comprising computer readable medium having recorded thereon a nucleotide sequence of the present invention. Likewise, it will be clear to those of skill how additional computer readable media that may be developed also can be used to create analogous manufactures having recorded thereon a nucleotide sequence of the present invention.

As used herein, "recorded" refers to a process for storing information on computer readable medium. A skilled artisan can readily adopt any of the presently know methods for recording information on computer readable medium to generate manufactures comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and MicroSoft Word, or represented in the form of an ASCII file, stored in a database application, such as DB2, Sybase, Oracle, or the like. A skilled artisan can readily adapt any number of data-processor structuring formats (e.g., text file or database) in order to obtain computer readable medium having recorded thereon the nucleotide sequence information of the present invention.

Computer software is publicly available which allows a skilled artisan to access sequence information provided in a computer readable medium. Thus, by providing in computer readable form the nucleotide sequences of SEQ ID NOS:1–391, a representative fragment thereof, or a nucleotide sequence at least 95%, preferably at least 99% and most preferably at least 99.9% identical to a sequence of SEQ ID NOS:1–391 the present invention enables the skilled artisan routinely to access the provided sequence information for a wide variety of purposes.

The examples which follow demonstrate how software which implements the BLAST (Altschul et al., *J. Mol. Biol.* 215:403–410 (1990)) and BLAZE (Brutlag et al., *Comp. Chem.* 17:203–207 (1993)) search algorithms on a Sybase system was used to identify open reading frames (ORFs) within the *Streptococcus pneumoniae* genome which contain homology to ORFs or proteins from both *Streptococcus pneumoniae* and from other organisms. Among the ORFs discussed herein are protein encoding fragments of the *Streptococcus pneumoniae* genome useful in producing commercially important proteins, such as enzymes used in fermentation reactions and in the production of commercially useful metabolites.

The present invention further provides systems, particularly computer-based systems, which contain the sequence information described herein. Such systems are designed to identify, among other things, commercially important fragments of the *Streptococcus pneumoniae* genome.

As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based systems are suitable for use in the present invention.

As stated above, the computer-based systems of the present invention comprise a data storage means having stored therein a nucleotide sequence of the present invention and the necessary hardware means and software means for supporting and implementing a search means.

As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the present genomic sequences which match a particular target sequence or target motif. A variety of known algorithms are disclosed publicly and a variety of commercially available software for conducting search means are and can be used in the computer-based systems of the present invention. Examples of such software includes, but is not limited to, MacPattern (EMBL), BLASTN and BLASTX (NCBIA). A skilled artisan can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A skilled artisan can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that searches for commercially important fragments, such as sequence fragments involved in gene expression and protein processing, may be of shorter length.

As used herein, "a target structural motif," or "target motif," refers to any rationally selected sequence or combination of sequences in which the sequence(s) are chosen based on a three-dimensional configuration which is formed upon the folding of the target motif. There are a variety of target motifs known in the art. Protein target motifs include, but are not limited to, enzymic active sites and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the Streptococcus pneumoniae genomic sequences possessing varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments of the Streptococcus pneumoniae genome. In the present examples, implementing software which implement the BLAST and BLAZE algorithms, described in Altschul et al., J. Mol. Biol. 215: 403–410 (1990), is used to identify open reading frames within the Streptococcus pneumoniae genome. A skilled artisan can readily recognize that any one of the publicly available homology search programs can be used as the search means for the computer-based systems of the present invention. Of course, suitable proprietary systems that may be known to those of skill also may be employed in this regard.

FIG. 1 provides a block diagram of a computer system illustrative of embodiments of this aspect of present invention. The computer system 102 includes a processor 106 connected to a bus 104. Also connected to the bus 104 are a main memory 108 (preferably implemented as random access memory, RAM) and a variety of secondary storage devices 110, such as a hard drive 112 and a removable medium storage device 114. The removable medium storage device 114 may represent, for example, a floppy disk drive, a CD-ROM drive, a magnetic tape drive, etc. A removable storage medium 116 (such as a floppy disk, a compact disk, a magnetic tape, etc.) containing control logic and/or data recorded therein may be inserted into the removable medium storage device 114. The computer system 102 includes appropriate software for reading the control logic and/or the data from the removable medium storage device 114, once it is inserted into the removable medium storage device 114.

A nucleotide sequence of the present invention may be stored in a well known manner in the main memory 108, any of the secondary storage devices 110, and/or a removable storage medium 116. During execution, software for accessing and processing the genomic sequence (such as search tools, comparing tools, etc.) reside in main memory 108, in accordance with the requirements and operating parameters of the operating system, the hardware system and the software program or programs.

BIOCHEMICAL EMBODIMENTS

Other embodiments of the present invention are directed to isolated fragments of the Streptococcus pneumoniae genome. The fragments of the Streptococcus pneumoniae genome of the present invention include, but are not limited to fragments which encode peptides and polypeptides, hereinafter open reading frames (ORFs), fragments which modulate the expression of an operably linked ORF, hereinafter expression modulating fragments (EMFs) and fragments which can be used to diagnose the presence of Streptococcus pneumoniae in a sample, hereinafter diagnostic fragments (DFs).

As used herein, an "isolated nucleic acid molecule" or an "isolated fragment of the Streptococcus pneumoniae genome" refers to a nucleic acid molecule possessing a specific nucleotide sequence which has been subjected to purification means to reduce, from the composition, the number of compounds which are normally associated with the composition. Particularly, the term refers to the nucleic acid molecules having the sequences set out in SEQ ID NOS:1–391, to representative fragments thereof as described above, to polynucleotides at least 95%, preferably at least 99% and especially preferably at least 99.9% identical in sequence thereto, also as set out above.

A variety of purification means can be used to generate the isolated fragments of the present invention. These include, but are not limited to methods which separate constituents of a solution based on charge, solubility, or size.

In one embodiment, Streptococcus pneumoniae DNA can be enzymatically sheared to produce fragments of 15–20 kb in length. These fragments can then be used to generate a Streptococcus pneumoniae library by inserting them into lambda clones as described in the Examples below. Primers flanking, for example, an ORF, such as those enumerated in Tables 1–3 can then be generated using nucleotide sequence information provided in SEQ ID NOS:1–391. Well known and routine techniques of PCR cloning then can be used to isolate the ORF from the lambda DNA library or Streptococcus pneumoniae genomic DNA. Thus, given the availability of SEQ ID NOS:1–391, the information in Tables 1, 2 and 3, and the information that may be obtained readily by analysis of the sequences of SEQ ID NOS:1–391 using methods set out above, those of skill will be enabled by the present disclosure to isolate any ORF-containing or other nucleic acid fragment of the present invention.

The isolated nucleic acid molecules of the present invention include, but are not limited to single stranded and double stranded DNA, and single stranded RNA.

As used herein, an "open reading frame," ORF, means a series of triplets coding for amino acids without any termination codons and is a sequence translatable into protein.

Tables 1, 2, and 3 list ORFs in the *Streptococcus pneumoniae* genomic contigs of the present invention that were identified as putative coding regions by the GeneMark software using organism-specific second-order Markov probability transition matrices. It will be appreciated that other criteria can be used, in accordance with well known analytical methods, such as those discussed herein, to generate more inclusive, more restrictive, or more selective lists.

Table 1 sets out ORFs in the *Streptococcus pneumoniae* contigs of the present invention that over a continuous region of at least 50 bases are 95% or more identical (by BLAST analysis) to a nucleotide sequence available through GenBank in October, 1997.

Table 2 sets out ORFs in the *Streptococcus pneumoniae* contigs of the present invention that are not in Table 1 and match, with a BLASTP probability score of 0.01 or less, a polypeptide sequence available through GenBank in October, 1997.

Table 3 sets out ORFs in the *Streptococcus pneumoniae* contigs of the present invention that do not match significantly, by BLASTP analysis, a polypeptide sequence available through GenBank in October, 1997.

In each table, the first and second columns identify the ORF by, respectively, contig number and ORF number within the contig; the third column indicates the first nucleotide of the ORF (actually the first nucleotide of the stop codon immediately preceeding the ORF), counting from the 5' end of the contig strand; and the fourth column, "stop (nt)" indicates the last nucleotide of the stop codon defining the 3' end of the ORF.

In Tables 1 and 2, column five, lists the Reference for the closest matching sequence available through GenBank. These reference numbers are the databases entry numbers commonly used by those of skill in the art, who will be familiar with their denominators. Descriptions of the nomenclature are available from the National Center for Biotechnology Information. Column six in Tables 1 and 2 provides the gene name of the matching sequence; column seven provides the BLAST identity score and column eight the BLAST similarity score from the comparison of the ORF and the homologous gene; and column nine indicates the length in nucleotides of the highest scoring segment pair identified by the BLAST identity analysis.

Each ORF described in the tables is defined by "start (nt)" (5') and "stop (nt)" (3') nucleotide position numbers. These position numbers refer to the boundaries of each ORF and provide orientation with respect to whether the forward or reverse strand is the coding strand and which reading frame the coding sequence is contained. The "start" position is the first nucleotide of the triplet encoding a stop codon just 5' to the ORF and the "stop" position is the last nucleotide of the triplet encoding the next in-frame stop codon (i.e., the stop codon at the 3' end of the ORF). Those of ordinary skill in the art appreciate that preferred fragments within each ORF described in the table include fragments of each ORF which include the entire sequence from the delineated "start" and "stop" positions excepting the first and last three nucleotides since these encode stop codons. Thus, polynucleotides set out as ORFs in the tables but lacking the three (3) 5' nucleotides and the three (3) 3' nucleotides are encompassed by the present invention. Those of skill also appreciate that particularly preferred are fragments within each ORF that are polynucleotide fragments comprising polypeptide coding sequence. As defined herein, "coding sequence" includes the fragment within an ORF beginning at the first in-frame ATG (triplet encoding methionine) and ending with the last nucleotide prior to the triplet encoding the 3' stop codon. Preferred are fragments comprising the entire coding sequence and fragments comprising the entire coding sequence, excepting the coding sequence for the N-terninal methionine. Those of skill appreciate that the N-terminal methionine is often removed during post-translational processing and that polynucleotides lacking the ATG can be used to facilitate production of N-termainal fusion proteins which may be benefical in the production or use of genetically engineered proteins. Of course, due to the degeneracy of the genetic code many polynucleotides can encode a given polypeptide. Thus, the invention further includes polynucleotides comprising a nucleotide sequence encoding a polypeptide sequence itself encoded by the coding sequence within an ORF described in Tables 1–3 herein. Further, polynucleotides at least 95%, preferably at least 99% and especially preferably at least 99.9% identical in sequence to the foregoing polynucleotides, are contemplated by the present invention.

Polypeptides encoded by polynucleotides described above and elsewhere herein are also provided by the present invention as are polypeptide comprising a an amino acid sequence at least about 95%, preferably at least 97% and even more preferably 99% identical to the amino acid sequence of a polypeptide encoded by an ORF shown in Tables 1–3. These polypeptides may or may not comprise an N-terminal methionine.

The concepts of percent identity and percent similarity of two polypeptide sequences is well understood in the art. For example, two polypeptides 10 amino acids in length which differ at three amino acid positions (e.g., at positions 1, 3 and 5) are said to have a percent identity of 70%. However, the same two polypeptides would be deemed to have a percent similarity of 80% if, for example at position 5, the amino acids moieties, although not identical, were "similar" (i.e., possessed similar biochemical characteristics). Many programs for analysis of nucleotide or amino acid sequence similarity, such as fasta and BLAST specifically list percent identity of a matching region as an output parameter. Thus, for instance, Tables 1 and 2 herein enumerate the percent identity of the highest scoring segment pair in each ORF and its listed relative. Further details concerning the algorithms and criteria used for homology searches are provided below and are described in the pertinent literature highlighted by the citations provided below.

It will be appreciated that other criteria can be used to generate more inclusive and more exclusive listings of the types set out in the tables. As those of skill will appreciate, narrow and broad searches both are useful. Thus, a skilled artisan can readily identify ORFs in contigs of the *Streptococcus pneumoniae* genome other than those listed in Tables 1–3, such as ORFs which are overlapping or encoded by the opposite strand of an identified ORF in addition to those ascertainable using the computer-based systems of the present invention.

As used herein, an "expression modulating fragment," EMF, means a series of nucleotide molecules which modulates the expression of an operably linked ORF or EMF.

As used herein, a sequence is said to "modulate the expression of an operably linked sequence" when the expression of the sequence is altered by the presence of the EMF. EMFs include, but are not limited to, promoters, and promoter modulating sequences (inducible elements). One class of EMFs are fragments which induce the expression or an operably linked ORF in response to a specific regulatory factor or physiological event.

EMF sequences can be identified within the contigs of the *Streptococcus pneumoniae* genome by their proximity to the ORFs provided in Tables 1–3. An intergenic segment, or a fragment of the intergenic segment, from about 10 to 200 nucleotides in length, taken from any one of the ORFs of Tables 1–3 will modulate the expression of an operably linked ORF in a fashion similar to that found with the naturally linked ORF sequence. As used herein, an "intergenic segment" refers to fragments of the *Streptococcus pneumoniae* genome which are between two ORF(s) herein described. EMFs also can be identified using known EMFs as a target sequence or target motif in the computer-based systems of the present invention. Further, the two methods can be combined and used together.

The presence and activity of an EMF can be confirmed using an EMF trap vector. An EMF trap vector contains a cloning site linked to a marker sequence. A marker sequence encodes an identifiable phenotype, such as antibiotic resistance or a complementing nutrition auxotrophic factor, which can be identified or assayed when the EMF trap vector is placed within an appropriate host under appropriate conditions. As described above, a EMF will modulate the expression of an operably linked marker sequence. A more detailed discussion of various marker sequences is provided below. A sequence which is suspected as being an EMF is cloned in all three reading frames in one or more restriction sites upstream from the marker sequence in the EMF trap vector. The vector is then transformed into an appropriate host using known procedures and the phenotype of the transformed host in examined under appropriate conditions. As described above, an EMF will modulate the expression of an operably linked marker sequence.

As used herein, a "diagnostic fragment," DF, means a series of nucleotide molecules which selectively hybridize to *Streptococcus pneumoniae* sequences. DFs can be readily identified by identifying unique sequences within contigs of the *Streptococcus pneumoniae* genome, such as by using well-known computer analysis software, and by generating and testing probes or amplification primers consisting of the DF sequence in an appropriate diagnostic format which determines amplification or hybridization selectivity.

The sequences falling within the scope of the present invention are not limited to the specific sequences herein described, but also include allelic and species variations thereof. Allelic and species variations can be routinely determined by comparing the sequences provided in SEQ ID NOS:1–391, a representative fragment thereof, or a nucleotide sequence at least 95%, preferably at least 99% and most at least preferably 99.9% identical to SEQ ID NOS:1–391, with a sequence from another isolate of the same species. Furthermore, to accommodate codon variability, the invention includes nucleic acid molecules coding for the same amino acid sequences as do the specific ORFs disclosed herein. In other words, in the coding region of an ORF, substitution of one codon for another which encodes the same amino acid is expressly contemplated. Any specific sequence disclosed herein can be readily screened for errors by resequencing a particular fragment, such as an ORF, in both directions (i.e., sequence both strands). Alternatively, error screening can be performed by sequencing corresponding polynucleotides of *Streptococcus pneumoniae* origin isolated by using part or all of the fragments in question as a probe or primer.

Preferred DFs of the present invention comprise at least about 17, preferably at least about 20, and more preferrably at least about 50 contiguous nucleotides within an ORF set out in Tables 1–3. Most highly preferred DFs specifically hybridize to a polynucleotide containing the sequence of the ORF from which they are derived. Specific hybridization occurs even under stringent conditions defined elsewhere herein.

Each of the ORFs of the *Streptococcus pneumoniae* genome disclosed in Tables 1, 2 and 3, and the EMFs found 5' to the ORFs, can be used as polynucleotide reagents in numerous ways. For example, the sequences can be used as diagnostic probes or diagnostic amplification primers to detect the presence of a specific microbe in a sample, particularly *Streptococcus pneumoniae*. Especially preferred in this regard are ORFs such as those of Table 3, which do not match previously characterized sequences from other organisms and thus are most likely to be highly selective for *Streptococcus pneumoniae*. Also particularly preferred are ORFs that can be used to distinguish between strains of *Streptococcus pneumoniae*, particularly those that distinguish medically important strain, such as drug-resistant strains.

In addition, the fragments of the present invention, as broadly described, can be used to control gene expression through triple helix formation or antisense DNA or RNA, both of which methods are based on the binding of a polynucleotide sequence to DNA or RNA. Triple helix-formation optimally results in a shut-off of RNA transcription from DNA, while antisense RNA hybridization blocks translation of an mRNA molecule into polypeptide. Information from the sequences of the present invention can be used to design antisense and triple helix-forming oligonucleotides. Polynucleotides suitable for use in these methods are usually 20 to 40 bases in length and are designed to be complementary to a region of the gene involved in transcription, for triple-helix formation, or to the mRNA itself, for antisense inhibition. Both techniques have been demonstrated to be effective in model systems, and the requisite techniques are well known and involve routine procedures. Triple helix techniques are discussed in, for example, Lee et al., *Nucl. Acids Res.* 6:3073 (1979); Cooney et al., *Science* 241:456 (1988); and Dervan et al., *Science* 251:1360 (1991). Antisence techniques in general are discussed in, for instance, Okano, *J. Neurochem.* 56:560 (1991) and *Oligodeoxynucleotides as Antisense Inhibitors of Gene Expression*, CRC Press, Boca Raton, Fla. (1988)).

The present invention further provides recombinant constructs comprising one or more fragments of the *Streptococcus pneumoniae* genomic fragments and contigs of the present invention. Certain preferred recombinant constructs of the present invention comprise a vector, such as a plasmid or viral vector, into which a fragment of the *Streptococcus pneumoniae* genome has been inserted, in a forward or reverse orientation. In the case of a vector comprising one of the ORFs of the present invention, the vector may further comprise regulatory sequences, including for example, a promoter, operably linked to the ORF. For vectors comprising the EMFs of the present invention, the vector may further comprise a marker sequence or heterologous ORF operably linked to the EMF.

Large numbers of suitable vectors and promoters are known to those of skill in the art and are commercially available for generating the recombinant constructs of the present invention. The following vectors are provided by way of example. Useful bacterial vectors include phagescript, PsiX174, pBluescript SK, pBS KS, pNH8a, pNH16a, pNH18a, pNH46a (available from Stratagene); pTrc99A, pKK223-3, pKK233-3, pDR540, pRIT5 (available from Pharmacia). Useful eukaryotic vectors include pWLneo, pSV2cat, pOG44, pXT1, pSG (available from Stratagene) pSVK3, pBPV, pMSG, pSVL (available from Pharmacia).

Promoter regions can be selected from any desired gene using CAT (chloramphenicol transferase) vectors or other vectors with selectable markers. Two appropriate vectors are pKK232-8 and pCM7. Particular named bacterial promoters include lacI, lacZ, T3, T7, gpt, lambda PR, and trc. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art.

The present invention further provides host cells containing any one of the isolated fragments of the *Streptococcus pneumoniae* genomic fragments and contigs of the present invention, wherein the fragment has been introduced into the host cell using known methods. The host cell can be a higher eukaryotic host cell, such as a mammalian cell, a lower eukaryotic host cell, such as a yeast cell, or a procaryotic cell, such as a bacterial cell.

A polynucleotide of the present invention, such as a recombinant construct comprising an ORF of the present invention, may be introduced into the host by a variety of well established techniques that are standard in the art, such as calcium phosphate transfection, DEAE, dextran mediated transfection and electroporation, which are described in, for instance, Davis, L. et al., BASIC METHODS IN MOLECULAR BIOLOGY (1986).

A host cell containing one of the fragments of the *Streptococcus pneumoniae* genomic fragments and contigs of the present invention, can be used in conventional manners to produce the gene product encoded by the isolated fragment (in the case of an ORF) or can be used to produce a heterologous protein under the control of the EMF. The present invention further provides isolated polypeptides encoded by the nucleic acid fragments of the present invention or by degenerate variants of the nucleic acid fragments of the present invention. By "degenerate variant" is intended nucleotide fragments which differ from a nucleic acid fragment of the present invention (e.g., an ORF) by nucleotide sequence but, due to the degeneracy of the Genetic Code, encode an identical polypeptide sequence.

Preferred nucleic acid fragments of the present invention are the ORFs and subfragments thereof depicted in Tables 2 and 3 which encode proteins.

A variety of methodologies known in the art can be utilized to obtain any one of the isolated polypeptides or proteins of the present invention. At the simplest level, the amino acid sequence can be synthesized using commercially available peptide synthesizers. This is particularly useful in producing small peptides and fragments of larger polypeptides. Such short fragments as may be obtained most readily by synthesis are useful, for example, in generating antibodies against the native polypeptide, as discussed further below.

In an alternative method, the polypeptide or protein is purified from bacterial cells which naturally produce the polypeptide or protein. One skilled in the art can readily employ well-known methods for isolating polypeptides and proteins to isolate and purify polypeptides or proteins of the present invention produced naturally by a bacterial strain, or by other methods. Methods for isolation and purification that can be employed in this regard include, but are not limited to, immunochromatography, HPLC, size-exclusion chromatography, ion-exchange chromatography, and immuno-affinity chromatography.

The polypeptides and proteins of the present invention also can be purified from cells which have been altered to express the desired polypeptide or protein. As used herein, a cell is said to be altered to express a desired polypeptide or protein when the cell, through genetic manipulation, is made to produce a polypeptide or protein which it normally does not produce or which the cell normally produces at a lower level. Those skilled in the art can readily adapt procedures for introducing and expressing either recombinant or synthetic sequences into eukaryotic or prokaryotic cells in order to generate a cell which produces one of the polypeptides or proteins of the present invention.

Any host/vector system can be used to express one or more of the ORFs of the present invention. These include, but are not limited to, eukaryotic hosts such as HeLa cells, CV-1 cell, COS cells, and Sf9 cells, as well as prokaryotic host such as *E. coli* and *B. subtilis*. The most preferred cells are those which do not normally express the particular polypeptide or protein or which expresses the polypeptide or protein at low natural level.

"Recombinant," as used herein, means that a polypeptide or protein is derived from recombinant (e.g., microbial or mammalian) expression systems. "Microbial" refers to recombinant polypeptides or proteins made in bacterial or fungal (e.g., yeast) expression systems. As a product, "recombinant microbial" defines a polypeptide or protein essentially free of native endogenous substances and unaccompanied by associated native glycosylation. Polypeptides or proteins expressed in most bacterial cultures, e.g., *E. coli*, will be free of glycosylation modifications; polypeptides or proteins expressed in yeast will have a glycosylation pattern different from that expressed in mammalian cells.

"Nucleotide sequence" refers to a heteropolymer of deoxyribonucleotides. Generally, DNA segments encoding the polypeptides and proteins provided by this invention are assembled from fragments of the *Streptococcus pneumoniae* genome and short oligonucleotide linkers, or from a series of oligonucleotides, to provide a synthetic gene which is capable of being expressed in a recombinant transcriptional unit comprising regulatory elements derived from a microbial or viral operon.

"Recombinant expression vehicle or vector" refers to a plasmid or phage or virus or vector, for expressing a polypeptide from a DNA (RNA) sequence. The expression vehicle can comprise a transcriptional unit comprising an assembly of (1) a genetic regulatory elements necessary for gene expression in the host, including elements required to initiate and maintain transcription at a level sufficient for suitable expression of the desired polypeptide, including, for example, promoters and, where necessary, an enhancer and a polyadenylation signal; (2) a structural or coding sequence which is transcribed into mRNA and translated into protein, and (3) appropriate signals to initiate translation at the beginning of the desired coding region and terminate translation at its end. Structural units intended for use in yeast or eukaryotic expression systems preferably include a leader sequence enabling extracellular secretion of translated protein by a host cell. Alternatively, where recombinant protein is expressed without a leader or transport sequence, it may include an N-terminal methionine residue. This residue may or may not be subsequently cleaved from the expressed recombinant protein to provide a final product.

"Recombinant expression system" means host cells which have stably integrated a recombinant transcriptional unit into chromosomal DNA or carry the recombinant transcriptional unit extra chromosomally. The cells can be prokaryotic or eukaryotic. Recombinant expression systems as defined herein will express heterologous polypeptides or proteins upon induction of the regulatory elements linked to the DNA segment or synthetic gene to be expressed.

Mature proteins can be expressed in mammalian cells, yeast, bacteria, or other cells under the control of appropriate promoters. Cell-free translation systems can also be employed to produce such proteins using RNAs derived from the DNA constructs of the present invention. Appropriate cloning and expression vectors for use with prokaryotic and eukaryotic hosts are described in Sambrook et al., *Molecular Cloning: A Laboratory Manual*, $2^{nd}$ Edition, Cold Spring Harbor Laboratory Press, Cold Spring Harbor, N.Y. (1989), the disclosure of which is hereby incorporated by reference in its entirety.

Generally, recombinant expression vectors will include origins of replication and selectable markers permitting transformation of the host cell, e.g., the ampicillin resistance gene of *E. coli* and *S. cerevisiae* TRP1 gene, and a promoter derived from a highly expressed gene to direct transcription of a downstream structural sequence. Such promoters can be derived from operons encoding glycolytic enzymes such as 3-phosphoglycerate kinase (PGK), alpha-factor, acid phosphatase, or heat shock proteins, among others. The heterologous structural sequence is assembled in appropriate phase with translation initiation and termination sequences, and preferably, a leader sequence capable of directing secretion of translated protein into the periplasmic space or extracellular medium. Optionally, the heterologous sequence can encode a fusion protein including an N-terminal identification peptide imparting desired characteristics, e.g., stabilization or simplified purification of expressed recombinant product.

Useful expression vectors for bacterial use are constructed by inserting a structural DNA sequence encoding a desired protein together with suitable translation initiation and termination signals in operable reading phase with a functional promoter. The vector will comprise one or more phenotypic selectable markers and an origin of replication to ensure maintenance of the vector and, when desirable, provide amplification within the host.

Suitable prokaryotic hosts for transformation include strains of *E. coli, B. subtilis, Salmonella typhimurium* and various species within the genera Pseudomonas and Streptomyces. Others may, also be employed as a matter of choice.

As a representative but non-limiting example, useful expression vectors for bacterial use can comprise a selectable marker and bacterial origin of replication derived from commercially available plasmids comprising genetic elements of the well known cloning vector pBR322 (ATCC 37017). Such commercial vectors include, for example, pKK223-3 (available form Pharmacia Fine Chemicals, Uppsala, Sweden) and GEM 1 (available from Promega Biotec, Madison, Wis., USA). These pBR322 "backbone" sections are combined with an appropriate promoter and the structural sequence to be expressed.

Following transformation of a suitable host strain and growth of the host strain to an appropriate cell density, the selected promoter, where it is inducible, is derepressed or induced by appropriate means (e.g., temperature shift or chemical induction) and cells are cultured for an additional period to provide for expression of the induced gene product. Thereafter cells are typically harvested, generally by centrifugation, disrupted to release expressed protein, generally by physical or chemical means, and the resulting crude extract is retained for further purification.

Various mammalian cell culture systems can also be employed to express recombinant protein. Examples of mammalian expression systems include the COS-7 lines of monkey kidney fibroblasts, described in Gluzman, *Cell* 23:175 (1981), and other cell lines capable of expressing a compatible vector, for example, the C127, 3T3, CHO, HeLa and BHK cell lines.

Mammalian expression vectors will comprise an origin of replication, a suitable promoter and enhancer, and also any necessary ribosome binding sites, polyadenylation site, splice donor and acceptor sites, transcriptional termination sequences, and 5' flanking nontranscribed sequences. DNA sequences derived from the SV40 viral genome, for example, SV40 origin, early promoter, enhancer, splice, and polyadenylation sites may be used to provide the required nontranscribed genetic elements.

Recombinant polypeptides and proteins produced in bacterial culture is usually isolated by initial extraction from cell pellets, followed by one or more salting-out, aqueous ion exchange or size exclusion chromatography steps. Microbial cells employed in expression of proteins can be disrupted by any convenient method, including freeze-thaw cycling, sonication, mechanical disruption, or use of cell lysing agents. Protein refolding steps can be used, as necessary, in completing configuration of the mature protein. Finally, high performance liquid chromatography (HPLC) can be employed for final purification steps.

The present invention further includes isolated polypeptides, proteins and nucleic acid molecules which are substantially equivalent to those herein described. As used herein, substantially equivalent can refer both to nucleic acid and amino acid sequences, for example a mutant sequence, that varies from a reference sequence by one or more substitutions, deletions, or additions, the net effect of which does not result in an adverse functional dissimilarity between reference and subject sequences. For purposes of the present invention, sequences having equivalent biological activity, and equivalent expression characteristics are considered substantially equivalent. For purposes of determining equivalence, truncation of the mature sequence should be disregarded.

The invention further provides methods of obtaining homologs from other strains of *Streptococcus pneumoniae*, of the fragments of the Streptococcus pneumoniae genome of the present invention and homologs of the proteins encoded by the ORFs of the present invention. As used herein, a sequence or protein of *Streptococcus pneumoniae* is defined as a homolog of a fragment of the *Streptococcus pneumoniae* fragments or contigs or a protein encoded by one of the ORFs of the present invention, if it shares significant homology to one of the fragments of the *Streptococcus pneumoniae* genome of the present invention or a protein encoded by one of the ORFs of the present invention. Specifically, by using the sequence disclosed herein as a probe or as primers, and techniques such as PCR cloning and colony/plaque hybridization, one skilled in the art can obtain homologs.

As used herein, two nucleic acid molecules or proteins are said to "share significant homology" if the two contain regions which possess greater than 85% sequence (amino acid or nucleic acid) homology. Preferred homologs in this regard are those with more than 90% homology. Especially preferred are those with 93% or more homology. Among especially preferred homologs those with 95% or more homology are particularly preferred. Very particularly preferred among these are those with 97% and even more particularly preferred among those are homologs with 99% or more homology. The most preferred homologs among these are those with 99.9% homology or more. It will be understood that, among measures of homology, identity is particularly preferred in this regard.

Region specific primers or probes derived from the nucleotide sequence provided in SEQ ID NOS:1–391 or from a nucleotide sequence at least 95%, particularly at least 99%, especially at least 99.5% identical to a sequence of SEQ ID NOS:1–391 can be used to prime DNA synthesis and PCR amplification, as well as to identify colonies containing cloned DNA encoding a homolog. Methods suitable to this aspect of the present invention are well known and have been described in great detail in many publications such as, for example, Innis et al., *PCR Protocols*, Academic Press, San Diego, Calif. (1990)).

When using primers derived from SEQ ID NOS:1–391 or from a nucleotide sequence having an aforementioned identity to a sequence of SEQ ID NOS:1–391, one skilled in the art will recognize that by employing high stringency conditions (e.g., annealing at 50–60° C. in 6×SSC and 50% formamide, and washing at 50–65° C. in 0.5×SSC) only sequences which are greater than 75% homologous to the primer will be amplified. By employing lower stringency conditions (e.g., hybridizing at 35–37° C. in 5×SSC and 40–45% formamide, and washing at 42° C. in 0.5×SSC), sequences which are greater than 40–50% homologous to the primer will also be amplified.

When using DNA probes derived from SEQ ID NOS:1–391, or from a nucleotide sequence having an aforementioned identity to a sequence of SEQ ID NOS:1–391, for colony/plaque hybridization, one skilled in the art will recognize that by employing high stringency conditions (e.g., hybridizing at 50–65° C. in 5×SSC and 50% formamide, and washing at 50–65° C. in 0.5×SSC), sequences having regions which are greater than 90% homologous to the probe can be obtained, and that by employing lower stringency conditions (e.g., hybridizing at 35–37° C. in 5×SSC and 40–45% formamide, and washing at 42° C. in 0.5×SSC), sequences having regions which are greater than 35–45% homologous to the probe will be obtained.

Any organism can be used as the source for homologs of the present invention so long as the organism naturally expresses such a protein or contains genes encoding the same. The most preferred organism for isolating homologs are bacteria which are closely related to *Streptococcus pneumoniae*.

ILLUSTRATIVE USES OF COMPOSITIONS OF THE INVENTION

Each ORF provided in Tables 1 and 2 is identified with a function by homology to a known gene or polypeptide. As a result, one skilled in the art can use the polypeptides of the present invention for commercial, therapeutic and industrial purposes consistent with the type of putative identification of the polypeptide. Such identifications permit one skilled in the art to use the *Streptococcus pneumoniae* ORFs in a manner similar to the known type of sequences for which the identification is made; for example, to ferment a particular sugar source or to produce a particular metabolite. A variety of reviews illustrative of this aspect of the invention are available, including the following reviews on the industrial use of enzymes, for example, BIOCHEMICAL ENGINEERING AND BIOTECHNOLOGY HANDBOOK, 2nd Ed., MacMillan Publications, Ltd. NY (1991) and BIOCATALYSTS IN ORGANIC SYNTHESES, Tramper et al., Eds., Elsevier Science Publishers, Amsterdam, The Netherlands (1985). A variety of exemplary uses that illustrate this and similar aspects of the present invention are discussed below.

1. Biosynthetic Enzymes

Open reading frames encoding proteins involved in mediating the catalytic reactions involved in intermediary and macromolecular metabolism, the biosynthesis of small molecules, cellular processes and other functions includes enzymes involved in the degradation of the intermediary products of metabolism, enzymes involved in central intermediary metabolism, enzymes involved in respiration, both aerobic and anaerobic, enzymes involved in fermentation, enzymes involved in ATP proton motor force conversion, enzymes involved in broad regulatory function, enzymes involved in amino acid synthesis, enzymes involved in nucleotide synthesis, enzymes involved in cofactor and vitamin synthesis, can be used for industrial biosynthesis.

The various metabolic pathways present in *Streptococcus pneumoniae* can be identified based on absolute nutritional requirements as well as by examining the various enzymes identified in Table 1–3 and SEQ ID NOS:1–391.

Of particular interest are polypeptides involved in the degradation of intermediary metabolites as well as non-macromolecular metabolism. Such enzymes include amylases, glucose oxidases, and catalase.

Proteolytic enzymes are another class of commercially important enzymes. Proteolytic enzymes find use in a number of industrial processes including the processing of flax and other vegetable fibers, in the extraction, clarification and depectinization of fruit juices, in the extraction of vegetables' oil and in the maceration of fruits and vegetables to give unicellular fruits. A detailed review of the proteolytic enzymes used in the food industry is provided in Rombouts et al., *Symbiosis* 21:79 (1986) and Voragen et al. in *Biocatalysts In Agricultural Biotechnology*, Whitaker et al., Eds., *American Chemical Society Symposium Series* 389:93 (1989).

The metabolism of sugars is an important aspect of the primary metabolism of *Streptococcus pneumoniae*. Enzymes involved in the degradation of sugars, such as, particularly, glucose, galactose, fructose and xylose, can be used in industrial fermentation. Some of the important sugar transforming enzymes, from a commercial viewpoint, include sugar isomerases such as glucose isomerase. Other metabolic enzymes have found commercial use such as glucose oxidases which produces ketogulonic acid (KGA). KGA is an intermediate in the commercial production of ascorbic acid using the Reichstein's procedure, as described in Krueger et al., *Biotechnology* 6(A , Rhine et al., Eds., Verlag Press, Weinheim, Germany (1984).

Glucose oxidase (GOD) is commercially available and has been used in purified form as well as in an immobilized form for the deoxygenation of beer. See, for instance, Hartmeir et al., *Biotechnology Letters* 1:21 (1979). The most important application of GOD is the industrial scale fermentation of gluconic acid. Market for gluconic acids which are used in the detergent, textile, leather, photographic, pharmaceutical, food, feed and concrete industry, as described, for example, in Bigelis et al., beginning on page 357 in GENE MANIPULATIONS AND FUNGI; Benett et al., Eds., Academic Press, New York (1985). In addition to industrial applications, GOD has found applications in medicine for quantitative determination of glucose in body fluids recently in biotechnology for analyzing syrups from starch and cellulose hydrosylates. This application is described in Owusu et al., *Biochem. et Biophysica. Acta.* 872:83 (1986), for instance.

The main sweetener used in the world today is sugar which comes from sugar beets and sugar cane. In the field of industrial enzymes, the glucose isomerase process shows the largest expansion in the market today. Initially, soluble enzymes were used and later immobilized enzymes were developed (Krueger et al., *Biotechnology, The Textbook of Industrial Microbiology*, Sinauer Associated Incorporated, Sunderland, Mass. (1990)). Today, the use of glucose-produced high fructose syrups is by far the largest industrial business using immobilized enzymes. A review of the industrial use of these enzymes is provided by Jorgensen, Starch 40:307 (1988).

Proteinases, such as alkaline serine proteinases, are used as detergent additives and thus represent one of the largest volumes of microbial enzymes used in the industrial sector. Because of their industrial importance, there is a large body of published and unpublished information regarding the use of these enzymes in industrial processes. (See Faultman et al., Acid Proteases Structure Function and Biology, Tang, J., ed., Plenum Press, New York (1977) and Godfrey et al., Industrial Enzymes, MacMillan Publishers, Surrey, UK (1983) and Hepner et al., Report Industrial Enzymes by 1990, Hel Hepner & Associates, London (1986)).

Another class of commercially usable proteins of the present invention are the microbial lipases, described by, for instance, Macrae et al., *Philosophical Transactions of the Chiral Society of London* 310:227 (1985) and Poserke, *Journal of the American Oil Chemist Society* 61:1758 (1984). A major use of lipases is in the fat and oil industry for the production of neutral glycerides using lipase catalyzed inter-esterification of readily available triglycerides. Application of lipases include the use as a detergent additive to facilitate the removal of fats from fabrics in the course of the washing procedures.

The use of enzymes, and in particular microbial enzymes, as catalyst for key steps in the synthesis of complex organic molecules is gaining popularity at a great rate. One area of great interest is the preparation of chiral intermediates. Preparation of chiral intermediates is of interest to a wide range of synthetic chemists particularly those scientists involved with the preparation of new pharmaceuticals, agrochemicals, fragrances and flavors. (See Davies et al., *Recent Advances in the Generation of Chiral Intermediates Using Enzymes*, CRC Press, Boca Raton, Fla. (1990)). The following reactions catalyzed by enzymes are of interest to organic chemists: hydrolysis of carboxylic acid esters, phosphate esters, amides and nitrites, esterification reactions, trans-esterification reactions, synthesis of amides, reduction of alkanones and oxoalkanates, oxidation of alcohols to carbonyl compounds, oxidation of sulfides to sulfoxides, and carbon bond forming reactions such as the aldol reaction.

When considering the use of an enzyme encoded by one of the ORFs of the present invention for biotransformation and organic synthesis it is sometimes necessary to consider the respective advantages and disadvantages of using a microorganism as opposed to an isolated enzyme. Pros and cons of using a whole cell system on the one hand or an isolated partially purified enzyme on the other hand, has been described in detail by Bud et al., Chemistry in Britain (1987), p. 127.

Amino transferases, enzymes involved in the biosynthesis and metabolism of amino acids, are useful in the catalytic production of amino acids. The advantages of using microbial based enzyme systems is that the amino transferase enzymes catalyze the stereo-selective synthesis of only L-amino acids and generally possess uniformly high catalytic rates, A description of the use of amino transferases for amino acid production is provided by Roselle-David, *Methods of Enzymology* 136:479 (1987).

Another category of useful proteins encoded by the ORFs of the present invention include enzymes involved in nucleic acid synthesis, repair, and recombination.

2. Generation of Antibodies

As described here, the proteins of the present invention, as well as homologs thereof, can be used in a variety of procedures and methods known in the art which are currently applied to other proteins. The proteins of the present invention can further be used to generate an antibody which selectively binds the protein. Such antibodies can be either monoclonal or polyclonal antibodies, as well fragments of these antibodies, and humanized forms.

The invention further provides antibodies which selectively bind to one of the proteins of the present invention and hybridomas which produce these antibodies. A hybridoma is an immortalized cell line which is capable of secreting a specific monoclonal antibody.

In general, techniques for preparing polyclonal and monoclonal antibodies as well as hybridomas capable of producing the desired antibody are well known in the art (Campbell, A. M., *Monoclonal Antibody Technology: Laboratory Techniques In Biochemistry And Molecular Biology*, Elsevier Science Publishers, Amsterdam, The Netherlands (1984); St. Groth et al., *J. Immunol. Methods* 35. 1–21 (1980), Kohler and Milstein, *Nature* 256:495–497 (1975)), the trioma technique, the human B-cell hybridoma technique (Kozbor et al., *Immunology Today* 4:72 (1983), pgs. 77–96 of Cole et al., in *Monoclonal Antibodies And Cancer Therapy*, Alan R. Liss, Inc. (1985)). Any animal (mouse, rabbit, etc.) which is known to produce antibodies can be immunized with the pseudogene polypeptide. Methods for immunization are well known in the art. Such methods include subcutaneous or interperitoneal injection of the polypeptide. One skilled in the art will recognize that the amount of the protein encoded by the ORF of the present invention used for immunization will vary based on the animal which is immunized, the antigenicity of the peptide and the site of injection.

The protein which is used as an immunogen may be modified or administered in an adjuvant in order to increase the proteins antigenicity. Methods of increasing the antigenicity of a protein are well known in the art and include, but are not limited to coupling the antigen with a heterologous protein (such as globulin or galactosidase) or through the inclusion of an adjuvant during immunization.

For monoclonal antibodies, spleen cells from the immunized animals are removed, fused with myeloma cells, such as SP2/0-Ag14 myeloma cells, and allowed to become monoclonal antibody producing hybridoma cells.

Any one of a number of methods well known in the art can be used to identify the hybridoma cell which produces an antibody with the desired characteristics. These include screening the hybridomas with an ELISA assay, western blot analysis, or radioimmunoassay (Lutz et al., *Exp. Cell Res.* 175.109–124 (1988)), Hybridomas secreting the desired antibodies are cloned and the class and subclass is determined using procedures known in the art (Campbell, A. M., *Monoclonal Antibody Technology: Laboratory Techniques in Biochemistry and Molecular Biology*, Elsevier Science Publishers, Amsterdam, The Netherlands (1984)).

Techniques described for the production of single chain antibodies (U.S. Pat. No. 4,946,778) can be adapted to produce single chain antibodies to proteins of the present invention.

For polyclonal antibodies, antibody containing antisera is isolated from the immunized animal and is screened for the presence of antibodies with the desired specificity using one of the above-described procedures.

The present invention further provides the above-described antibodies in detectably labelled form. Antibodies can be detectably labelled through the use of radioisotopes, affinity labels (such as biotin, avidin, etc.), enzymatic labels (such as horseradish peroxidase, alkaline phosphatase, etc.) fluorescent labels (such as FITC or rhodamine, etc.), paramagnetic atoms, etc. Procedures for accomplishing such labeling are well-known in the art, for example see Sternberger et al., *J. Histochem. Cytochem.* 18:315 (1970); Bayer, E. A. et al., *Meth. Enzym.* 62:308 (1979); Engval, E. et al., *Immunol.* 109:129 (1972); Goding, J. W., *J. Immunol.*

Meth. 13:215 (1976)).

The labeled antibodies of the present invention can be used for in vitro, in vivo, and in situ assays to identify cells or tissues in which a fragment of the *Streptococcus pneumoniae* genome is expressed.

The present invention further provides the above-described antibodies immobilized on a solid support. Examples of such solid supports include plastics such as polycarbonate, complex carbohydrates such as agarose and sepharose, acrylic resins and such as polyacrylamide and latex beads. Techniques for coupling antibodies to such solid supports are well known in the art (Weir, D. M. et al., "Handbook of Experimental Immunology" 4th Ed., Blackwell Scientific Publications, Oxford, England, Chapter 10 (1986); Jacoby, W. D. et al., Meth. Enzym. 34 Academic Press, N.Y. (1974)). The immobilized antibodies of the present invention can be used for in vitro, in vivo, and in situ assays as well as for immunoaffinity purification of the proteins of the present invention.

3. Diagnostic Assays and Kits

The present invention further provides methods to identify the expression of one of the ORFs of the present invention, or homolog thereof, in a test sample, using one of the DFs or antibodies of the present invention.

In detail, such methods comprise incubating a test sample with one or more of the antibodies or one or more of the DFs of the present invention and assaying for binding of the DFs or antibodies to components within the test sample.

Conditions for incubating a DF or antibody with a test sample vary, Incubation conditions depend on the format employed in the assay, the detection methods employed, and the type and nature of the DF or antibody used in the assay. One skilled in the art will recognize that any one of the commonly available hybridization, amplification or immunological assay formats can readily be adapted to employ the DFs or antibodies of the present invention. Examples of such assays can be found in Chard, T., *An Introduction to Radioimmunoassay and Related Techniques*, Elsevier Science Publishers, Amsterdam, The Netherlands (1986); Bullock, G. R. et al., *Techniques in Immunocytochemistry*, Academic Press, Orlando, Fla. Vol. 1 (1982), Vol. 2 (1983), Vol. 3 (1985); Tijssen, P., *Practice and Theory of Enzyme Immunoassays: Laboratory Techniques in Biochemistry and Molecular Biology*, Elsevier Science Publishers, Amsterdam, The Netherlands (1985).

The test samples of the present invention include cells, protein or membrane extracts of cells, or biological fluids such as sputum, blood, serum, plasma, or urine. The test sample used in the above-described method will vary based on the assay format, nature of the detection method and the tissues, cells or extracts used as the sample to be assayed. Methods for preparing protein extracts or membrane extracts of cells are well known in the art and can be readily be adapted in order to obtain a sample which is compatible with the system utilized.

In another embodiment of the present invention, kits are provided which contain the necessary reagents to carry out the assays of the present invention.

Specifically, the invention provides a compartmentalized kit to receive, in close confinement, one or more containers which comprises: (a) a first container comprising one of the DFs or antibodies of the present invention; and (b) one or more other containers comprising one or more of the following: wash reagents, reagents capable of detecting presence of a bound DF or antibody.

In detail, a compartmentalized kit includes any kit in which reagents are contained in separate containers. Such containers include small glass containers, plastic containers or strips of plastic or paper. Such containers allows one to efficiently transfer reagents from one compartment to another compartment such that the samples and reagents are not cross-contaminated, and the agents or solutions of each container can be added in a quantitative fashion from one compartment to another. Such containers will include a container which will accept the test sample, a container which contains the antibodies used in the assay, containers which contain wash reagents (such as phosphate buffered saline, Tris-buffers, etc.), and containers which contain the reagents used to detect the bound antibody or DF.

Types of detection reagents include labelled nucleic acid probes, labelled secondary antibodies, or in the alternative, if the primary antibody is labelled, the enzymatic, or antibody binding reagents which are capable of reacting with the labelled antibody. One skilled in the art will readily recognize that the disclosed DFs and antibodies of the present invention can be readily incorporated into one of the established kit formats which are well known in the art.

4. Screening Assay for Binding Agents

Using the isolated proteins of the present invention, the present invention further provides methods of obtaining and identifying agents which bind to a protein encoded by one of the ORFs of the present invention or to one of the fragments and the *Streptococcus pneumoniae* fragment and contigs herein described.

In general, such methods comprise steps of:
(a) contacting an agent with an isolated protein encoded by one of the ORFs of the present invention, or an isolated fragment of the Streptococcus pneumoniae genome; and
(b) determining whether the agent binds to said protein or said fragment, The agents screened in the above assay can be, but are not limited to, peptides, carbohydrates, vitamin derivatives, or other pharmaceutical agents. The agents can be selected and screened at random or rationally selected or designed using protein modeling techniques.

For random screening, agents such as peptides, carbohydrates, pharmaceutical agents and the like are selected at random and are assayed for their ability to bind to the protein encoded by the ORF of the present invention.

Alternatively, agents may be rationally selected or designed. As used herein, an agent is said to be "rationally selected or designed" when the agent is chosen based on the configuration of the particular protein. For example, one skilled in the art can readily adapt currently available procedures to generate peptides, pharmaceutical agents and the like capable of binding to a specific peptide sequence in order to generate rationally designed antipeptide peptides, for example see Hurby et al., "Application of Synthetic Peptides: Antisense Peptides," in *Synthetic Peptides, A User's Guide*, W. H. Freeman, NY (1992), pp. 289–307, and Kaspczak et al., *Biochemistry* 28:9230–8 (1989), or pharmaceutical agents, or the like.

In addition to the foregoing, one class of agents of the present invention, as broadly described, can be used to control gene expression through binding to one of the ORFs or EMFs of the present invention. As described above, such agents can be randomly screened or rationally designed/selected. Targeting the ORF or EMF allows a skilled artisan to design sequence specific or element specific agents, modulating the expression of either a single ORF or multiple ORFs which rely on the same EMF for expression control.

One class of DNA binding agents are agents which contain base residues which hybridize or form a triple helix by binding to DNA or RNA. Such agents can be based on the classic phosphodiester, ribonucleic acid backbone, or can be a variety of sulfhydryl or polymeric derivatives which have base attachment capacity.

Agents suitable for use in these methods usually contain 20 to 40 bases and are designed to be complementary to a region of the gene involved in transcription (triple helix— see Lee et al., *Nucl. Acids Res.* 6:3073 (1979); Cooney et al., *Science* 241:456 (1988); and Dervan et al., *Science* 251:1360 (1991)) or to the mRNA itself (antisense—Okano, *J. Neurochem.* 56:560 (1991); *Oligodeoxynucleotides as Antisense Inhibitors of Gene Expression*, CRC Press, Boca Raton, Fla. (1988)). Triple helix-formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention can be used to design antisense and triple helix-forming oligonucleotides, and other DNA binding agents.

5. Pharmaceutical Compositions and Vaccines

The present invention further provides pharmaceutical agents which can be used to modulate the growth or pathogenicity of *Streptococcus pneumoniae*, or another related organism, in vivo or in vitro. As used herein, a "pharmaceutical agent" is defined as a composition of matter which can be formulated using known techniques to provide a pharmaceutical compositions. As used herein, the "pharmaceutical agents of the present invention" refers the pharmaceutical agents which are derived from the proteins encoded by the ORFs of the present invention or are agents which are identified using the herein described assays.

As used herein, a pharmaceutical agent is said to "modulate the growth pathogenicity of *Streptococcus pneumoniae* or a related organism, in vivo or in vitro," when the agent reduces the rate of growth, rate of division, or viability of the organism in question. The pharmaceutical agents of the present invention can modulate the growth or pathogenicity of an organism in many fashions, although an understanding of the underlying mechanism of action is not needed to practice the use of the pharmaceutical agents of the present invention. Some agents will modulate the growth by binding to an important protein thus blocking the biological activity of the protein, while other agents may bind to a component of the outer surface of the organism blocking attachment or rendering the organism more prone to act the bodies nature immune system. Alternatively, the agent may comprise a protein encoded by one of the ORFs of the present invention and serve as a vaccine. The development and use of a vaccine based on outer membrane components are well known in the art.

As used herein, a "related organism" is a broad term which refers to any organism whose growth can be modulated by one of the pharmaceutical agents of the present invention, In general, such an organism will contain a homolog of the protein which is the target of the pharmaceutical agent or the protein used as a vaccine. As such, related organisms do not need to be bacterial but may be fungal or viral pathogens.

The pharmaceutical agents and compositions of the present invention may be administered in a convenient manner, such as by the oral, topical, intravenous, intraperitoneal, intramuscular, subcutaneous, intranasal or intradermal routes. The pharmaceutical compositions are administered in an amount which is effective for treating and/or prophylaxis of the specific indication. In general, they are administered in an amount of at least about 1 mg/kg body weight and in most cases they will be administered in an amount not in excess of about 1 g/kg body weight per day. In most cases, the dosage is from about 0.1 mg/kg to about 10 g/kg body weight daily, taking into account the routes of administration, symptoms, etc.

The agents of the present invention can be used in native form or can be modified to form a chemical derivative. As used herein, a molecule is said to be a "chemical derivative" of another molecule when it contains additional chemical moieties not normally a part of the molecule. Such moieties may improve the molecule's solubility, absorption, biological half life, etc. The moieties may alternatively decrease the toxicity of the molecule, eliminate or attenuate any undesirable side effect of the molecule, etc. Moieties capable of mediating such effects are disclosed in, among other sources, REMINGTON'S PHARMACEUTICAL SCIENCES (1980) cited elsewhere herein.

For example, such moieties may change an immunological character of the functional derivative, such as affinity for a given antibody. Such changes in immunomodulation activity are measured by the appropriate assay, such as a competitive type immunoassay. Modifications of such protein properties as redox or thermal stability, biological half-life, hydrophobicity, susceptibility to proteolytic degradation or the tendency to aggregate with carriers or into multimers also may be effected in this way and can be assayed by methods well known to the skilled artisan.

The therapeutic effects of the agents of the present invention may be obtained by providing the agent to a patient by any suitable means (e.g., inhalation, intravenously, intramuscularly, subcutaneously, enterally, or parenterally). It is preferred to administer the agent of the present invention so as to achieve an effective concentration within the blood or tissue in which the growth of the organism is to be controlled. To achieve an effective blood concentration, the preferred method is to administer the agent by injection. The administration may be by continuous infusion, or by single or multiple injections.

In providing a patient with one of the agents of the present invention, the dosage of the administered agent will vary depending upon such factors as the patient's age, weight, height, sex, general medical condition, previous medical history, etc. In general, it is desirable to provide the recipient with a dosage of agent which is in the range of from about 1 pg/kg to 10 mg/kg (body weight of patient), although a lower or higher dosage may be administered. The therapeutically effective dose can be lowered by using combinations of the agents of the present invention or another agent.

As used herein, two or more compounds or agents are said to be administered "in combination" with each other when either (1) the physiological effects of each compound, or (2) the serum concentrations of each compound can be measured at the same time. The composition of the present invention can be administered concurrently with, prior to, or following the administration of the other agent.

The agents of the present invention are intended to be provided to recipient subjects in an amount sufficient to decrease the rate of growth (as defined above) of the target organism.

The administration of the agent(s) of the invention may be for either a "prophylactic" or "therapeutic" purpose. When provided prophylactically, the agent(s) are provided in advance of any symptoms indicative of the organisms growth. The prophylactic administration of the agent(s) serves to prevent, attenuate, or decrease the rate of onset of any subsequent infection. When provided therapeutically, the agent(s) are provided at (or shortly after) the onset of an indication of infection. The therapeutic administration of the compound(s) serves to attenuate the pathological symptoms of the infection and to increase the rate of recovery.

The agents of the present invention are administered to a subject, such as a mammal, or a patient, in a pharmaceutically acceptable form and in a therapeutically effective concentration, A composition is said to be "pharmacologically acceptable" if its administration can be tolerated by a recipient patient. Such an agent is said to be administered in a "therapeutically effective amount" if the amount administered is physiologically significant. An agent is physiologically significant if its presence results in a detectable change in the physiology of a recipient patient.

The agents of the present invention can be formulated according to known methods to prepare pharmaceutically useful compositions, whereby these materials, or their functional derivatives, are combined in a mixture with a pharmaceutically acceptable carrier vehicle. Suitable vehicles and their formulation, inclusive of other human proteins, e.g., human serum albumin, are described, for example, in REMINGTON'S PHARMACEUTICAL SCIENCES, $16^{th}$ Ed., Osol, A., Ed., Mack Publishing, Easton Pa. (1980). In order to form a pharmaceutically acceptable composition suitable for effective administration, such compositions will contain an effective amount of one or more of the agents of the present invention, together with a suitable amount of carrier vehicle.

Additional pharmaceutical methods may be employed to control the duration of action. Control release preparations may be achieved through the use of polymers to complex or absorb one or more of the agents of the present invention. The controlled delivery may be effectuated by a variety of well known techniques, including formulation with macromolecules such as, for example, polyesters, polyamino acids, polyvinyl, pyrrolidone, ethylenevinylacetate, methylcellulose, carboxymethylcellulose, or protamine, sulfate, adjusting the concentration of the macromolecules and the agent in the formulation, and by appropriate use of methods of incorporation, which can be manipulated to effectuate a desired time course of release. Another possible method to control the duration of action by controlled release preparations is to incorporate agents of the present invention into particles of a polymeric material such as polyesters, polyamino acids, hydrogels, poly(lactic acid) or ethylene vinylacetate copolymers. Alternatively, instead of incorporating these agents into polymeric particles, it is possible to entrap these materials in microcapsules prepared, for example, by coacervation techniques or by interfacial polymerization with, for example, hydroxymethylcellulose or gelatine-microcapsules and poly(methylmethacylate) microcapsules, respectively, or in colloidal drug delivery systems, for example, liposomes, albumin microspheres, microemulsions, nanoparticles, and nanocapsules or in macroemulsions. Such techniques are disclosed in REMINGTON'S PHARMACEUTICAL SCIENCES (1980).

The invention further provides a pharmaceutical pack or kit comprising one or more containers filled with one or more of the ingredients of the pharmaceutical compositions of the invention. Associated with such container(s) can be a notice in the form prescribed by a governmental agency regulating the manufacture, use or sale of pharmaceuticals or biological products, which notice reflects approval by the agency of manufacture, use or sale for human administration.

In addition, the agents of the present invention may be employed in conjunction with other therapeutic compounds.

6. Shot-Gun Approach to Megabase DNA Sequencing

The present invention further demonstrates that a large sequence can be sequenced using a random shotgun approach. This procedure, described in detail in the examples that follow, has eliminated the up front cost of isolating and ordering overlapping or contiguous subclones prior to the start of the sequencing protocols.

Certain aspects of the present invention are described in greater detail in the examples that follow. The examples are provided by way of illustration. Other aspects and embodiments of the present invention are contemplated by the inventors, as will be clear to those of skill in the art from reading the present disclosure.

ILLUSTRATIVE EXAMPLES

Libraries and Sequencing

1. Shotgun Sequencing Probability Analysis

The overall strategy for a shotgun approach to whole genome sequencing follows from the Lander and Waterman (Landerman and Waterman, *Genomics* 2:231 (1988)) application of the equation for the Poisson distribution. According to this treatment, the probability, P, that any given base in a sequence of size L, in nucleotides, is not sequenced after a certain amount, n, in nucleotides, of random sequence has been determined can be calculated by the equation $P=e^{-m}$, where m is L/n, the fold coverage. For instance, for a genome of 2.8 Mb, m=1 when 2.8 Mb of sequence has been randomly generated (1×coverage). At that point, $P=e^{-1}=0.37$. The probability that any given base has not been sequenced is the same as the probability that any region of the whole sequence L has not been determined and, therefore, is equivalent to the fraction of the whole sequence that has yet to be determined, Thus, at one-fold coverage, approximately 37% of a polynucleotide of size L, in nucleotides has not been sequenced. When 14 Mb of sequence has been generated, coverage is 5× for a 2.8 Mb and the unsequenced fraction drops to 0.0067 or 0.67%. 5×coverage of a 2.8 Mb sequence can be attained by sequencing approximately 17,000 random clones from both insert ends with an average sequence read length of 410 bp.

Similarly, the total gap length, G, is determined by the equation $G=Le^{-m}$, and the average gap size, g, follows the equation, $g=L/n$. Thus, 5×coverage leaves about 240 gaps averaging about 82 bp in size in a sequence of a polynucleotide 2.8 Mb long.

The treatment above is essentially that of Lander and Waterman, *Genomics* 2: 231 (1988).

2. Random Library Construction

In order to approximate the random model described above during actual sequencing, a nearly ideal library of cloned genomic fragments is required. The following library construction procedure was developed to achieve this end.

*Streptococcus pneumoniae* DNA is prepared by phenol extraction. A mixture containing 200 µg DNA in 1.0 ml of 300 mM sodium acetate, 10 mM Tris-HCl, 1 mM Na-EDTA, 50% glycerol is processed through a nebulizer (IPI Medical Products) with a stream of nitrogen adjusted to 35 Kpa for 2 minutes. The sonicated DNA is ethanol precipitated and redissolved in 500 µl TE buffer.

To create blunt-ends, a 100 µl aliquot of the resuspended DNA is digested with 5 units of BAL31 nuclease (New England BioLabs) for 10 min at 30° C. in 200 µl BAL31 buffer. The digested DNA is phenol-extracted, ethanol-precipitated, redissolved in 100 µl TE buffer, and then size-fractionated by electrophoresis through a 1.0% low melting temperature agarose gel. The section containing DNA fragments 1.6–2.0 kb in size is excised from the gel, and the LGT agarose is melted and the resulting solution is extracted with phenol to separate the agarose from the DNA. DNA is ethanol precipitated and redissolved in 20 µl of TE buffer for ligation to vector.

A two-step ligation procedure is used to produce a plasmid library with 97% inserts, of which >99% were single inserts. The first ligation mixture (50 ul) contains 2 µg of DNA fragments, 2 µg pUC18 DNA (Pharmacia) cut with SmaI and dephosphorylated with bacterial alkaline phosphatase, and 10 units of T4 ligase (GIBCO/BRL) and is incubated at 14° C. for 4 hr. The ligation mixture then is phenol extracted and ethanol precipitated, and the precipitated DNA is dissolved in 20 µl TE buffer and electrophoresed on a 1.0% low melting agarose gel. Discrete bands in a ladder are visualized by ethidium bromide-staining and UV illumination and identified by size as insert (I), vector (v), v+I, v+2i, v+3i, etc. The portion of the gel containing v+I DNA is excised and the v+I DNA is recovered and resuspended into 20 µl TE. The v+I DNA then is blunt-ended by T4 polymerase treatment for 5 min. at 37° C. in a reaction mixture (50 ul) containing the v+I linears, 500 µM each of the 4 dNTPs, and 9 units of T4 polymerase (New England BioLabs), under recommended buffer conditions. After phenol extraction and ethanol precipitation the repaired v+I linears are dissolved in 20 µl TE, The final ligation to produce circles is carried out in a 50 µl reaction containing 5 µl of v+I linears and 5 units of T4 ligase at 14° C. overnight. After 10 min. at 70° C. the following day, the reaction mixture is stored at −20° C.

This two-stage procedure results in a molecularly random collection of single-insert plasmid recombinants with minimal contamination from double-insert chimeras (<1%) or free vector (<3%).

Since deviation from randomness can arise from propagation the DNA in the host, *E. coli* host cells deficient in all recombination and restriction functions (A. Greener, *Strategies* 3 (1):5 (1990)) are used to prevent rearrangements, deletions, and loss of clones by restriction. Furthermore, transformed cells are plated directly on antibiotic diffusion plates to avoid the usual broth recovery phase which allows multiplication and selection of the most rapidly growing cells.

Plating is carried out as follows. A 100 µl aliquot of Epicurian Coli SURE II Supercompetent Cells (Stratagene 200152) is thawed on ice and transferred to a chilled Falcon 2059 tube on ice. A 1.7 µl aliquot of 1.42 M beta-mercaptoethanol is added to the aliquot of cells to a final concentration of 25 mM. Cells are incubated on ice for 10 min. A 1 µl aliquot of the final ligation is added to the cells and incubated on ice for 30 min. The cells are heat pulsed for 30 sec. at 42° C. and placed back on ice for 2 min. The outgrowth period in liquid culture is eliminated from this protocol in order to minimize the preferential growth of any given transformed cell. Instead the transformation mixture is plated directly on a nutrient rich SOB plate containing a 5 ml bottom layer of SOB agar (5% SOB agar: 20 g tryptone, 5 g yeast extract, 0.5 g NaCl, 1.5% Difco Agar per liter of media). The 5 ml bottom layer is supplemented with 0.4 ml of 50 mg/ml ampicillin per 100 ml SOB agar. The 15 ml top layer of SOB agar is supplemented with 1 ml X-Gal (2%), 1 ml MgCl (1 M), and 1 ml MgSO/100 ml SOB agar. The 15 ml top layer is poured just prior to plating. Our titer is approximately 100 colonies/10 µl aliquot of transformation.

All Colonies are picked for template preparation regardless of size. Thus, only clones lost due to "poison" DNA or deleterious gene products are deleted from the library, resulting in a slight increase in gap number over that expected.

3. Random DNA Sequencing

High quality double stranded DNA plasmid templates are prepared using a "boiling bead" method developed in collaboration with Advanced Genetic Technology Corp. (Gaithersburg, Md.) (Adams et al., *Science* 252:1651 (1991); Adams et al., *Nature* 355:632 (1992)). Plasmid preparation is performed in a 96-well format for all stages of DNA preparation from bacterial growth through final DNA purification. Template concentration is determined using Hoechst Dye and a Millipore Cytofluor. DNA concentrations are not adjusted, but low-yielding templates are identified where possible and not sequenced.

Templates are also prepared from two *Streptococcus pneumoniae* lambda genomic libraries. An amplified library is constructed in the vector Lambda GEM-12 (Promega) and an unamplified library is constructed in Lambda DASH II (Stratagene). In particular, for the unamplified lambda library, *Streptococcus pneumoniae* DNA (>100 kb) is partially digested in a reaction mixture (200 ul) containing 50 µg DNA, 1×Sau3AI buffer, 20 units Sau3AI for 6 min. at 23° C. The digested DNA was phenol-extracted and electrophoresed on a 0.5% low melting agarose gel at 2V/cm for 7 hours. Fragments from 15 to 25 kb are excised and recovered in a final volume of 6 ul. One µl of fragments is used with 1 µl of DASHII vector (Stratagene) in the recommended ligation reaction. One µl of the ligation mixture is used per packaging reaction following the recommended protocol with the Gigapack II XL Packaging Extract (Stratagene, #227711). Phage are plated directly without amplification from the packaging mixture (after dilution with 500 µl of recommended SM buffer and chloroform treatment). Yield is about 2.5×10³ pfu/ul. The amplified library is prepared essentially as above except the lambda GEM-12 vector is used. After packaging, about 3.5×10⁴ pfu are plated on the restrictive NM539 host. The lysate is harvested in 2 ml of SM buffer and stored frozen in 7% dimethylsulfoxide. The phage titer is approximately 1×10⁹ pfu/ml.

Liquid lysates (100 µl) are prepared from randomly selected plaques (from the unamplified library) and template is prepared by long-range PCR using T7 and T3 vector-specific primers.

Sequencing reactions are carried out on plasmid and/or PCR templates using the AB Catalyst LabStation with Applied Biosystems PRISM Ready Reaction Dye Primer Cycle Sequencing Kits for the M13 forward (M13–21) and the M13 reverse (M13RP1) primers (Adams et al., *Nature* 368:474 (1994)). Dye terminator sequencing reactions are carried out on the lambda templates on a Perkin-Elmer 9600 Thermocycler using the Applied Biosystems Ready Reaction Dye Terminator Cycle Sequencing kits. T7 and SP6 primers are used to sequence the ends of the inserts from the Lambda GEM-12 library and T7 and T3 primers are used to sequence the ends of the inserts from the Lambda DASH II library. Sequencing reactions are performed by eight individuals using an average of fourteen AB 373 DNA Sequencers per day. All sequencing reactions are analyzed using the Stretch modification of the AB 373, primarily using a 34 cm well-to-read distance. The overall sequencing success rate very approximately is about 85% for M13–21 and M13RP1 sequences and 65% for dye-terminator reactions. The average usable read length is 485 bp for M13–21 sequences, 445 bp for M13RP1 sequences, and 375 bp for dye-terminator reactions.

Richards et al., Chapter 28 in AUTOMATED DNA SEQUENCING AND ANALYSIS, M. D. Adams, C. Fields, J. C. Venter, Eds., Academic Press, London, (1994) described the value of using sequence from both ends of sequencing templates to facilitate ordering of contigs in shotgun assembly projects of lambda and cosmid clones. We balance the desirability of both-end sequencing (including the reduced cost of lower total number of templates) against shorter read-lengths for sequencing reactions performed with the M13RP1 (reverse) primer compared to the M13–21 (forward) primer. Approximately one-half of the templates are sequenced from both ends. Random reverse sequencing reactions are done based on successful forward sequencing reactions. Some M13RP1 sequences are obtained in a semi-directed fashion: M13–21: sequences pointing outward at the ends of contigs are chosen for M13RP1 sequencing in an effort to specifically order contigs.

4. Protocol for Automated Cycle Sequencing

The sequencing is carried out using ABI Catalyst robots and AB 373 Automated DNA Sequencers. The Catalyst robot is a publicly available sophisticated pipetting and temperature control robot which has been developed specifically for DNA sequencing reactions. The Catalyst combines pre-aliquoted templates and reaction mixes consisting of deoxy- and dideoxynucleotides, the thermostable Taq DNA polymerase, fluorescently-labelled sequencing primers, and reaction buffer. Reaction mixes and templates are combined in the wells of an aluminum 96-well thermocycling plate. Thirty consecutive cycles of linear amplification (i.e., one primer synthesis) steps are performed including denaturation, annealing of primer and template, and extension; i. e., DNA synthesis. A heated lid with rubber gaskets on the thermocycling plate prevents evaporation without the need for an oil overlay.

Two sequencing protocols are used: one for dye-labelled primers and a second for dye-labelled dideoxy chain terminators. The shotgun sequencing involves use of four dye-labelled sequencing primers, one for each of the four terminator nucleotide. Each dye-primer is labelled with a different fluorescent dye, permitting the four individual reactions to be combined into one lane of the 373 DNA Sequencer for electrophoresis, detection, and base-calling. ABI currently supplies pre-mixed reaction mixes in bulk packages containing all the necessary non-template reagents for sequencing. Sequencing can be done with both plasmid and PCR-generated templates with both dye-primers and dye-terminators with approximately equal fidelity, although plasmid templates generally give longer usable sequences.

Thirty-two reactions are loaded per AB373 Sequencer each day, for a total of 960 samples. Electrophoresis is run overnight following the manufacturer's protocols, and the data is collected for twelve hours. Following electrophoresis and fluorescence detection, the ABI 373 performs automatic lane tracking and base-calling. The lane-tracking is confirmed visually. Each sequence electropherogram (or fluorescence lane trace) is inspected visually and assessed for quality. Trailing sequences of low quality are removed and the sequence itself is loaded via software to a Sybase database (archived daily to 8 mm tape). Leading vector polylinker sequence is removed automatically by a software program. Average edited lengths of sequences from the standard ABI 373 are around 400 bp and depend mostly on the quality of the template used for the sequencing reaction. ABI 373 Sequencers converted to Stretch Liners provide a longer electrophoresis path prior to fluorescence detection and increase the average number of usable bases to 500–600 bp.

Informatics

1. Data Management

A number of information management systems for a large-scale sequencing lab have been developed. (For review see, for instance, Kerlavage et al., *Proceedings of the Twenty-Sixth Annual Hawaii International Conference on System Sciences*, IEEE Computer Society Press, Washington D. C., 585 (1993)) The system used to collect and assemble the sequence data was developed using the Sybase relational database management system and was designed to automate data flow wherever possible and to reduce user error. The database stores and correlates all information collected during the entire operation from template preparation to final analysis of the genome. Because the raw output of the ABI 373 Sequencers was based on a Macintosh platform and the data management system chosen was based on a Unix platform, it was necessary to design and implement a variety of multi-user, client-server applications which allow the raw data as well as analysis results to flow seamlessly into the database with a minimum of user effort.

2. Assembly

An assembly engine (TIGR Assembler) developed for the rapid and accurate assembly of thousands of sequence fragments was employed to generate contigs. The TIGR assembler simultaneously clusters and assembles fragments of the genome. In order to obtain the speed necessary to assemble more than $10^4$ fragments, the algorithm builds a hash table of 12 bp oligonucleotide subsequences to generate a list of potential sequence fragment overlaps. The number of potential overlaps for each fragment determines which fragments are likely to fall into repetitive elements. Beginning with a single seed sequence fragment, TIGR Assembler extends the current contig by attempting to add the best matching fragment based on oligonucleotide content. The contig and candidate fragment are aligned using a modified version of the Smith-Waterman algorithm which provides for optimal gapped alignments (Waterman, M. S., *Methods in Enzymology* 164:765 (1988)). The contig is extended by the fragment only if strict criteria for the quality of the match are met. The match criteria include the minimum length of overlap, the maximum length of an unmatched end, and the minimum percentage match. These criteria are automatically lowered by the algorithm in regions of minimal coverage and raised in regions with a possible repetitive element. The number of potential overlaps for each fragment determines which fragments are likely to fall into repetitive elements. Fragments representing the boundaries of repetitive elements and potentially chimeric fragments are often rejected based on partial mismatches at the ends of alignments and excluded from the current contig. TIGR Assembler is designed to take advantage of clone size information coupled with sequencing from both ends of each template. It enforces the constraint that sequence fragments from two ends of the same template point toward one another in the contig and are located within a certain range of base pairs (definable for each clone based on the known clone size range for a given library).

The process resulted in 391 contigs as represented by SEQ ID NOs:1–391.

3. Identifying Genes

The predicted coding regions of the *Streptococcus pneumoniae* genome were initially defined with the program GeneMark, which finds ORFs using a probabilistic classification technique. The predicted coding region sequences were used in searches against a database of all nucleotide sequences from GenBank (October, 1997), using the BLASTN search method to identify overlaps of 50 or more nucleotides with at least a 95% identity. Those ORFs with nucleotide sequence matches are shown in Table 1. The ORFs without such matches were translated to protein sequences and compared to a non-redundant database of known proteins generated by combining the Swiss-prot, PIR and GenPept databases. ORFs that matched a database protein with BLASTP probability less than or equal to 0.01 are shown in Table 2. The table also lists assigned functions based on the closest match in the databases. ORFs that did not match protein or nucleotide sequences in the databases at these levels are shown in Table 3.

Illustrative Applications

1. Production of an Antibody to a *Streptococcus pneumoniae* Protein

Substantially pure protein or Polypeptide is isolated from the transfected or transformed cells using any one of the methods known in the art. The protein can also be produced in a recombinant prokaryotic expression system, such as *E. coli*, or can be chemically synthesized. Concentration of protein in the final preparation is adjusted, for example, by concentration on an Amicon filter device, to the level of a few micrograms/ml Monoclonal or polyclonal antibody to the protein can then be prepared as follows.

2. Monoclonal Antibody Production by Hybridoma Fusion

Monoclonal antibody to epitopes of any of the peptides identified and isolated as described can be prepared from murine hybridomas according to the classical method of Kohler, G. and Milstein, C., *Nature* 256:495 (1975) or modifications of the methods thereof. Briefly, a mouse is repetitively inoculated with a few micrograms of the selected protein over a period of a few weeks. The mouse is then sacrificed, and the antibody producing cells of the spleen isolated. The spleen cells are fused by means of Polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall, E., *Meth. Enzymol.* 70:419 (1980), and modified methods thereof. Selected positive clones can be expanded and their monoclonal antibody product harvested for use. Detailed procedures for monoclonal antibody production are described in Davis, L. et al., *Basic Methods in Molecular Biology*, Elsevier, N.Y. Section 21-2 (1989).

3. Polyclonal Antibody Production by Immunization

Polyclonal antiserum containing antibodies to heterogenous epitopes of a single protein can be prepared by immunizing suitable animals with the expressed protein described above, which can be unmodified or modified to enhance immunogenicity. Effective polyclonal antibody production is affected by many factors related both to the antigen and the host species. For example, small molecules tend to be less immunogenic than others and may require the use of carriers and adjuvant. Also, host animals vary in response to site of inoculations and dose, with both inadequate or excessive doses of antigen resulting in low titer antisera. Small doses (ng level) of antigen administered at multiple intradermal sites appears to be most reliable. An effective immunization protocol for rabbits can be found in Vaitukaitis, J. et al., *J. Clin.* Endocrinol. Metab. 33:988–991 (1971).

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, O. et al., Chap. 19 in: *Handbook of Experimental Immunology*, Wier, D., ed, Blackwell (1973). Plateau concentration of antibody is usually in the range of 0.1 to 0.2 mg/ml of serum (about 12M). Affinity of the antisera for the antigen is determined by preparing competitive binding curves, as described, for example, by Fisher, D., Chap. 42 in: *Manual of Clinical Immunology*, second edition, Rose and Friedman, eds., Amer. Soc. For Microbiology, Washington, D. C. (1980)

Antibody preparations prepared according to either protocol are useful in quantitative immunoassays which determine concentrations of antigen-bearing substances in biological samples; they are also used semi-quantitatively or qualitatively to identify the presence of antigen in a biological sample. In addition, antibodies are useful in various animal models of pneumococcal disease as a means of evaluating the protein used to make the antibody as a potential vaccine target or as a means of evaluating the antibody as a potential immunotherapeutic or immunoprophylactic reagent.

4. Preparation of PCR Primers and Amplification of DNA

Various fragments of the *Streptococcus pneumoniae* genome, such as those of Tables 1–3 and SEQ ID NOS:1–391 can be used, in accordance with the present invention, to prepare PCR primers for a variety of uses. The PCR primers are preferably at least 15 bases, and more preferably at least 18 bases in length. When selecting a primer sequence, it is preferred that the primer pairs have approximately the same G/C ratio, so that melting temperatures are approximately the same. The PCR primers and amplified DNA of this Example find use in the Examples that follow.

5. Gene expression from DNA Sequences Corresponding to ORFs

A fragment of the *Streptococcus pneumoniae* genome provided in Tables 1–3 is introduced into an expression vector using conventional technology. Techniques to transfer cloned sequences into expression vectors that direct protein translation in mammalian, yeast, insect or bacterial expression systems are well known in the art. Commercially available vectors and expression systems are available from a variety of suppliers including Stratagene (La Jolla, Calif.), Promega (Madison, Wis.), and Invitrogen (San Diego, Calif.). If desired, to enhance expression and facilitate proper protein folding, the codon context and codon pairing of the sequence may be optimized for the particular expression organism, as explained by Hatfield et al., U.S. Pat. No. 5,082,767, incorporated herein by this reference.

The following is provided as one exemplary method to generate polypeptide(s) from cloned ORFs of the *Streptococcus pneumoniae* genome fragment. Bacterial ORFs generally lack a poly A addition signal. The addition signal sequence can be added to the construct by, for example, splicing out the poly A addition sequence from pSG5 (Stratagene) using BglI and SalI restriction endonuclease enzymes and incorporating it into the mammalian expression vector pXT1 (Stratagene) for use in eukaryotic expression systems. pXT1 contains the LTRs and a portion of the gag gene of Moloney Murine Leukemia Virus. The positions of the LTRs in the construct allow efficient stable transfection. The vector includes the Herpes Simplex thymidine kinase promoter and the selectable neomycin gene. The *Streptococcus pneumoniae* DNA is obtained by PCR from the bacterial vector using oligonucleotide primers complementary to the *Streptococcus pneumoniae* DNA and containing restriction endonuclease sequences for PstI incorporated into the 5' primer and BglII at the 5' end of the corresponding *Streptococcus pneumoniae* DNA 3' primer, taking care to ensure that the *Streptococcus pneumoniae* DNA is positioned such that its followed with the poly A addition sequence. The purified fragment obtained from the resulting PCR reaction is digested with PstI, blunt ended with an exonuclease, digested with BglII, purified and ligated to pXT1, now containing a poly A addition sequence and digested BglII.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 ug/ml G418 (Sigma, St. Louis, Mo.). The protein is preferably released into the supernatant. However if the protein has membrane binding domains, the protein may additionally be retained within the cell or expression may be restricted to the cell surface. Since it may be necessary to purify and locate the transfected product, synthetic 15-mer peptides synthesized from the predicted *Streptococcus pneumoniae* DNA sequence are injected into mice to generate antibody to the polypeptide encoded by the *Streptococcus pneumoniae* DNA.

Alternatively and if antibody production is not possible, the *Streptococcus pneumoniae* DNA sequence is additionally incorporated into eukaryotic expression vectors and expressed as, for example, a globin fusion. Antibody to the globin moiety then is used to purify the chimeric protein. Corresponding protease cleavage sites are engineered between the globin moiety and the polypeptide encoded by the *Streptococcus pneumoniae* DNA so that the latter may be freed from the formed by simple protease digestion. One useful expression vector for generating globin chimerics is pSG5 (Stratagene). This vector encodes a rabbit globin. Intron II of the rabbit globin gene facilitates splicing of the expressed transcript, and the polyadenylation signal incorporated into the construct increases the level of expression. These techniques are well known to those skilled in the art of molecular biology. Standard methods are published in methods texts such as Davis et al., cited elsewhere herein, and many of the methods are available from the technical assistance representatives from Stratagene, Life Technologies, Inc., or Promega. Polypeptides of the invention also may be produced using in vitro translation systems such as in vitro Express™ Translation Kit (Stratagene).

While the present invention has been described in some detail for purposes of clarity and understanding, one skilled in the art will appreciate that various changes in form and detail can be made without departing from the true scope of the invention.

All patents, patent applications and publications referred to above are hereby incorporated by reference.

TABLE 1

S. pneumoniae - Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 1 | 1 | 437 | 1003 | gb|U41735| | Streptococcus pneumoniae peptide methionine sulfoxide reductase (msrA) and homoserine kinase homolog (thrB) genes, complete cds | 92 | 200 | 567 |
| 2 | 5 | 6169 | 5720 | gb|U04047| | Streptococcus pneumoniae SSZ dextran glucosidase gene and insertion sequence IS1202 transposase gene, complete cds | 96 | 450 | 450 |
| 2 | 6 | 6592 | 6167 | emb|Z83335|SPZ8 | S. pneumoniae dexB, capl[A,B,C,D,E,F,G,H,I,J,K] genes, dTDP-rhamnose biosynthesis genes and aliA gene | 98 | 426 | 426 |
| 3 | 11 | 9770 | 9147 | emb|Z83335|SPZ8 | S. pneumoniae dexB, capl[A,B,C,D,E,F,G,H,I,J,K] genes, dTDP-rhamnose biosynthesis genes and aliA gene | 94 | 624 | 624 |
| 3 | 12 | 10489 | 9671 | emb|Z83335|SPZ8 | S. pneumoniae dexB, capl[A,B,C,D,E,F,G,H,I,J,K] genes, dTDP-rhamnose biosynthesis genes and aliA gene | 91 | 819 | 819 |
| 3 | 13 | 11546 | 12019 | gb|U43526| | Streptococcus pneumoniae neuraminidase B (nanB) gene, complete cds, and neuraminidase (nanA) gene, partial cds | 99 | 474 | 474 |
| 3 | 14 | 12017 | 13375 | gb|U43526| | Streptococcus pneumoniae neuraminidase B (nanB) gene, complete cds, and neuraminidase (nanA) gene, partial cds | 99 | 1359 | 1359 |
| 3 | 15 | 13421 | 14338 | gb|U43526| | Streptococcus pneumoniae neuraminidase B (nanB) gene, complete cds, and neuraminidase (nanA) gene, partial cds | 99 | 918 | 918 |
| 3 | 16 | 14329 | 15171 | gb|U43526| | Streptococcus pneumoniae neuraminidase B (nanB) gene, complete cds, and neuraminidase (nanA) gene, partial cds | 99 | 843 | 843 |
| 3 | 17 | 15132 | 17282 | gb|U43526| | Streptococcus pneumoniae neuraminidase B (nanB) gene, complete cds, and neuraminidase (nanA) gene, partial cds | 99 | 2151 | 2151 |
| 3 | 18 | 17267 | 18397 | gb|U43526| | Streptococcus pneumoniae neuraminidase B (nanB) gene, complete cds, and neuraminidase (nanA) gene, partial cds | 99 | 1069 | 1131 |
| 4 | 1 | 46 | 1188 | emb|Y11463|SPDN | Streptococcus pneumoniae dnaG, rpoD, cpoA genes and ORF3 and ORF5 | 99 | 1143 | 1143 |
| 4 | 2 | 1198 | 2529 | emb|Y11463|SPDN | Streptococcus pneumoniae dnaG, rpoD, cpoA genes and ORF3 and ORF5 | 99 | 876 | 1332 |
| 5 | 7 | 11297 | 11473 | gb|U41735| | Streptococcus pneumoniae peptide methionine sulfoxide reductase (msrA) and homoserine kinase homolog (thrB) genes, complete cds | 82 | 175 | 177 |
| 6 | 7 | 7125 | 7364 | emb|Z77726|SPIS | S. pneumoniae DNA for insertion sequence IS1318 (1372 bp) | 93 | 238 | 240 |
| 6 | 8 | 7322 | 7570 | emb|Z77725|SPIS | S. pneumoniae DNA for insertion sequence IS1381 (966 bp) | 95 | 160 | 249 |
| 6 | 9 | 7533 | 7985 | emb|Z77725|SPIS | S. pneumoniae DNA for insertion sequence IS1381 (966 bp) | 99 | 453 | 453 |
| 6 | 23 | 20197 | 19733 | emb|Z83335|SPZ8 | S. pneumoniae dexB, capl[A,B,C,D,E,F,G,H,I,J,K] genes, dTDP-rhamnose biosynthesis genes and aliA gene | 96 | 465 | 465 |
| 7 | 10 | 8305 | 7682 | emb|Z83335|SPZ8 | S. pneumoniae dexB, capl[A,B,C,D,E,F,G,H,I,J,K] genes, dTDP-rhamnose biosynthesis genes and aliA gene | 95 | 624 | 624 |
| 7 | 11 | 9024 | 8206 | emb|Z83335|SPZ8 | S. pneumoniae dexB, capl[A,B,C,D,E,F,G,H,I,J,K] genes, dTDP-rhamnose biosynthesis genes and aliA gene | 95 | 819 | 819 |
| 10 | 13 | 9304 | 8078 | gb|L29323| | Streptococcus pneumoniae methyl transferase (mtr) gene cluster, complete cds | 93 | 513 | 1227 |
| 11 | 2 | 548 | 919 | emb|Z79691|SOOR | S. pneumoniae yorf[A,B,C,D,E], ftsL, pbpX and regR genes | 99 | 316 | 372 |
| 11 | 3 | 892 | 1980 | emb|Z79691|SOOR | S. pneumoniae yorf[A,B,C,D,E], ftsL, pbpX and regR genes | 99 | 1089 | 1089 |
| 11 | 5 | 3040 | 3477 | emb|Z79691|SOOR | S. pneumoniae yorf[A,B,C,D,E], ftsL, pbpX and regR genes | 99 | 259 | 438 |
| 11 | 6 | 3480 | 3247 | emb|Z79691|SOOR | S. pneumoniae yorf[A,B,C,D,E], ftsL, pbpX and regR genes | 99 | 234 | 234 |
| 11 | 7 | 3601 | 4557 | emb|Z79691|SOOR | S. pneumoniae yorf[A,B,C,D,E], ftsL, pbpX and regR genes | 98 | 957 | 957 |
| 11 | 8 | 4506 | 4886 | emb|Z79691|SOOR | S. pneumoniae yorf[A,B,C,D,E], ftsL, pbpX and regR genes | 99 | 381 | 381 |
| 11 | 9 | 4884 | 7142 | emb|X16367|SPPB | Streptococcus pneumoniae pbpX gene for penicillin binding protein 2X | 99 | 2259 | 2259 |
| 11 | 10 | 7132 | 8124 | emb|X16367|SPPB | Streptococcus pneumoniae pbpX gene for penicillin binding protein 2X | 98 | 70 | 993 |
| 13 | 1 | 53 | 1126 | gb|M31296| | S. pneumoniae recP gene, complete cds | 99 | 437 | 1074 |

TABLE 1-continued

S. pneumoniae - Coding regions containing known sequences

| Contig ID | ORF ID | Start (nt) | Stop (nt) | match accession | match gene name | percent ident | HSP nt length | ORF nt length |
|---|---|---|---|---|---|---|---|---|
| 14 | 3 | 1837 | 2148 | emb\|Z83335\|SPZ8 | S. pneumoniae desB, cap1[A,B,C,D,E,F,G,H,I,J,K] genes, dTDP-rhamnose bisynthesis genes and aliA gene | 87 | 96 | 312 |
| 14 | 4 | 2518 | 2108 | gb\|M36180\| | Streptococcus pneumoniae transposase, (comA and comB) and SAICAR synthetase (purC) genes, complete cds | 98 | 411 | 411 |
| 15 | 9 | 8942 | 8511 | gb\|U09239\| | Streptococcus pneumoniae type 19F capsular polysaccharide biosynthesis operon, (cps19 fABCDEFGHIJKLMNO) genes, complete cds, and aliA gene, partial cds | 89 | 340 | 432 |
| 17 | 7 | 3910 | 3458 | emb\|Z77726\|SPIS | S. pneumoniae DNA for insertion sequence IS1318 (1372 bp) | 98 | 453 | 453 |
| 17 | 8 | 4304 | 3873 | emb\|Z77727\|SPIS | S. pneumoniae DNA for insertion sequence IS1318 (823 bp) | 96 | 382 | 432 |
| 19 | 1 | 41 | 529 | emb\|X94909\|SPIG | S. pneumoniae iga gene | 75 | 368 | 489 |
| 19 | 2 | 554 | 757 | gb\|L07752\| | Streptococcus pneumoniae attachment site (attB), DNA sequence | 99 | 167 | 204 |
| 19 | 3 | 946 | 1827 | gb\|L07752\| | Streptococcus pneumoniae attachment site (attB), DNA sequence | 94 | 100 | 882 |
| 20 | 1 | 937 | 182 | gb\|U33315\| | Streptococcus pneumoniae orfL gene, partial cds, competence stimulating peptide precursor (comC), histidine protein kinase (comD) and response regulator (comE) genes, complete cds, tRNA-Arg and tRNA-Gln genes | 99 | 756 | 756 |
| 20 | 2 | 2271 | 931 | gb\|U33315\| | Streptococcus pneumoniae orfL gene, partial cds, competence stimulating peptide precursor (comC), histidine protein kinase (comD) and response regulator (comE) genes, complete cds, tRNA-Arg and tRNA-Gln genes | 98 | 1341 | 1341 |
| 20 | 3 | 3175 | 2684 | gb\|U76218\| | Streptococcus pneumoniae competence stimulating peptide precursor ComC (comC), histidine kinase homolog ComD (comD), and response regulator homolog ComE (comE) genes, complete cds | 99 | 492 | 492 |
| 20 | 4 | 3322 | 4527 | gb\|AF000658\| | Streptococcus pneumoniae R801 tRNA-Arg gene, partial sequence, and putative serine protease (sphtra), SPSpoJ (spspoJ), initiator protein (spdnaa) and beta subunit of DNA polymerase III (spdnan) genes, complete cds | 99 | 1206 | 1206 |
| 20 | 5 | 4573 | 5343 | gb\|AF000658\| | Streptococcus pneumoniae R801 tRNA-Arg gene, partial sequence, and putative serine protease (sphtra), SPSpoJ (spspoJ), initiator protein (spdnaa) and beta subunit of DNA polymerase III (spdnan) genes, complete cds | 99 | 771 | 771 |
| 20 | 6 | 5532 | 6917 | gb\|AF000658\| | Streptococcus pneumoniae R801 tRNA-Arg gene, partial sequence, and putative serine protease (sphtra), SPSpoJ (spspoJ), initiator protein (spdnaa) and beta subunit of DNA polymerase III (spdnan) genes, complete cds | 99 | 1386 | 1386 |
| 20 | 7 | 6995 | 8212 | gb\|AF000658\| | Streptococcus pneumoniae R801 tRNA-Arg gene, partial sequence, and putative serine protease (sphtra), SPSpoJ (spspoJ), initiator protein (spdnaa) and beta subunit of DNA polymerase III (spdnan) genes, complete cds | 99 | 1218 | 1218 |
| 20 | 8 | 8214 | 8471 | gb\|AF000658\| | Streptococcus pneumoniae R801 tRNA-Arg gene, partial sequence, and putative serine protease (sphtra), SPSpoJ (spspoJ), initiator protein (spdnaa) and beta subunit of DNA polymerase III (spdnan) genes, complete cds | 98 | 258 | 258 |
| 20 | 9 | 8534 | 9670 | gb\|AF000658\| | Streptococcus pneumoniae R801 tRNA-Arg gene, partial sequence, and putative serine protease (sphtra), SPSpoJ (spspoJ), initiator protein (spdnaa) and beta subunit of DNA polymerase III (spdnan) genes, complete cds | 99 | 134 | 1137 |
| 22 | 14 | 11887 | 12267 | emb\|Z77726\|SPIS | S. pneumoniae DNA for insertion sequence IS1318 (1372 bp) | 99 | 226 | 381 |
| 22 | 15 | 12708 | 12256 | emb\|Z77727\|SPIS | S. pneumoniae DNA for insertion sequence IS1318 (823 bp) | 97 | 353 | 453 |
| 22 | 16 | 13165 | 12662 | emb\|Z77726\|SPIS | S. pneumoniae DNA for insertion sequence IS1318 (1372 bp) | 98 | 504 | 504 |
| 22 | 23 | 18398 | 18910 | emb\|Z86112\|SPZ8 | S. pneumoniae genes encoding galacturonosyl transferase and transposase and insertion sequence IS1515 | 95 | 463 | 513 |
| 22 | 24 | 18829 | 19299 | emb\|Z86112\|SPZ8 | S. pneumoniae genes encoding galacturonosyl transferase and transposase and insertion sequence IS1515 | 99 | 443 | 471 |
| 23 | 5 | 5624 | 4203 | emb\|X52474\|SPPL | S. pneumoniae ply gene for pneumolysin | 99 | 1422 | 1422 |

TABLE 1-continued

S. pneumoniae - Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 23 | 6 | 6063 | 5629 | gb|M17717| | S. pneumoniae pneumolysin gene, complete cds | 98 | 197 | 435 |
| 26 | 1 | 5500 | 2 | emb|X94909|SPIG | S. pneumoniae iga gene | 87 | 3487 | 5499 |
| 26 | 2 | 5823 | 5584 | gb|U47687| | Streptococcus pneumoniae immunoglobulin A1 protease (iga) gene, complete cds | 99 | 151 | 240 |
| 26 | 3 | 6878 | 5685 | gb|U47687| | Streptococcus pneumoniae immunoglobulin A1 protease (iga) gene, complete cds | 100 | 50 | 1194 |
| 26 | 8 | 14498 | 14854 | emb|Z83335|SPX8 | S. pnuemoniae dexB, cap1[A,B,C,D,E,F,G,H,I,J,K] genes, dTDP-rhamnose biosynthesis genes and aliA gene | 99 | 338 | 357 |
| 26 | 9 | 14763 | 14924 | emb|Z83335|SPZ8 | S. pnuemoniae dexB, cap1[A,B,C,D,E,F,G,H,I,J,K] genes, dTDP-rhamnose biosynthesis genes and aliA gene | 100 | 94 | 162 |
| 26 | 10 | 14922 | 15173 | gb|U04047| | Streptococcus pneumoniae SSZ dextran glucosidase gene and insertion sequence IS1202 transposase gene, complete cds | 97 | 242 | 252 |
| 28 | 1 | 80 | 505 | gb|U04047| | S. pnuemoniae dexB, cap1[A,B,C,D,E,F,G,H,I,J,K] genes, dTDP-rhamnose biosynthesis genes and aliA gene | 99 | 426 | 426 |
| 28 | 2 | 503 | 952 | gb|U04047| | Streptococcus pneumoniae SSZ dextran glucosidase gene and insertion sequence IS1202 transposase gene, complete cds | 97 | 450 | 450 |
| 28 | 3 | 780 | 1298 | gb|U04047| | Streptococcus pneumoniae SSZ dextran glucosidase gene and insertion sequence IS1202 transposase gene, complete cds | 96 | 181 | 519 |
| 34 | 1 | 207 | 1523 | gb|L08611| | Streptococcus pneumoniae maltose/maltodextrin uptake (malX) and two maltodextrin permease (malC and MalD) genes, complete cds | 99 | 1317 | 1317 |
| 34 | 2 | 1477 | 2367 | gb|L08611| | Streptococcus pneumoniae maltose/maltodextrin uptake (malX) and two maltodextrin permease (malC and MalD) genes, complete cds | 96 | 795 | 891 |
| 34 | 3 | 2593 | 3420 | gb|L21856| | Streptococcus pneumoniae malA gene, complete cds; malR gene, complete cds | 96 | 446 | 828 |
| 34 | 4 | 2790 | 2647 | gb|L21856| | Streptococcus pneumoniae malA gene, complete cds; malR gene, complete cds | 98 | 137 | 144 |
| 34 | 5 | 3418 | 4416 | gb|L21856| | Streptococcus pneumoniae malA gene, complete cds; malR gene, complete cds | 96 | 999 | 999 |
| 34 | 9 | 7764 | 7507 | gb|U41735| | Streptococcus pneumoniae peptide methionine sulfoxide reductase (msrA) and homoserine kinase homolog (thrB) genes, complete cds | 93 | 201 | 258 |
| 34 | 16 | 10562 | 10257 | emb|X63602|SPBO | S. pnuemoniae mmsA-Box | 92 | 238 | 306 |
| 35 | 4 | 1176 | 1439 | emb|Z83335|SPX8 | S. pnuemoniae dexB, cap1[A,B,C,D,E,F,G,H,I,J,K] genes, dTDP-rhamnose biosynthesis genes and aliA gene | 87 | 248 | 264 |
| 35 | 5 | 1458 | 1961 | gb|U09239| | Streptococcus pneumoniae type 19F capsular polysaccharide biosynthesis operon, (cps19 fABCDEFGHIJKLMNO) genes, complete cds, and aliA gene, partial cds | 98 | 264 | 504 |
| 35 | 17 | 16172 | 15477 | emb|X85787|SPCP | S. pneumoniae dexB, cps14A, cps14B, cps14C, cps14D, cps14E, cps14F, cps14G, cps14H, cps14I, cps14J, cps14K, cps14L, tasA genes | 97 | 696 | 696 |
| 35 | 18 | 16961 | 16170 | emb|Z83335|SPX8 | S. pnuemoniae dexB, cap1[A,B,C,D,E,F,G,H,I,J,K] genes, dTDP-rhamnose biosynthesis genes and aliA gene | 86 | 792 | 792 |
| 35 | 19 | 17620 | 16871 | gb|U09239| | Streptococcus pneumoniae type 19F capsular polysaccharide biosynthesis operon, (cps19fABCDEFGHIJKLMNO) genes, complete cds, and aliA gene, partial cds | 83 | 750 | 750 |
| 35 | 20 | 19061 | 17604 | emb|X85787|SPCP | S. pneumoniae dexB, cps14A, cps14B, cps14C, cps14D, cps14E, cps14F, cps14G, cps14H, cps14I, cps14J, cps14K, cps14L, tasA genes | 94 | 1458 | 1458 |
| 36 | 19 | 18960 | 18352 | gb|U40786| | Streptococcus pneumoniae surface antigen A variant precursor (psaA) and 18 kDa protein genes, complete cds, and ORF1 gene, partial cds | 99 | 609 | 609 |
| 36 | 20 | 19934 | 18966 | gb|U53509| | Streptococcus pneumoniae surface adhesin A precursor (psaA) gene, complete cds | 99 | 969 | 969 |
| 37 | 1 | 2743 | 179 | emb|Z67739|SPPA | S. pneumoniae parC, parE and transposase genes and unknown orf | 99 | 2565 | 2565 |

TABLE 1-continued

S. pneumoniae - Coding regions containing known sequences

| Contig ID | ORF ID | Start (nt) | Stop (nt) | match accession | match gene name | percent ident | HSP nt length | ORF nt length |
|---|---|---|---|---|---|---|---|---|
| 37 | 2 | 2985 | 2824 | emb\|Z67739\|SPPA | S. pneumoniae parC, parE and transposase genes and unknown orf | 100 | 162 | 162 |
| 37 | 3 | 5034 | 3070 | emb\|Z67739\|SPPA | S. pneumoniae parC, parE and transposase genes and unknown orf | 99 | 1965 | 1965 |
| 37 | 4 | 5134 | 5790 | emb\|Z67739\|SPPA | S. pneumoniae parC, parE and transposase genes and unknown orf | 99 | 657 | 657 |
| 37 | 5 | 6171 | 5833 | emb\|Z67739\|SPPA | S. pneumoniae parC, parE and transposase genee and unknown orf | 96 | 339 | 339 |
| 38 | 19 | 12969 | 13268 | gb\|M28679\| | S. pneumoniae promoter region DNA | 100 | 64 | 300 |
| 39 | 2 | 1256 | 2137 | gb\|U41735\| | Streptococcus pneumoniae peptide methionine sulfoxide reductase (msrA) and homoserine kinase homolog (thrB) genes, complete cds | 99 | 882 | 882 |
| 39 | 3 | 2405 | 3370 | gb\|U41735\| | Streptococcus pneumoniae peptide methionine sulfoxide reductase (msrA) and homoserine kinase homolog (thrB) genes, complete cds | 99 | 966 | 966 |
| 40 | 9 | 5253 | 7208 | gb\|M29686\| | S. pneumoniae mismatch repair (hexB) gene, complete cds | 99 | 1956 | 1956 |
| 41 | 1 | 3 | 1037 | emb\|Z17307\|SPRE | S. pneumoniae recA gene encoding RecA | 99 | 1027 | 1035 |
| 41 | 2 | 1328 | 2713 | emb\|Z34303\|SPCI | Streptococcus pneumoniae cin operon encoding the cinA, recA, dinF, lytA genes, and downstream sequences | 99 | 1386 | 3386 |
| 41 | 3 | 3083 | 4045 | gb\|M13812\| | S. pneumoniae autolysin (lytA) gene, complete cds | 99 | 963 | 963 |
| 41 | 4 | 3272 | 3096 | gb\|M13812\| | S. pneumoniae autolysin (lytA) gene, complete cds | 100 | 177 | 177 |
| 41 | 5 | 3603 | 3860 | gb\|M13812\| | S. pneumoniae autolysin (lytA) gene, complete cds | 100 | 258 | 258 |
| 41 | 6 | 4755 | 5162 | gb\|L36660\| | Streptococcus pneumoniae ORF, complete cds | 98 | 408 | 408 |
| 41 | 7 | 5270 | 5716 | gb\|L36660\| | Streptococcus pneumoniae ORF, complete cds | 98 | 447 | 447 |
| 41 | 8 | 6112 | 6918 | gb\|L36660\| | Streptococcus pneumoniae ORF, complete cds | 98 | 431 | 807 |
| 41 | 9 | 6916 | 7119 | gb\|L36660\| | Streptococcus pneumoniae ORF, complete cds | 100 | 204 | 204 |
| 41 | 10 | 7082 | 7660 | gb\|L36660\| | Streptococcus pneumoniae ORF, complete cds | 97 | 552 | 579 |
| 41 | 11 | 7680 | 7979 | gb\|L36660\| | Streptococcus pneumoniae ORF, complete cds | 98 | 81 | 300 |
| 41 | 12 | 9169 | 8717 | emb\|Z77727\|SPIS | S. pneumoniae DNA for insertion sequence IS1318 (823 bp) | 97 | 353 | 453 |
| 41 | 13 | 9533 | 9132 | emb\|Z77725\|SPIS | S. pneumoniae DNA for insertion sequence IS1381 (966 bp) | 95 | 160 | 402 |
| 41 | 14 | 9669 | 9475 | emb\|Z82001\|SPZ8 | S. pneumoniae pcpA gene and open reading frames | 100 | 189 | 195 |
| 44 | 5 | 7190 | 7555 | emb\|Z82001\|SPZ8 | S. pneumoniae pcpA gene and open reading frames | 99 | 366 | 366 |
| 44 | 6 | 8059 | 7607 | emb\|Z77726\|SPIS | S. pneumoniae DNA for insertion sequence IS1318 (1372 bp) | 97 | 453 | 453 |
| 44 | 7 | 8423 | 8022 | emb\|Z77725\|SPIS | S. pneumoniae DNA for insertion sequence IS1381 (966 bp) | 95 | 160 | 402 |
| 44 | 8 | 8559 | 8365 | emb\|Z82001\|SPZ8 | S. pneumoniae pcpA gene and open reading frames | 100 | 189 | 195 |
| 48 | 9 | 6480 | 4687 | gb\|L39074\| | Streptococcus pneumoniae pyruvate oxidase (spxB) gene, complete cds | 99 | 1794 | 1794 |
| 49 | 2 | 231 | 2603 | gb\|L20561\| | Streptococcus pneumoniae Exp7 gene, partial cds | 100 | 2373 | 2373 |
| 53 | 6 | 2407 | 2156 | gb\|U04047\| | Streptococcus pneumoniae SSZ dextran glucomidase gene and insertion sequence IS1202 transposase gene, complete cds | 97 | 242 | 252 |
| 53 | 7 | 2566 | 2405 | emb\|Z83335\|SPZ8 | S. pneuaoniae dexB, capI[A,B,C,D,E,F,G,H,I,J,K] genes, dTDP-rhamnose biosynthesis genes and aliA gene | 100 | 94 | 162 |
| 53 | 8 | 2831 | 2475 | emb\|Z83335\|SPZ8 | S. pneumoniae dexB, capI[A,B,C,D,E,F,G,H,I,J,K] genes, dTDP-rhamnose biosynthesis genes and aliA gene | 99 | 338 | 357 |
| 54 | 13 | 12409 | 11105 | emb\|Z83335\|SPZ8 | S. pneuoniae dexB, capI[A,B,C,D,E,F,G,H,I,J,K] genes, dTDP-rhamnose biosynthesis genes and aliA gene | 67 | 591 | 1305 |
| 55 | 22 | 20488 | 19949 | emb\|Z84379\|HSZ8 | S. pneumoniae dfr gene (isolate 92) | 99 | 540 | 540 |
| 61 | 11 | 11864 | 9900 | emb\|Z16082\|PNAL | Streptococcus pneumoniae aliB gene | 98 | 1965 | 1965 |
| 63 | 1 | 3 | 239 | gb\|M18729\| | S. pneumoniae mismatch repair protein (hexA) gene, complete cds | 100 | 237 | 237 |
| 63 | 2 | 233 | 2611 | gb\|M18729\| | S. pneumoniae mismatch repair protein (hexA) gene, complete cds | 99 | 2330 | 2379 |
| 63 | 3 | 2557 | 2823 | gb\|M18729\| | S. pneumoniae mismatch repair protein (hexA) gene, complete cds | 99 | 266 | 267 |
| 63 | 4 | 2958 | 4664 | gb\|M18729\| | S. pneumoniae mismatch repair protein (hexA) gene, complete cds | 95 | 69 | 1707 |
| 67 | 6 | 3770 | 3399 | gb\|L20670\| | Streptococcus pneumoniae hyaluronidase gene, complete cds | 96 | 372 | 372 |
| 67 | 7 | 7161 | 4171 | gb\|L20670\| | Streptococcus pneumoniae hyaluronidase gene, complete cds | 99 | 2938 | 2991 |

TABLE 1-continued

S. pneumoniae - Coding regions containing known sequences

| Contig ID | ORF ID | Start (nt) | Stop (nt) | match accession | match gene name | percent ident | HSP nt length | ORF nt length |
|---|---|---|---|---|---|---|---|---|
| 70 | 1 | 1 | 702 | gb|M14340| | S. pneumoniae DpnI gene region encoding dpnC and dpnD, complete cds | 100 | 693 | 702 |
| 70 | 2 | 678 | 1160 | gb|M14340| | S. pneumoniae DpnI gene region encoding dpnC and dpnD, complete cds | 100 | 483 | 483 |
| 70 | 3 | 2490 | 1210 | gb|M14339| | S. pneumoniae DpnII gene region encoding dpnM, dpnA, dpnB, complete cds | 98 | 462 | 1281 |
| 70 | 7 | 4230 | 4424 | gb|J04234| | S. pneumoniae exodeoxyribonuclease (exoA) gene, complete cds | 99 | 147 | 195 |
| 70 | 8 | 5197 | 4316 | gb|J04234| | S. pneumoniae exodeoxyribonuclease (exoA) gene, complete cds | 99 | 881 | 882 |
| 70 | 13 | 8108 | 9874 | gb|L20562| | Streptococcus pneumoniae Exp8 gene, partial cds | 93 | 234 | 1767 |
| 71 | 22 | 27964 | 28341 | emb|X63602|SPBO | S. pneumoniae mmsA-Box | 93 | 233 | 378 |
| 72 | 5 | 4607 | 3552 | emb|Z26850|SPAT | S. pneumoniae (M222) genes for ATPase a subunit, ATPase b subunit and ATPase c subunit | 97 | 102 | 1056 |
| 73 | 1 | 471 | 133 | emb|X63602|SPBO | S. pneumoniae mmsA-Box | 91 | 193 | 339 |
| 73 | 3 | 3658 | 977 | gb|J04479| | S. pneumoniae DNA polymerase I (polA) gene, complete cds | 99 | 2682 | 2682 |
| 73 | 8 | 4864 | 5379 | gb|M36180| | Streptococcus pneumoniae transposase, (comA and comB) and SAICAR synthetase (purC) genes, complete cds | 98 | 318 | 516 |
| 77 | 3 | 2622 | 1999 | emb|Z83335|SPZ8 | S. penumoniae dexB, cap1[A,B,C,D,E,F,G,H,I,J,K] genes and aliA gene biosynthesis genes and aliA gene | 95 | 624 | 624 |
| 77 | 4 | 3341 | 2523 | emb|Z83335|SPZ8 | S. penumoniae dexB, cap1[A,B,C,D,E,F,G,H,I,J,K] genes and aliA gene biosynthesis genes and aliA gene | 91 | 819 | 819 |
| 78 | 1 | 341 | 3 | emb|X77249|SPR6 | S. pneumoniae (R6) ciaR/ciaH genes | 99 | 339 | 339 |
| 78 | 2 | 1095 | 325 | emb|X77249|SPR6 | S. pneumoniae (R6) ciaR/ciaH genes | 99 | 771 | 771 |
| 82 | 10 | 11436 | 10816 | gb|U90721| | Streptococcus pneumoniae signal peptidase I (spi) gene, complete cds | 97 | 621 | 621 |
| 82 | 11 | 12402 | 11434 | gb|U93576| | Streptococcus pneumoniae ribonuclease HII (rnhB) gene, complete cds | 98 | 953 | 969 |
| 82 | 12 | 12381 | 12704 | gb|U93576| | Streptococcus pneumoniae ribonuclease HII (rnhB) gene, complete cds | 100 | 51 | 324 |
| 83 | 8 | 3212 | 3550 | emb|Z77727|SPIS | S. pneumoniae DNA for insertion sequence IS1318 (823 bp) | 97 | 290 | 339 |
| 83 | 10 | 4662 | 6851 | gb|M36180| | Streptococcus pneumoniae transposase, (comA and comB) and SAICAR synthetase (purC) genes, complete cds | 99 | 2190 | 2190 |
| 83 | 11 | 6849 | 8213 | gb|M36180| | Streptococcus pneumoniae transposase, (comA and comB) and SAICAR synthetase (purC) genes, complete cds | 99 | 1365 | 1365 |
| 83 | 12 | 8236 | 9090 | gb|M36180| | Streptococcus pneumoniae transposase, (comA and comB) and SAICAR synthetase (purC) genes, complete cds | 99 | 855 | 855 |
| 83 | 13 | 9283 | 13017 | gb|L15190| | Streptococcus pneumoniae SAICAR synthetase (purC) gene, complete cds | 100 | 107 | 3735 |
| 83 | 23 | 22147 | 23313 | gb|L36923| | Streptococcus pneumoniae beta-N-acetylhexosaminidase (strH) gene, complete cds | 98 | 218 | 1167 |
| 83 | 24 | 23268 | 23450 | gb|L36923| | Streptococcus pneumoniae beta-N-acetylhexosaminidase (strH) gene, complete cds | 98 | 172 | 183 |
| 83 | 25 | 27527 | 23505 | gb|L36923| | Streptococcus pneumoniae beta-N-acetylhexosaminidase (strH) gene, complete cds | 99 | 3826 | 4023 |
| 83 | 26 | 28472 | 27771 | gb|L36923| | Streptococcus pneumoniae beta-N-acetylhexosaminidase (strH) gene, complete cds | 99 | 416 | 702 |
| 84 | 4 | 4554 | 6173 | emb|Z83335|SPZB | S. pneumoniae dexB, cap1[A,B,C,D,E,F,G,H,I,J,K] genes and aliA gene biosynthesis genes and aliA gene | 98 | 697 | 1620 |
| 87 | 6 | 5951 | 5316 | emb|Z77725|SPIS | S. pneumoniae DNA for insertion sequence IS1381 (966 bp) | 96 | 439 | 636 |
| 88 | 5 | 2957 | 3511 | gb|M36180| | Streptococcus pneumoniae transposase, (comA and comB) and SAICAR synthetase (purC) genes, complete cds | 94 | 555 | 555 |
| 88 | 6 | 3466 | 4269 | gb|M36180| | Streptococcus pneumoniae transposase, (comA and comB) and SAICAR synthetase (purC) genes, complete cds | 94 | 804 | 804 |
| 89 | 13 | 9878 | 10093 | gb|M36180| | Streptococcus pneumoniae transposase, (comA and comB) and SAICAR synthetase (purC) genes, complete cds | 97 | 211 | 216 |

TABLE 1-continued

S. pneumoniae - Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 89 | 14 | 10062 | 10412 | emb\|Z83335\|SPZ8 | S. pneumoniae dexB, cap1[A,B,C,D,E,F,G,H,I,J,K] genes, dTDP-rhamnose biosynthesis genes and aliA gene | 97 | 335 | 351 |
| 93 | 10 | 5303 | 4941 | emb\|X63602\|SPBO | S. pneumoniae mmsA-Box | 89 | 237 | 363 |
| 97 | 4 | 1708 | 1520 | gb\|U41735\| | Streptococcus pneumoniae peptide methionine sulfoxide reductase (msrA) and homoserine kinase homolog (thrB) genes, complete cds | 91 | 140 | 189 |
| 99 | 1 | 89 | 700 | emb\|Z83335\|SPZ8 | S. pneumoniae dexB, cap1[A,B,C,D,E,F,G,H,I,J,K] genes, dTDP-rhamnose biosynthesis genes and aliA gene | 93 | 592 | 612 |
| 99 | 2 | 1773 | 775 | emb\|X17337\|SPAM | Streptococcus pneumoniae ami locus conferring aminopterin resistance | 99 | 998 | 999 |
| 99 | 3 | 2794 | 1712 | emb\|X17337\|SPAM | Streptococcus pneumoniae ami locus conferring aminopterin resistance | 99 | 1083 | 1083 |
| 99 | 4 | 3732 | 2788 | emb\|X17337\|SPAM | Streptococcus pneumoniae ami locus conferring aminopterin resistance | 100 | 945 | 945 |
| 99 | 5 | 5249 | 3714 | emb\|X17337\|SPAM | Streptococcus pneumoniae ami locus conferring aminopterin resistance | 100 | 1536 | 1536 |
| 99 | 6 | 7262 | 5277 | emb\|X17337\|SPAM | Streptococcus pneumoniae ami locus conferring aminopterin resistance | 99 | 1986 | 1986 |
| 101 | 1 | 216 | 1538 | emb\|X54225\|SPEN | S. pneumoniae epuA and endA genes for 7 kDa protein and membrane endonuclease | 99 | 146 | 1323 |
| 101 | 2 | 1492 | 1719 | emb\|X54225\|SPEN | S. pneumoniae epuA and endA genes for 7 kDa protein and membrane endonuclease | 99 | 228 | 228 |
| 101 | 3 | 1694 | 1855 | emb\|X54225\|SPEN | S. pneumoniae epuA and endA genes for 7 kDa protein and membrane endonuclease | 100 | 162 | 162 |
| 101 | 4 | 1701 | 2582 | emb\|X54225\|SPEN | S. pneumoniae epuA and endA genes for 7 kDa protein and membrane endonuclease | 100 | 882 | 882 |
| 103 | 7 | 5556 | 5041 | emb\|Z95914\|SPZ9 | Streptococcus pneumoniae sodA gene | 100 | 396 | 516 |
| 105 | 2 | 1347 | 1556 | emb\|Z77727\|SPIS | S. pneumoniae DNA for insertion sequence IS1318 (823 bp) | 83 | 206 | 210 |
| 105 | 5 | 5381 | 5028 | emb\|Z67739\|SPPA | S. pneumoniae parC, parE and transposase genes and unknown orf | 98 | 353 | 354 |
| 105 | 6 | 6089 | 5379 | emb\|Z67739\|SPPA | S. pneumoniae parC, parE and transposase genes and unknown orf | 98 | 84 | 711 |
| 107 | 4 | 2785 | 1880 | emb\|X16022\|SPPE | S. pneumoniae penA gene | 98 | 72 | 906 |
| 107 | 5 | 2913 | 4988 | emb\|X16022\|SPPE | S. pneumoniae penA gene | 99 | 1692 | 2076 |
| 107 | 6 | 4981 | 5595 | emb\|X13136\|SPPE | Streptococcus pneumoniae penA gene for penicillin binding protein 2B lacking N-term, (penicillin resistant strain) | 91 | 107 | 615 |
| 108 | 9 | 9068 | 8718 | emb\|Z67739\|SPPA | S. pneumoniae parC, parE and transposase genes and unknown orf | 95 | 342 | 351 |
| 108 | 12 | 11308 | 10922 | emb\|Z67739\|SPPA | S. pneumoniae parC, parE and transposase genes and unknown orf | 99 | 199 | 387 |
| 109 | 3 | 2768 | 2241 | emb\|Z77725\|SPIS | S. pneumoniae DNA for insertion sequence IS1381 (966 bp) | 96 | 61 | 528 |
| 109 | 4 | 2688 | 2855 | emb\|Z77726\|SPIS | S. pneumoniae DNA for insertion sequence IS3318 (1372 bp) | 96 | 148 | 168 |
| 109 | 5 | 2862 | 3269 | emb\|Z77727\|SPIS | S. pneumoniae DNA for insertion sequence IS1318 (823 bp) | 97 | 353 | 408 |
| 109 | 6 | 5320 | 3584 | gb\|M18729\| | S. pneumoniae DNA mismatch repair protein (hexA) gene, complete cds | 100 | 371 | 1737 |
| 113 | 1 | 431 | 3 | gb\|M36180\| | Streptococcus pneumoniae transposase, (comA and comB) and SAICAR synthetase (purC) genes, complete cds | 95 | 429 | 429 |
| 113 | 10 | 9788 | 8532 | emb\|X99400\|SPDA | S. pneumoniae dacA gene and ORF | 99 | 1257 | 1257 |
| 113 | 11 | 9870 | 10985 | emb\|X99400\|SPDA | S. pneumoniae dacA gene and ORF | 99 | 1116 | 1116 |
| 114 | 3 | 2530 | 2030 | gb\|M36180\| | Streptococcus pneumoniae transposase, (comA and comB) and SAICAR synthetase (purC) genes, complete cds | 95 | 481 | 501 |
| 115 | 11 | 11303 | 10932 | gb\|U04047\| | Streptococcus pneumoniae SSZ dextran glucosidase gene and insertion sequence IS1202 transposase gene, complete cds | 97 | 372 | 372 |
| 117 | 1 | 897 | 3302 | emb\|X72967\|SPNA | S. pneumoniae nanA gene | 99 | 2402 | 2408 |
| 117 | 2 | 3277 | 3831 | emb\|X72967\|SPNA | S. pneumoniae nanA gene | 99 | 237 | 555 |
| 117 | 3 | 4327 | 3899 | gb\|M36180\| | Streptococcus pneumoniae transposase, (comA and comB) and SAICAR synthetase (purC) genes, complete cds | 98 | 429 | 429 |
| 121 | 2 | 1369 | 1941 | gb\|U72720\| | Streptococcus pneumoniae heat shock protein 70 (dnaK) gene, complete cds | 99 | 202 | 573 |

TABLE 1-continued

S. pneumoniae - Coding regions containing known sequences

| Contig ID | ORF ID | Start (nt) | Stop (nt) | match accession | match gene name | percent ident | HSP nt length | ORF nt length |
|---|---|---|---|---|---|---|---|---|
| 121 | 3 | 2412 | 4253 | gb|U72720| | and DnaJ (dnaJ) gene, partial cds Streptococcus pneumoniae heat shock protein 70 (dnaK) gene, complete cds and DnaJ (dnaJ) gene, partial cds | 99 | 1842 | 1842 |
| 122 | 8 | 5066 | 5587 | gb|U04047| | Streptococcus pneumoniae SSZ dextran glucosidase gene and insertion sequence IS1202 transposase gene, complete cds | 64 | 451 | 522 |
| 125 | 1 | 1811 | 189 | gb|H36180| | Streptococcus pneumoniae transposase, (comA and comB) and SAICAR synthetase (purC) genes, complete cds | 92 | 99 | 1623 |
| 128 | 15 | 12496 | 11204 | emb|Z83335|SPZ8 | S. pneumoniae dexB, cap1[A,B,C,D,E,F,G,H,I,J,K] genes, dTDP-rhamnose biosynthesis genes and aliA gene | 91 | 705 | 1293 |
| 134 | 1 | 1 | 492 | emb|Y10818|SPY1 | S. pneumoniae spsA gene | 99 | 203 | 492 |
| 134 | 2 | 556 | 2652 | gb|AF019904| | Streptococcus pneumoniae choline binding protein A (cbpA) gene, partial cds | 86 | 685 | 2097 |
| 134 | 3 | 1160 | 837 | emb|Y10818|SPY1 | S. pneumoniae spsA gene | 86 | 324 | 324 |
| 134 | 4 | 3952 | 2882 | gb|AF019904| | Streptococcus pneumoniae choline binding protein A (cbpA) gene, partial cds | 98 | 215 | 1071 |
| 134 | 8 | 7992 | 9848 | gb|U12567| | Streptococcus pneumoniae P13 glycerol-3-phosphate dehydrogenase (glpD) gene, partial cds, and glycerol uptake facilitator (glpF) and ORF3 genes, complete cds | 99 | 285 | 1857 |
| 134 | 9 | 9846 | 10622 | gb|U12567| | Streptococcus pneumoniae P13 glycerol-3-phosphate dehydrogenase (glpD) gene, partial cds, and glycerol uptake facilitator (glpF) and ORF3 genes, complete cds | 99 | 570 | 777 |
| 134 | 10 | 10805 | 11122 | gb|U12567| | Streptococcus pneumoniae P13 glycerol-3-phosphate dehydrogenase (glpD) gene, partial cds, and glycerol uptake facilitator (glpF) and ORF3 genes, complete cds | 100 | 318 | 318 |
| 137 | 13 | 7970 | 8443 | gb|U09239| | Streptococcus pneumoniae type 19F capsular polysaccharide biosynthesis operon, (cps19 fABCDEFGHIJKLMNO) genes, complete cds, and aliA gene, partial cds | 90 | 420 | 474 |
| 137 | 14 | 8590 | 8775 | emb|Z83335|SPZ8 | S. pneumoniae dexB, cap1 [A,B,C,D,E,F,G,H,I,J,K] genes, dTDP-rhamnose biosynthesis genes and aliA gene | 94 | 174 | 186 |
| 137 | 15 | 8773 | 8967 | emb|Z83335|SPZ8 | S. pneumoniae dexB, cap1[A,B,C,D,E,F,G,H,I,J,K] genes, dTDP-rhamnose biosynthesis genes and aliA gene | 98 | 195 | 195 |
| 137 | 16 | 9223 | 9687 | emb|Z77726|SPIS | S. pneumoniae DNA for insertion sequence IS1318 (1372 bp) | 96 | 446 | 465 |
| 137 | 17 | 9641 | 10051 | emb|Z77727|SPIS | S. pneumoniae DNA for insertion sequence IS1318 (823 bp) | 96 | 293 | 411 |
| 139 | 10 | 12998 | 12702 | emb|X63602|SPBO | S. pneumoniae mmsA-Box | 90 | 234 | 297 |
| 141 | 8 | 7805 | 8938 | emb|Z49988|SPMM | Streptococcus pneumoniae mmsA gene | 99 | 338 | 1134 |
| 141 | 9 | 8936 | 10972 | emb|Z49988|SPMM | Streptococcus pneumoniae mmsA gene | 99 | 2037 | 2037 |
| 141 | 10 | 11472 | 12467 | emb|Z49988|SPMM | Streptococcus pneumoniae mmsA gene | 100 | 76 | 996 |
| 142 | 2 | 257 | 814 | gb|M80215| | Streptococcus pneumoniae uvs402 protein gene, complete cds | 98 | 174 | 558 |
| 142 | 3 | 787 | 957 | gb|M80215| | Streptococcus pneumoniae uvs402 protein gene, partial cds | 100 | 142 | 171 |
| 142 | 4 | 980 | 3022 | gb|M80215| | Streptococcus pneumoniae uvs402 protein gene, complete cds | 95 | 1997 | 2043 |
| 142 | 5 | 3020 | 3595 | gb|M80215| | Streptococcus pneumoniae uvs402 protein gene, complete cds | 100 | 153 | 576 |
| 145 | 1 | 1 | 219 | emb|Z35135|SPAL | S. pneumoniae aliA gene for amiA-like gene A | 97 | 185 | 219 |
| 145 | 2 | 171 | 1994 | gb|L20556| | Streptococcus pneumoniae plpA gene, partial cds | 99 | 1811 | 1824 |
| 145 | 3 | 2287 | 7599 | emb|Z47210|SPDE | S. pneumoniae dexB, cap2A, cap3B and cap3C genes and orfs | 99 | 1052 | 5313 |
| 145 | 4 | 9934 | 7766 | gb|M90527| | Streptococcus pneumoniae penicillin binding protein (ponA) gene, complete cds | 99 | 2169 | 2169 |
| 145 | 5 | 10488 | 9922 | gb|M90527| | Streptococcus pneumoniae penicillin binding protein (ponA) gene, complete cds | 99 | 512 | 567 |
| 146 | 1 | 159 | 4 | emb|Z82002|SPZ8 | S. pneumoniae pcpB and pcpC genes | 98 | 156 | 156 |

TABLE 1-continued

S. pneumoniae - Coding regions containing known sequences

| Contig ID | ORF ID | Start (nt) | Stop (nt) | match accession | match gene name | percent ident | HSP nt length | ORF nt length |
|---|---|---|---|---|---|---|---|---|
| 146 | 2 | 344 | 90 | emb\|Z82002\|SPZ8 | S. pneumoniae pcpB and pcpC genes | 98 | 255 | 255 |
| 146 | 16 | 11795 | 10794 | emb\|Z82002\|SPZ8 | S. pneumoniae pcpB and pcpC genes | 85 | 276 | 1002 |
| 147 | 11 | 10678 | 10202 | emb\|Z21702\|SPUN | S. pneumoniae ung gene and mutX genes encoding uracil-DNA glycosylase and 8-oxodGTP nucleoside triphosphatase | 98 | 477 | 477 |
| 147 | 12 | 11338 | 10676 | emb\|Z21702\|SPUN | S. pneumoniae ung gene and mutX genes encoding uracil-DNA glycosylase and 8-oxodGTP nucleoside triphosphatase | 99 | 663 | 663 |
| 148 | 12 | 9009 | 8815 | gb\|U41735\| | Streptococcus pneumoniae peptide methionine sulfoxide reductase (msrA) and homoserine kinase homolog (thrB) genes, complete cds | 90 | 180 | 195 |
| 156 | 4 | 1154 | 1402 | emb\|X63602\|SPBO | S. pneumoniae mmsA-Box | 94 | 185 | 249 |
| 159 | 13 | 9048 | 8521 | gb\|M36180\| | Streptococcus pneumoniae transposase, (comA and comB) and SAICAR synthetase (purC) genes, complete cds | 98 | 526 | 528 |
| 160 | 1 | 1 | 147 | emb\|Z26851\|SPAT | S. pneumoniae (R6) genes for ATPase a subunit, ATPase b subunit and ATPase c subunit | 100 | 142 | 147 |
| 160 | 2 | 179 | 898 | emb\|Z26851\|SPAT | S. pneumoniae (R6) genes for ATPase a subunit, ATPase b subunit and ATPase c subunit | 99 | 720 | 720 |
| 160 | 3 | 906 | 1406 | emb\|Z26850\|SPAT | S. pneumoniae (M22) genes for ATPase a subunit, ATPase b subunit and ATPase c subunit | 95 | 501 | 501 |
| 160 | 4 | 1373 | 1942 | emb\|Z26850\|SPAT | S. pneumoniae (M22) genes for ATPase a subunit, ATPase b subunit and ATPase c subunit | 87 | 306 | 570 |
| 161 | 1 | 1 | 984 | emb\|X77249\|SPR6 | S. pneumoniae (R6) ciaR/ciaH genes | 99 | 984 | 984 |
| 161 | 7 | 6910 | 7497 | emb\|X83917\|SPGY | S. pneumoniae orfgyrB and gyrB gene encoding DNA gyrase B subunit | 99 | 437 | 588 |
| 161 | 8 | 7443 | 9386 | emb\|X83917\|SPGY | S. pneumoniae orfgyrB and gyrB gene encoding DNA gyrase B subunit | 98 | 1912 | 1944 |
| 163 | 1 | 2 | 2155 | gb\|L20559\| | Streptococcus pneumoniae Exp5 gene, partial cds | 98 | 327 | 1809 |
| 165 | 1 | 32 | 1618 | gb\|J01796\| | S. pneumoniae malX and malM genes encoding membrane protein and amylomaltase, complete cds, and malP gene encoding phosphorylase | 99 | 1587 | 1587 |
| 165 | 2 | 1608 | 3902 | gb\|J01796\| | S. pneumoniae malX and malM genes encoding membrane protein and amylomaltase, complete cds, and malP gene encoding phosphorylase | 100 | 280 | 2295 |
| 166 | 1 | 378 | 4 | emb\|Y11463\|SPDN | Streptococcus pneumoniae dnaG, rpoD, cpoA genes and ORF3 and ORF5 | 100 | 375 | 375 |
| 166 | 2 | 1507 | 320 | emb\|Y11463\|SPDN | Streptocgcus pneumoniae dnaG, rpoD, cpoA genes and ORF3 and ORF5 | 99 | 1188 | 1188 |
| 166 | 3 | 3240 | 1432 | emb\|Y11463\|SPDN | Streptococcus pneumoniae dnaG, rpoD, cpoA genes and ORF3 and ORF5 | 99 | 563 | 1809 |
| 167 | 1 | 1077 | 328 | emb\|Z71552\|SPAD | Streptococcus pneumoniae adcCBA operon | 94 | 155 | 750 |
| 167 | 2 | 1844 | 999 | emb\|Z71552\|SPAD | Streptococcus pneumoniae adcCBA operon | 98 | 405 | 846 |
| 167 | 3 | 2714 | 1842 | emb\|Z71552\|SPAD | Streptococcus pneumoniae adcCBA operon | 97 | 604 | 873 |
| 167 | 4 | 3399 | 2641 | emb\|Z71552\|SPAD | Streptococcus pneumoniae adcCBA operon | 99 | 703 | 759 |
| 168 | 1 | 1 | 2259 | gb\|L20558\| | Streptococcus pneumoniae Exp4 gene, partial cds | 99 | 282 | 2259 |
| 170 | 10 | 7338 | 7685 | emb\|Z77726\|SPIS | S. pneumoniae DNA for insertion sequence IS1318 (1372 bp) | 95 | 315 | 348 |
| 172 | 6 | 2462 | 4981 | gb\|47625\| | Streptococcus pneumoniae formate acetyltransferase (exp72) gene, partial cds | 97 | 365 | 2520 |
| 175 | 1 | 373 | 20 | gb\|M36180\| | Streptococcus pneumoniae transposase (comA and comB) and SAICAR synthetase (purC) genes, complete cds | 89 | 353 | 354 |
| 175 | 4 | 1843 | 3621 | emb\|Z47210\|SPDE | S. pneumoniae dexB, cap3A, cap3B and cap3C genes and orfs | 95 | 89 | 1779 |
| 176 | 5 | 3984 | 2980 | emb\|Z67739\|SPPA | S. pneumoniae parC, parE and transposase genes and unknown orf | 100 | 573 | 1005 |
| 178 | 1 | 3 | 425 | emb\|Z67739\|SPPA | S. pneumoniae parC, parE and transposase genes and unknown orf | 95 | 423 | 423 |
| 179 | 1 | 426 | 70 | emb\|Z83335\|SPZ8 | S. pneumoniae dexB, cap1[A,B,C,D,E,F,G,H,I,J,K] genes, dTDP-rhamnose biosynthesis genes and aliA gene | 99 | 338 | 357 |
| 180 | 3 | 3084 | 1855 | emb\|X95718\|SPGY | S. pneumoniae gyrA gene | 99 | 381 | 1230 |
| 186 | 1 | 714 | 4 | emb\|Z79691\|SOOR | S. pneumoniae yorf[A,B,C,D,E], ftsL, pbpX and regR genes | 98 | 59 | 711 |

TABLE 1-continued

S. pneumoniae - Coding regions containing known sequences

| Contig ID | ORF ID | Start (nt) | Stop (nt) | match accession | match gene name | percent ident | HSP nt length | ORF nt length |
|---|---|---|---|---|---|---|---|---|
| 186 | 2 | 2254 | 608 | emb|Z79691|SOOR | S. pneumoniae yorf[A,B,C,D,E], ftsL, pbpX and regR genes | 98 | 315 | 1647 |
| 186 | 3 | 707 | 880 | emb|Z79691|SOOR | S. pneumoniae yorf[A,B,C,D,E], ftsL, pbpX and regR genes | 98 | 174 | 174 |
| 189 | 1 | 2 | 259 | gb|U72720| | Streptococcus pneumoniae heat shock protein 70 (dnaK) gene, complete cds and DnaJ (dnaJ) gene, partial cds | 99 | 258 | 258 |
| 189 | 2 | 600 | 385 | gb|U72720| | Streptococcus pneumoniae heat shock protein 70 (dnaK) gene, complete cds and DnaJ (dnaJ) gene, partial cds | 98 | 204 | 216 |
| 189 | 3 | 1018 | 851 | gb|U72720| | Streptococcus pneumoniae heat shock protein 70 (dnaK) gene, complete cds and DnaJ (dnaJ) gene, partial cds | 99 | 168 | 168 |
| 189 | 4 | 1012 | 2154 | gb|U72720| | Streptococcus pneumoniae heat shock protein 70 (dnaK) gene, complete cds and DnaJ (dnaJ) gene, partial cds | 99 | 1062 | 1143 |
| 191 | 9 | 7829 | 7524 | emb|X63602|SPBO | S. pneumoniae mmsA-Box | 95 | 234 | 306 |
| 194 | 1 | 1 | 729 | gb|M36180| | Streptococcus pneumoniae transposase, (comA and comB) and SAICAR synthetase (purC) genes, complete cds | 91 | 728 | 729 |
| 199 | 2 | 1117 | 881 | emb|Z83335|SPZ8 | S. pneumoniae dexB, cap1[A,B,C,D,E,F,G,H,I,J,K] genes, dTDP-rhamnose biosynthesis genes and aliA gene | 96 | 211 | 237 |
| 199 | 4 | 1499 | 1762 | emb|Z83335|SPZ8 | S. pneumoniae dexB, cap1[A,B,C,D,E,F,G,H,I,J,K] genes, dTDP-rhamnose biosynthesis genes and aliA gene | 89 | 248 | 264 |
| 199 | 5 | 1781 | 2284 | emb|Z83335|SPZ8 | S. pneumoniae dexB, cap1[A,B,C,D,E,F,G,H,I,J,K] genes, dTDP-rhamnose biosynthesis genes and aliA gene | 98 | 504 | 504 |
| 203 | 1 | 1977 | 337 | gb|L20563| | Streptococcus pneumoniae Exp9 gene, partial cds | 99 | 342 | 1641 |
| 204 | 1 | 1145 | 3 | gb|L36131| | Streptococcus pneumoniae exp10 gene, complete cds, recA gene, 5' end | 99 | 1143 | 1143 |
| 208 | 1 | 59 | 2296 | gb|U89711| | Streptococcus pneumoniae pneumococcal surface protien A PspA (pspA) gene, complete cds | 90 | 471 | 2238 |
| 213 | 3 | 2455 | 2123 | emb|Z83335|SPZ8 | S. pneumoniae dexB, cap1[A,B,C,D,E,F,G,H,I,J,K] genes, dTDP-rhamnose biosynthesis genes and aliA gene | 96 | 332 | 333 |
| 216 | 1 | 368 | 12 | emb|Z83335|SPZ8 | S. pneumoniae dexB, cap1[A,B,C,D,E,F,G,H,I,J,K] genes, dTDP-rhamnose biosynthesis genes and aliA gene | 99 | 338 | 357 |
| 216 | 3 | 2650 | 2327 | gb|M28678| | Streptococcus pneumoniae promoter sequence DNA | 98 | 86 | 324 |
| 222 | 1 | 417 | 4 | emb|Z83335|SPZ8 | S. pneumoniae dexB, cap1[A,B,C,D,E,F,G,H,I,J,K] genes, dTDP-rhamnose biosynthesis genes and aliA gene | 94 | 414 | 414 |
| 227 | 3 | 5266 | 4238 | emb|AJ000336|SP | Streptococcus pneumoniae 1dh gene | 99 | 1029 | 1029 |
| 239 | 1 | 1 | 804 | gb|M31296| | Streptococcus pneumoniae recP gene, complete cds | 95 | 484 | 804 |
| 247 | 3 | 1625 | 1807 | gb|M36180| | Streptococcus pneumoniae transposase, (comA and comB) and SAICAR synthetase (purC) genes, complete cds | 94 | 178 | 183 |
| 249 | 3 | 921 | 1364 | emb|Z83335|SPZ8 | S. pneumoniae dexB, cap1[A,B,C,D,E,F,G,H,I,J,K] genes, dTDP-rhamnose biosynthesis genes and aliA gene | 94 | 443 | 444 |
| 253 | 1 | 362 | 3 | gb|M36180| | Streptococcus pneumoniae transposase, (comA and comB) and SAICAR synthetase (purC) genes, complete cds | 99 | 360 | 360 |
| 253 | 5 | 1238 | 2050 | emb|Z83335|SPZ8 | S. pneumoniae dexB, cap1[A,B,C,D,E,F,G,H,I,J,K] genes, dTDP-rhamnose biosynthesis genes and aliA gene | 95 | 420 | 813 |
| 253 | 6 | 2069 | 2572 | emb|Z83335|SPZ8 | S. pneumoniae dexB, cap1[A,B,C,D,E,F,G,H,I,J,K] genes, dTDP-rhamnose biosynthesis genes and aliA gene | 97 | 504 | 504 |
| 254 | 1 | 3 | 800 | emb|Z82002|SPZ8 | S. pneumoniae pcpB and pcpC genes | 97 | 531 | 798 |
| 255 | 2 | 798 | 1841 | emb|Z82002|SPZ8 | S. pneumoniae pcpB and pcpC genes | 97 | 672 | 1044 |
| 255 | 1 | 2493 | 1969 | emb|Z67739|SPPA | S. pneumoniae parC, parE and transposase genes and unknown orf | 92 | 435 | 525 |
| 257 | 2 | 985 | 770 | emb|X17337|SPAM | Streptococcus pneumoniae ami locus conferring aminopterin resistance | 96 | 117 | 216 |
| 257 | 3 | 1245 | 907 | gb|M36180| | Streptococcus pneumoniae transposase, (comA and comB) and SAICAR synthetase | 97 | 339 | 339 |

TABLE 1-continued

S. pneumoniae - Coding regions containing known sequences

| Contig ID | ORF ID | Start (nt) | Stop (nt) | match accession | match gene name | percent ident | HSP nt length | ORF nt length |
|---|---|---|---|---|---|---|---|---|
| 267 | 2 | 495 | 1208 | gb|U16156| | (purC) genes, complete cds | 95 | 84 | 714 |
| 267 | 3 | 1291 | 2277 | gb|U16156| | Streptococcus pneumoniae dihydropteroate synthase (sulA), dihydrofolate synthetase (sulB), guanosine triphosphate cyclohydrolase (sulC), aldolase-pyrophosphokinase (sulD) genes, complete cds | 97 | 755 | 987 |
| 267 | 4 | 2261 | 3601 | gb|U16156| | Streptococcus pneumoniae dihydropteroate synthase (sulA), dihydrofolate synthetase (sulB), guanosine triphosphate cyclohydrolase (sulC), aldolase-pyrophosphokinase (sulD) genes, complete cds | 98 | 1341 | 1341 |
| 267 | 5 | 3561 | 4136 | gb|U16156| | Streptococcus pneumoniae dihydropteroate synthase (sulA), dihydrofolate synthetase (sulB), guanosine triphosphate cyclohydrolase (sulC), aldolase-pyrophosphokinase (sulD) genes, complete cds | 99 | 576 | 576 |
| 267 | 6 | 4164 | 4949 | gb|U16156| | Streptococcus pneumoniae dihydropteroate synthase (sulA), dihydrofolate synthetase (sulB), guanosine triphosphate cyclohydrolase (sulC), aldolase-pyrophosphokinase (sulD) genes, complete cds | 99 | 748 | 786 |
| 267 | 7 | 5544 | 5140 | gb|U16156| | Streptococcus pneumoniae dihydropteroate synthase (sulA), dihydrofolate synthetase (sulB), guanosine triphosphate cyclohydrolase (sulC), aldolase-pyrophosphokinase (sulD) genes, complete cds | 100 | 186 | 405 |
| 268 | 4 | 1793 | 1990 | emb|X63602|SPBO | S. pneumoniae mmsA-Box | 89 | 194 | 198 |
| 271 | 1 | 562 | 104 | gb|429686| | S. pneumoniae mismatch repair (hexB) gene, complete cds | 93 | 160 | 459 |
| 291 | 1 | 75 | 524 | gb|U04047| | Streptococcus pneumoniae SSZ dextran glucosidase gene and insertion sequence IS1202 transposase gene, complete cds | 96 | 450 | 450 |
| 291 | 2 | 1001 | 525 | emb|Z83335|SPZ8 | S. pneumoniae dexB, capI[A,B,C,D,E,F,G,H,I,J,K] genes, dTDP-rhamnose biosynthesis genes and aliA gene | 87 | 205 | 477 |
| 291 | 3 | 807 | 559 | emb|Z83335|SPZ8 | S. pneumoniae dexB, capI[A,B,C,D,E,F,G,H,I,J,K] genes, dTDP-rhamnose biosynthesis genes and aliA gene | 90 | 170 | 249 |
| 291 | 4 | 1374 | 1099 | gb|M36180| | Streptococcus pneumoniae transposase, (comA and comB) and SAICAR synthetase (purC) genes, complete cds | 85 | 264 | 276 |
| 293 | 1 | 3 | 1673 | emb|Z67740|SPGY | S. pneumoniae gyrB gene and unknown orf | 98 | 553 | 1671 |
| 296 | 1 | 1434 | 151 | emb|Z47210|SPDE | S. pneumoniae dexB, cap3A, cap3B and cap3C genes and orfs | 99 | 430 | 1284 |
| 317 | 1 | 157 | 510 | emb|Z67739|SPPA | S. pneumoniae dexB, parC, parE and transposase genes and unknown orf | 89 | 353 | 354 |
| 325 | 2 | 1237 | 485 | emb|Z83335|SPZ8 | S. pneumoniae dexB, capI[A,B,C,D,E,F,G,H,I,J,K] genes, dTDP-rhamnose biosynthesis genes and aliA gene | 91 | 299 | 753 |
| 326 | 1 | 1 | 462 | emb|Z82001|SPPA | S. pneumoniae pcpA gene and open reading frames | 100 | 233 | 462 |
| 327 | 1 | 603 | 64 | emb|Z83335|SPZ8 | S. pneumoniae dexB, capI[A,B,C,D,E,F,G,H,I,J,K] genes, dTDP-rhamnose biosynthesis genes and aliA gene | 94 | 89 | 540 |
| 334 | 1 | 153 | 545 | gb|U41735| | Streptococcus pneumoniae peptide methionine sulfoxide reductase (msrA) and homoserine kinase homolog (thrB) genes, complete cds | 87 | 91 | 393 |
| 336 | 1 | 308 | 93 | emb|Z26850|SPAT | S. pneumoniae (M222) genes for ATPase a subunit, ATPase b subunit and ATPase c subunit | 97 | 102 | 216 |
| 360 | 1 | 1 | 519 | emb|Z67739|SPPA | S. pneumoniae parC, parE and transposase genes and unknown orf | 95 | 435 | 519 |
| 360 | 4 | 1598 | 1960 | emb|Z83335|SPZ8 | S. pneumoniae dexB, capI[A,B,C,D,E,F,G,H,I,J,K] genes, dTDP-rhamnose biosynthesis genes and aliA gene | 94 | 353 | 363 |

TABLE 1-continued

S. pneumoniae - Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 362 | 1 | 673 | 2 | emb|Z83335|SPZ8 | S. pneumoniae dexB, cap1[A,B,C,D,E,F,G,H,I,J,K] genes, dTDP-rhamnose biosynthesis genes and aliA gene | 95 | 63 | 672 |
| 362 | 2 | 1168 | 728 | gb|U04047| | Streptococcus pneumoniae SSZ dextran glucosidase gene and insertion sequence IS1202 transposase gene, complete cds | 96 | 441 | 441 |
| 384 | 1 | 347 | 111 | emb|X85787|SPCP | S. pneumoniae dexB, cps14A, cps14B, cps14C, cpsl4D, cps14E, cps14F, cps14G, cps14H, cps14I, cps14J, cps14K, cps14L, tasA genes | 94 | 54 | 237 |

TABLE 2

*S. pneumoniae* - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 228 | 2 | 1760 | 1942 | pir\|F60663\|F606 | translation elongation factor Tu - *Streptococcus oralis* | 100 | 100 | 183 |
| 319 | 1 | 2 | 205 | gi\|984927 | neomycin phosphotransferase [Cloning vector pBSL99] | 100 | 100 | 204 |
| 260 | 1 | 2 | 1138 | pir\|F60663\|F606 | translation elongation factor Tu - *Streptococcus oralis* | 99 | 98 | 1137 |
| 25 | 2 | 486 | 1394 | gi\|1574495 | hypothetical [*Haemophilus influenzae*] | 98 | 96 | 909 |
| 94 | 2 | 685 | 1002 | gi\|310627 | phosphoenolpyruvate:sugar phosphotransferase system HPr [*Streptococcus mutans*] | 98 | 93 | 318 |
| 312 | 1 | 190 | 2 | gi\|347999 | ATP-dependent protease proteolytic subunit [*Streptococcus salivarius*] | 98 | 95 | 189 |
| 329 | 1 | 1 | 807 | gi\|924848 | inosine monophosphate dehydrogenase [*Streptococcus pyogenes*] | 98 | 94 | 807 |
| 336 | 2 | 290 | 589 | gi\|987050 | lacZ gene product [unidentified cloning vector] | 98 | 98 | 300 |
| 181 | 9 | 5948 | 7366 | gi\|153855 | phospho-beta-D-galactosidase (EC 3.2.1.85) [*Lactococcus lactis cremoris*] | 97 | 94 | 1419 |
| 312 | 2 | 1044 | 361 | gi\|347998 | uracil phosphoribosyltransferase [*Streptococcus salivarius*] | 97 | 88 | 684 |
| 32 | 8 | 6575 | 7486 | sp\|P37214\|ERA_S | GTP-BINDING PROTEIN ERA HOMOLOG. | 96 | 91 | 912 |
| 94 | 3 | 951 | 2741 | gi\|153615 | phosphoenolpyruvate:sugar phosphotransferase system enzyme I [*Streptococcus salivarius*] | 96 | 92 | 1791 |
| 127 | 1 | 1 | 168 | gi\|cremoris]581299 | initiation factor IF-1 [*Lactococcus lactis*] | 96 | 89 | 168 |
| 128 | 14 | 10438 | 11154 | gi\|cremoris]1276873 | DeoD [*Streptococcus thermophilus*] | 96 | 93 | 717 |
| 181 | 4 | 1362 | 1598 | gi\|46606 | lacD polypeptide (AA 1–326) [*Staphylococcus aureus*] | 96 | 80 | 237 |
| 218 | 1 | 1 | 834 | gi\|1743856 | intrageneric coaggregation-relevant adhesin [*Streptococcus gordonii*] | 96 | 93 | 834 |
| 319 | 2 | 115 | 441 | gi\|208225 | heat-shock protein 82/neomcyn phosphotransferase fusion protein (hsp82-neo) [unidentified cloning vector] | 96 | 96 | 327 |
| 54 | 12 | 8622 | 10967 | gnl\|PID\|d100972 | Pyruvate formate-lyase [*Streptococcus mutans*] | 95 | 89 | 2346 |
| 181 | 2 | 606 | 1289 | gi\|149396 | lacD [*Lactococcus lactis*] | 95 | 89 | 684 |
| 46 | 3 | 3410 | 3045 | gi\|1850606 | YlxM [*Streptococcus mutans*] | 94 | 86 | 366 |
| 89 | 10 | 7972 | 7337 | gi\|703442 | thymidine kinase [*Streptococcus gordonii*] | 94 | 86 | 636 |
| 148 | 9 | 6431 | 7354 | gi\|995767 | UDP-glucose pyrophosphorylase [*Streptococcus pyogenes*] | 94 | 85 | 924 |
| 160 | 7 | 4430 | 5848 | gi\|153573 | H+ ATPase [*Enterococcus faecalis*] | 94 | 87 | 1419 |
| 2 | 3 | 4598 | 3513 | gi\|153763 | plasmin receptor [*Streptococcus pyogenes*] | 93 | 86 | 1086 |
| 12 | 8 | 7877 | 6204 | gi\|1103865 | formyl-tetrahydrofolate synthetase [*Streptococcus mutans*] | 93 | 84 | 1674 |
| 65 | 11 | 4734 | 5120 | gi\|40150 | L14 protein (AA 1–122) [*Bacillus subtilis*] | 93 | 87 | 387 |
| 68 | 1 | 53 | 1297 | gi\|47341 | antitumor protein [*Streptococcus pyogenes*] | 93 | 87 | 1245 |
| 80 | 1 | 3 | 299 | gnl\|PID\|d101166 | ribosomal protein S7 [*Bacillus subtilis*] | 93 | 84 | 297 |
| 127 | 3 | 695 | 1093 | gi\|142462 | ribosomal protein S11 [*Bacillus subtilis*] | 93 | 86 | 399 |
| 160 | 5 | 1924 | 3462 | gi\|1773264 | ATPase, alpha subunit [*Streptococcus mutans*] | 93 | 85 | 1539 |
| 211 | 5 | 3757 | 3047 | gi\|535273 | aminopeptidase C [*Streptococcus thermophilus*] | 93 | 82 | 711 |
| 262 | 1 | 16 | 564 | gi\|149394 | lacB [*Lactococcus lactis*] | 93 | 90 | 549 |
| 366 | 1 | 197 | 3 | gi\|295259 | tryptophan synthase beta subunit [*Synechocystis sp.*] | 93 | 91 | 195 |
| 25 | 3 | 1392 | 1976 | gi\|1574496 | hypothetical [*Haemophilus influenzae*] | 92 | 80 | 585 |
| 36 | 21 | 20781 | 19927 | gi\|310632 | hydrophobic membrane protein [*Streptococcus gordonii*] | 92 | 86 | 855 |
| 181 | 3 | 1265 | 1534 | gi\|149396 | lacD [*Lactococcus lactis*] | 92 | 83 | 270 |
| 181 | 7 | 3662 | 4060 | gi\|149410 | enzyme III [*Lactococcus lactis*] | 92 | 83 | 399 |
| 32 | 4 | 5631 | 3937 | gnl\|PID\|e294090 | fibronectin-binding protein-like protein A [*Streptococcus gordonii*] | 91 | 85 | 1695 |
| 46 | 2 | 3054 | 1462 | gi\|1850607 | signal recognition particle Ffh [*Streptococcus mutans*] | 91 | 84 | 1593 |
| 65 | 10 | 4442 | 4726 | pir\|S17865\|S178 | ribosomal protein S17 - Bacillus stearothermophilus | 91 | 80 | 285 |
| 77 | 2 | 260 | 1900 | gi\|287871 | groEL gene product [*Lactococcus lactis*] | 91 | 82 | 1641 |
| 84 | 1 | 2 | 2056 | gi\|871784 | Clp-like ATP-dependent protease binding subunit [*Bos taurus*] | 91 | 79 | 2055 |
| 99 | 8 | 10750 | 9272 | gi\|153740 | sucrose phosphorylase [*Streptococcus mutans*] | 91 | 84 | 1479 |
| 99 | 9 | 11947 | 11072 | gi\|153739 | membrane protein [*Streptococcus mutans*] | 91 | 78 | 876 |
| 127 | 5 | 2065 | 2469 | pir\|SO7223\|R5BS | ribosomal protein L17 - Bacillus stearothermophilus | 91 | 78 | 405 |
| 132 | 6 | 9539 | 9390 | gi\|143065 | hubst [*Bacillus stearothermophilus*] | 91 | 89 | 150 |
| 137 | 8 | 4765 | 6153 | gnl\|PID\|d100347 | Na+ - ATPase beta subunit [*Enterococcus hirae*] | 91 | 79 | 1389 |
| 151 | 7 | 11119 | 9734 | gi\|1815634 | glutamine synthetase type 1 [*Streptococcus agalactiae*] | 91 | 82 | 1386 |
| 201 | 2 | 1798 | 278 | gi\|1108998 | dextran glucosidase DexS [*Streptococcus suis*] | 91 | 79 | 1521 |
| 222 | 2 | 673 | 1839 | gi\|153741 | ATP-binding protein [*Streptococcus mutans*] | 91 | 85 | 1167 |
| 293 | 5 | 4113 | 4400 | gi\|1196921 | unknown protein [Insertion sequence IS861] | 91 | 71 | 288 |
| 32 | 7 | 6166 | 6570 | pir\|A36933\|A369 | diacylglycerol kinase homolog - Streptococcus mutans | 90 | 77 | 405 |
| 33 | 2 | 841 | 527 | gi\|1196921 | unknown protein [Insertion sequence IS861] | 90 | 70 | 315 |
| 48 | 27 | 20908 | 19757 | gnl\|PID\|e274705 | lactate oxidase [*Streptococcus iniae*] | 90 | 80 | 1152 |
| 55 | 21 | 19777 | 18515 | gnl\|PID\|e221213 | ClpX protein [*Bacillus subtilis*] | 90 | 75 | 1263 |
| 56 | 2 | 717 | 977 | gi\|1710133 | flagellar filament cap [*Borrelia burgdorferi*] | 90 | 50 | 261 |
| 65 | 1 | 1 | 606 | gi\|1165303 | L3 [*Bacillus subtilis*] | 90 | 75 | 606 |
| 114 | 1 | 2 | 988 | gi\|153562 | aspartate beta-semialdehyde dehydrogenase (EC 1.2.1.11) [*Streptococcus mutans*] | 90 | 80 | 987 |
| 120 | 1 | 1345 | 827 | gi\|407880 | ORF1 [*Streptococcus equismilis*] | 90 | 75 | 519 |
| 159 | 12 | 7690 | 8298 | gi\|143012 | GMP synthetase [*Bacillus subtilis*] | 90 | 84 | 609 |
| 166 | 4 | 4076 | 3282 | gi\|1661179 | high affinity branched chain amino acid transport protein [*Streptococcus mutans*] | 90 | 78 | 795 |
| 183 | 1 | 28 | 1395 | gi\|308858 | ATP:pyruvate 2-O-phosphotransferase [*Lactococcus lactis*] | 90 | 76 | 1368 |
| 191 | 3 | 2891 | 1662 | gi\|149521 | tryptophan synthase beta subunit [*Lactococcus lactis*] | 90 | 78 | 1230 |
| 198 | 2 | 1551 | 436 | gi\|2323342 | (AF014460) CcpA [*Streptococcus mutans*] | 90 | 76 | 1116 |
| 305 | 1 | 37 | 783 | gi\|1573551 | asparagine synthethase A (asnA) [*Haemophilus influenzae*] | 90 | 80 | 747 |
| 8 | 3 | 2285 | 3343 | gi\|149434 | putative [*Lactococcus lactis*] | 89 | 78 | 1059 |
| 46 | 8 | 7577 | 7362 | pir\|A45434\|A454 | ribosomal protein L19 - Bacillus stearothermophilus | 89 | 76 | 216 |

TABLE 2-continued

*S. pneumoniae* - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 49 | 9 | 8363 | 10342 | gi\|153792 | recP peptide [*Streptococcus pneumoniae*] | 89 | 83 | 1980 |
| 51 | 14 | 18410 | 19447 | gi\|308857 | ATP:D-fructose 6-phosphate 1-phosphotransferase [*Lactococcus lactis*] | 89 | 81 | 1038 |
| 57 | 11 | 9686 | 10669 | gnl\|PID\|d100932 | H2O-forming NADH Oxidase [*Streptococcus mutans*] | 89 | 77 | 984 |
| 65 | 5 | 2418 | 2786 | gi\|1165307 | S19 [*Bacillus subtilis*] | 89 | 81 | 369 |
| 65 | 8 | 3806 | 4225 | sp\|P14577\|RL16_ | 50S RIBOSOMAL PROTEIN L16. | 89 | 82 | 420 |
| 65 | 18 | 8219 | 8719 | gi\|143417 | ribosomal protein S5 [*Bacillus stearothermophilus*] | 89 | 76 | 501 |
| 73 | 9 | 6337 | 5315 | gi\|532204 | prs [*Listeria monocytogens*] | 89 | 70 | 1023 |
| 76 | 3 | 3360 | 1465 | gnl\|PID\|e200671 | lepA gene product [*Bacillus subtilis*] | 89 | 76 | 1896 |
| 99 | 10 | 12818 | 11919 | gi\|153738 | membrane protein [*Streptococcus mutans*] | 89 | 73 | 900 |
| 120 | 2 | 3552 | 1300 | gi\|407881 | stringent response-like protein [*Streptococcus equisimilis*] | 89 | 79 | 2253 |
| 122 | 5 | 4512 | 2791 | gnl\|PID\|e280490 | unknown [*Streptococcus pneumoniae*] | 89 | 81 | 1722 |
| 176 | 1 | 669 | 4 | gi\|47394 | 5-oxoprolyl-peptidase [*Streptococcus pyogenes*] | 89 | 78 | 666 |
| 177 | 6 | 3050 | 3934 | gi\|912423 | putative [*Lactococcus lactis*] | 89 | 71 | 885 |
| 181 | 8 | 4033 | 5751 | gi\|149411 | enzyme III [*Lactococcus lactis*] | 89 | 80 | 1719 |
| 211 | 4 | 3149 | 2793 | gi\|535273 | aminopeptidase C [*Streptococcus thermophilus*] | 89 | 70 | 408 |
| 361 | 1 | 431 | 838 | gi\|1196922 | unknown protein [Insertion sequence IS861] | 89 | 70 | 408 |
| 34 | 17 | 11839 | 10535 | sp\|P30053[SYH_S | HISTIDYL-TRNA SYNTHETASE (EC 6.1.1.21) (HISTIDINE--TRNA LIGASE) (HISRS) | 88 | 78 | 1305 |
| 38 | 3 | 1646 | 2623 | gi\|2058544 | putative ABC transporter subunit ComYA [*Streptococcus gordonii*] | 88 | 78 | 978 |
| 54 | 1 | 3 | 227 | gnl\|PID\|d101320 | YggU [*Bacillus subtilis*] | 88 | 66 | 225 |
| 57 | 2 | 611 | 1468 | gnl\|PID\|e134943 | putative reductase 1 [*Saccharomyces cerevisiae*] | 88 | 75 | 858 |
| 65 | 13 | 5497 | 6069 | pir\|A29102\|R5BS | ribosomal protein L5 - Bacillus stearothermophilus | 88 | 75 | 573 |
| 65 | 20 | 9030 | 9500 | gi\|2078381 | ribosomal protein L15 [*Staphylococcus aureus*] | 88 | 83 | 471 |
| 78 | 3 | 3636 | 1108 | gnl\|PID\|d100781 | lysyl-aminopeptidase [*Lactococcus lactis*] | 88 | 80 | 2529 |
| 106 | 12 | 12965 | 12054 | gi\|2407215 | (AF017421) putative heat shock protein HtpX [*Streptococcus gordonii*] | 88 | 72 | 912 |
| 107 | 2 | 219 | 962 | gnl\|PID\|e339862 | putative acylneuraminate lyase [*Clostridium tertium*] | 88 | 75 | 744 |
| 111 | 8 | 14073 | 10420 | gi\|402363 | RNA polymerase beta-subunit [*Bacillus subtilis*] | 88 | 74 | 3654 |
| 126 | 9 | 13096 | 12062 | gnl\|PID\|e311468 | unknown [*Bacillus subtilis*] | 88 | 74 | 1035 |
| 140 | 17 | 19143 | 18874 | gi\|1573659 | H. influenzae predicted coding region HI0659 [*Haemophilus influenzae*] | 88 | 61 | 270 |
| 144 | 1 | 394 | 555 | gnl\|PID\|e274705 | lactate oxidase [*Streptococcus iniae*] | 88 | 75 | 162 |
| 148 | 4 | 2723 | 3493 | gi\|159672 | phosphate transport system ATP-binding protein [*Methanococcus jannaschii*] | 88 | 68 | 771 |
| 160 | 8 | 5853 | 6278 | gi\|1773267 | ATPase, epsilon subunit [*Streptococcus mutans*] | 88 | 65 | 426 |
| 177 | 4 | 1770 | 2885 | gi\|149426 | putative [*Lactococcus lactis*] | 88 | 72 | 1116 |
| 211 | 6 | 4149 | 3613 | gi\|535273 | aminopeptidase C [*Streptococcus thermophilus*] | 88 | 74 | 528 |
| 231 | 4 | 580 | 957 | gi\|40186 | homologous to E. coli ribosomal protein L27 [*Bacillus subtilis*] | 88 | 78 | 378 |
| 260 | 5 | 2387 | 2998 | gi\|1196922 | unknown protein [Insertion sequence IS861] | 88 | 69 | 612 |
| 291 | 6 | 2017 | 3375 | gnl\|PID\|d100571 | adenylosuccinate synthetase [*Bacillus subtilis*] | 88 | 75 | 1359 |
| 319 | 4 | 658 | 317 | gi\|603578 | serine/threonine kinase [*Phytophthora capsici*] | 88 | 88 | 342 |
| 40 | 5 | 4353 | 4514 | gi\|153672 | lactose repressor [*Streptococcus mutans*] | 87 | 56 | 162 |
| 49 | 10 | 10660 | 10929 | gi\|1196921 | unknown protein [Insertion sequence IS861] | 87 | 72 | 270 |
| 65 | 7 | 3140 | 3808 | gi\|1165309 | S3 [*Bacillus subtilis*] | 87 | 73 | 669 |
| 65 | 15 | 6623 | 7039 | gi\|1044978 | ribosomal protein S8 [*Bacillus subtilis*] | 87 | 73 | 417 |
| 75 | 8 | 5411 | 6625 | gi\|1877422 | galactokinase [*Streptococcus mutans*] | 87 | 78 | 1215 |
| 80 | 2 | 703 | 2805 | gnl\|PID\|d101166 | elongation factor G [*Bacillus subtilis*] | 87 | 76 | 2103 |
| 82 | 1 | 541 | 248 | gi\|1196921 | unknown protein [Insertion sequence IS861] | 87 | 69 | 294 |
| 140 | 23 | 25033 | 23897 | gnl\|PID\|e254999 | phenylalany-tRNA synthetase beta subunit [*Bacillus subtilis*] | 87 | 74 | 1137 |
| 214 | 14 | 10441 | 8516 | gi\|2281305 | glucose inhibited division protein homolog GidA [*Lactococcus lactis cremoris*] | 87 | 75 | 1926 |
| 220 | 2 | 2742 | 874 | gnl\|PID\|e324358 | product highly similar to elongation factor EF-G [*Bacillus subtilis*] | 87 | 73 | 1869 |
| 260 | 4 | 2096 | 2389 | gi\|1196921 | unknown protein [Insertion sequence IS861] | 87 | 72 | 294 |
| 323 | 1 | 27 | 650 | gi\|897795 | 30S ribosomal protein [*Pediococcus acidilactici*] | 87 | 73 | 624 |
| 357 | 1 | 154 | 570 | gi\|1044978 | ribosomal protein S8 [*Bacillus subtilis*] | 87 | 73 | 417 |
| 49 | 11 | 10927 | 11445 | gi\|1196922 | unknown protein [Insertion sequence IS861] | 86 | 63 | 519 |
| 59 | 12 | 7461 | 9224 | gi\|951051 | relaxase [*Streptococcus pneumoniae*] | 86 | 68 | 1764 |
| 65 | 4 | 1553 | 2401 | pir\|A02759\|R5BS | ribosomal protein L2 - Bacillus stearothermophilus | 86 | 77 | 849 |
| 65 | 23 | 10957 | 11610 | gi\|44074 | adenylate kinase [*Lactococcus lactis*] | 86 | 76 | 654 |
| 82 | 4 | 4374 | 4856 | gi\|153745 | mannitol-specific enzyme III [*Streptococcus mutans*] | 86 | 72 | 483 |
| 102 | 4 | 4270 | 4986 | gnl\|PID\|e264705 | OMP decarboxylase [*Lactococcus lactis*] | 86 | 76 | 717 |
| 106 | 6 | 7824 | 6880 | gnl\|PID\|e137598 | aspartate transcarbamylase [*Lactobacillus leichmannii*] | 86 | 68 | 945 |
| 107 | 1 | 1 | 273 | gnl\|PID\|e339862 | putative acylneuraminate lyase [*Clostridium tertium*] | 86 | 71 | 273 |
| 111 | 7 | 10432 | 6710 | gnl\|PID\|e228283 | DNA-dependent RNA polymerase [*Streptococcus pyogenes*] | 86 | 80 | 3723 |
| 131 | 9 | 5704 | 4892 | gi\|1661193 | polipoprotein diacylglycerol transferase [*Streptococcus mutans*] | 86 | 71 | 813 |
| 134 | 7 | 6430 | 7980 | gi\|2388637 | glycerol kinase [*Enterococcus faecalis*] | 86 | 73 | 1551 |
| 146 | 11 | 7473 | 6583 | gi\|1591731 | melvalonate kinase [*Methanococcus jannaschii*] | 86 | 72 | 891 |
| 153 | 2 | 595 | 2010 | gi\|2160707 | dipeptidase [*Lactococcus lactis*] | 86 | 78 | 1416 |
| 154 | 1 | 2 | 1435 | gi\|1857246 | 6-phosphogluconate dehydrogenase [*Lactococcus lactis*] | 86 | 74 | 1434 |
| 161 | 5 | 5025 | 6284 | gi\|47529 | Unknown [*Streptococcus salivarius*] | 86 | 66 | 1260 |
| 184 | 1 | 2 | 1483 | gi\|642667 | NADP-dependent glyceraldehyde-3-phosphate dehydrogenase [*Streptococcus mutans*] | 86 | 73 | 1482 |
| 210 | 8 | 3659 | 6571 | gi\|153661 | translational initiation factor IF2 [*Enterococcus faecium*] | 86 | 76 | 2913 |

TABLE 2-continued

_S. pneumoniae_ - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 250 | 1 | 2 | 187 | gi\|1573551 | asparagine synthetase A (asnA) [_Haemophilus influenzae_] | 86 | 68 | 186 |
| 36 | 4 | 2644 | 3909 | gi\|2149909 | cell division protein [_Enterococcus faecalis_] | 85 | 73 | 1266 |
| 38 | 4 | 2475 | 3587 | gi\|2058545 | putative ABC transporter subunit ComYB [_Streptococcus gordonii_] | 85 | 72 | 1113 |
| 38 | 5 | 3577 | 3915 | gi\|2058546 | ComYC [_Streptococcus gordonii_] | 85 | 80 | 339 |
| 57 | 5 | 2797 | 3789 | gnl\|PID\|d101316 | YqfJ [_Bacillus subtilis_] | 85 | 72 | 993 |
| 82 | 5 | 4915 | 6054 | gi\|153746 | mannitol-phosphate dehydrogenase [_Streptococcus mutans_] | 85 | 68 | 1140 |
| 83 | 15 | 14690 | 15793 | gi\|143371 | phosphoribosyl aminoimidazole synthetase (PUR-M) [_Bacillus subtilis_] | 85 | 69 | 1104 |
| 87 | 2 | 1417 | 2388 | gi\|1184967 | ScrR [_Streptococcus mutans_] | 85 | 69 | 972 |
| 108 | 3 | 2666 | 3154 | gi\|153566 | ORF (19K protein) [_Enterococcus faecalis_] | 85 | 67 | 489 |
| 127 | 2 | 312 | 692 | gi\|1044989 | ribosomal protein S13 [_Bacillus subtilis_] | 85 | 72 | 381 |
| 128 | 3 | 1534 | 2409 | gi\|1685110 | tetrahydrofolate dehydrogenase/cyclohydrolase [_Streptococcus thermophilus_] | 85 | 71 | 876 |
| 137 | 7 | 2962 | 4767 | gnl\|PID\|d100347 | Na+ -ATPase alpha subunit [_Enterococcus hirae_] | 85 | 74 | 1806 |
| 170 | 2 | 2622 | 709 | gnl\|PID\|d102006 | (AB001488) FUNCTION UNKNOWN, SIMILAR PRODUCT IN E. COLI, H. INFLUENZAE AND NEISSERIA MENINGITIDIS. [_Bacillus subtilis_] | 85 | 70 | 1914 |
| 187 | 5 | 3760 | 4386 | gi\|727436 | putative 20-kDa protein [_Lactococcus lactis_] | 85 | 65 | 627 |
| 233 | 2 | 728 | 1873 | gi\|1163116 | ORF-5 [_Streptococcus pneumoniae_] | 85 | 67 | 1146 |
| 234 | 3 | 962 | 1255 | gi\|2293155 | (AF008220) YtiA [_Bacillus subtilis_] | 85 | 61 | 294 |
| 240 | 1 | 309 | 1931 | gi\|143597 | CTP synthetase [_Bacillus subtilis_] | 85 | 70 | 1623 |
| 6 | 1 | 199 | 1521 | gi\|508979 | GTP-binding protein [_Bacillus subtilis_] | 84 | 72 | 1323 |
| 10 | 4 | 4375 | 3443 | gnl\|PID\|e339862 | putative acylneuraminate lyase [_Clostridium tertium_] | 84 | 70 | 933 |
| 14 | 1 | 63 | 2093 | gi\|520753 | DNA topoisomerase I [_Bacillus subtilis_] | 84 | 69 | 2031 |
| 19 | 4 | 1793 | 2593 | gi\|2352484 | (AF005098) RNAseH II (_Lactococcus lactis_) | 84 | 68 | 801 |
| 20 | 17 | 17720 | 19687 | gnl\|PID\|d100584 | cell division protein [_Bacillus subtilis_] | 84 | 71 | 1968 |
| 22 | 28 | 21723 | 20884 | gi\|299163 | alanine dehydrogenase [_Bacillus subtilis_] | 84 | 68 | 840 |
| 30 | 10 | 7730 | 6792 | gnl\|PID\|d100296 | fructokinase [_Streptococcus mutans_] | 84 | 75 | 939 |
| 33 | 9 | 5650 | 5300 | gi\|147194 | phnA protein [_Escherichia coli_] | 84 | 71 | 351 |
| 36 | 22 | 21551 | 20772 | gi\|310631 | ATP binding protein [_Streptococcus gordonii_] | 84 | 72 | 780 |
| 48 | 4 | 2837 | 2505 | gi\|882609 | 6-phospho-beta-glucosidase [_Escherichia coli_] | 84 | 69 | 333 |
| 58 | 1 | 41 | 1516 | gi\|450849 | amylase [_Streptococcus bovis_] | 84 | 73 | 1476 |
| 59 | 10 | 6715 | 7116 | gi\|951053 | ORF10, putative [_Streptococcus pneumoniae_] | 84 | 74 | 402 |
| 62 | 1 | 21 | 644 | gi\|806487 | ORF211, putative [_Lactococcus lactis_] | 84 | 66 | 624 |
| 65 | 17 | 7779 | 8207 | gi\|1044980 | ribosomal protein L18 [_Bacillus subtilis_] | 84 | 73 | 429 |
| 65 | 21 | 9507 | 10397 | gi\|44073 | SecY protein [_Lactococcus lactis_] | 84 | 68 | 891 |
| 106 | 4 | 5474 | 2262 | gnl\|PID\|e199387 | carbamoyl-phosphate synthase [_Lactobacillus plantarium_] | 84 | 73 | 3213 |
| 159 | 1 | 47 | 4 | gi\|806487 | ORF211; putative [_Lactococcus lactis_] | 84 | 63 | 144 |
| 163 | 4 | 4690 | 5910 | gi\|2293164 | (AF008220) SAM synthase [_Bacillus subtilis_] | 84 | 69 | 1221 |
| 192 | 1 | 46 | 1308 | gi\|495046 | tripeptidase [_Lactococcus lactis_] | 84 | 73 | 1263 |
| 348 | 1 | 671 | 6 | gi\|1787753 | (AE000245) f346; 70 pct identical to 336 amino acids of ADH1_ZYMMO SW; F20368 but has 10 additional N-ter residues [_Escherichia coli_] | 84 | 71 | 666 |
| 3 | 4 | 1572 | 1375 | gi\|143766 | (thrSv) (EC 6.1.1.3) [_Bacillus subtilis_] | 83 | 65 | 2004 |
| 9 | 6 | 3893 | 3417 | gnl\|PID\|d100576 | single strand DNA binding protein [_Bacillus subtilis_] | 83 | 68 | 477 |
| 17 | 15 | 7426 | 8457 | gi\|520738 | comA protein [_Streptococcus pneumoniae_] | 83 | 66 | 1032 |
| 20 | 12 | 13860 | 14144 | gnl\|PID\|d100583 | unknown [_Bacillus subtilis_] | 83 | 61 | 285 |
| 23 | 4 | 3358 | 2606 | gi\|1788294 | (AE000290) o238; This 238 aa orf is 40 pct identical (5 gaps) to 231 residues of an approx. 248 as protein YEBC_ECOLI SW; P24237 [_Escherichia coli_] | 83 | 74 | 753 |
| 28 | 6 | 3304 | 3005 | gi\|1573659 | H. influenzae predicted coding region HI0659 [_Haemophilus influenzae_] | 83 | 57 | 300 |
| 35 | 7 | 5108 | 3867 | gi\|311707 | hypothetical nucleotide binding protein [_Acholeplasma laidlawii_] | 83 | 63 | 1242 |
| 55 | 19 | 17932 | 17528 | gi\|537085 | ORF_f141 [_Escherichia coli_] | 83 | 59 | 405 |
| 55 | 20 | 18539 | 17919 | gi\|496558 | orfx [_Bacillus subtilis_] | 83 | 69 | 621 |
| 65 | 6 | 2795 | 3142 | gi\|1165308 | L22 [_Bacillus subtilis_] | 83 | 64 | 348 |
| 68 | 6 | 6877 | 6683 | gi\|1213494 | immunoglobulin A1 protease [_Streptococcus pneumoniae_] | 83 | 54 | 195 |
| 87 | 15 | 15112 | 14771 | gnl\|PID\|e323522 | putative rpoZ protein [_Bacillus subtilis_] | 83 | 54 | 342 |
| 96 | 12 | 8963 | 9631 | gi\|47394 | 5-oxoprolyl-peptidase [_Streptococcus pyogenes_] | 83 | 73 | 669 |
| 98 | 1 | 3 | 263 | go\|1183885 | glutamine-binding subunit [_Bacillus subtilis_] | 83 | 55 | 261 |
| 120 | 4 | 7170 | 5233 | gi\|310630 | zinc metalloprotease [_Streptococcus gordonii_] | 83 | 72 | 1938 |
| 127 | 7 | 2998 | 4347 | gi\|1500567 | M. jannaschii predicted coding region MJ1665 [_Methanococcus jannaschii_] | 83 | 72 | 1350 |
| 137 | 1 | 3 | 440 | gi\|472918 | v-type Na-ATPase [_Enterococcus hirae_] | 83 | 60 | 438 |
| 160 | 6 | 3466 | 4356 | gi\|1773265 | ATPase, gamma subunit [_Streptococcus mutans_] | 83 | 67 | 891 |
| 214 | 4 | 2278 | 2964 | gi\|663279 | transposase [_Streptococcus pneumoniae_] | 83 | 72 | 687 |
| 226 | 3 | 2367 | 2020 | gi\|142154 | thioredoxin [_Synechococcus PCC6301_] | 83 | 58 | 348 |
| 303 | 1 | 3 | 1049 | gi\|40046 | phosphoglucose isomerase A (AA 1–449) [_Bacillus stearothermophilus_] | 83 | 67 | 1047 |
| 303 | 2 | 1155 | 1931 | gi\|289282 | glutamyl-tRNA synthetase [_Bacillus subtilis_] | 83 | 67 | 777 |
| 6 | 17 | 15370 | 14318 | gi\|633147 | ribose-phosphate pyrophosphokinase [_Bacillus caldolyticus_] | 82 | 64 | 1053 |
| 7 | 1 | 299 | 96 | gi\|143648 | ribosomal protein L28 [_Bacillus subtilis_] | 82 | 69 | 204 |
| 9 | 3 | 1479 | 1090 | gi\|385178 | unknown [_Bacillus subtilis_] | 82 | 46 | 390 |
| 9 | 7 | 4213 | 3899 | gnl\|PID\|d100576 | ribosomal protein S6 [_Bacillus subtilis_] | 82 | 60 | 315 |

TABLE 2-continued

_S. pneumoniae_ - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 12 | 6 | 4688 | 3942 | gnl\|PID\|d100571 | unknown [_Bacillus subtilis_] | 82 | 68 | 747 |
| 22 | 17 | 13422 | 14837 | gi\|520754 | putative [_Bacillus subtilis_] | 82 | 69 | 1416 |
| 22 | 18 | 14897 | 15658 | gnl\|PID\|d101929 | uridine monophosphate kinase [Synechocystis sp.] | 82 | 62 | 762 |
| 33 | 16 | 11471 | 10641 | gnl\|PID\|d101190 | ORF4 [_Streptococcus mutans_] | 82 | 68 | 831 |
| 35 | 9 | 7400 | 6255 | gi\|1881543 | UDP-N-acetylglucosamine-2-epimerase [_Streptococcus pneumoniae_] | 82 | 68 | 1146 |
| 40 | 10 | 8003 | 7533 | gi\|1173519 | riboflavin synthase beta subunit [_Actinobacillus pleuropneumoniae_] | 82 | 68 | 471 |
| 48 | 32 | 23159 | 23437 | gi\|1930092 | outer membrane protein [_Campylobacter jejuni_] | 82 | 61 | 279 |
| 52 | 14 | 13833 | 14765 | gi\|142521 | deoxyribodipyrimidine photolyase [_Bacillus subtilis_] | 82 | 61 | 933 |
| 60 | 4 | 4737 | 1849 | gnl\|PID\|d102221 | (AB001610) urvA [_Deinococcus radiodurans_] | 82 | 66 | 2889 |
| 62 | 4 | 2131 | 1457 | gi\|2246749 | (AF009622) thioredoxin reductase [_Listeria monocytogenes_] | 82 | 63 | 675 |
| 71 | 11 | 16586 | 17518 | gnl\|PID\|e322063 | ss-1,4-galactosyltransferase [_Streptococcus pneumoniae_] | 82 | 60 | 933 |
| 73 | 13 | 9222 | 7837 | gnl\|PID\|d100586 | unknown [_Bacillus subtilis_] | 82 | 65 | 1386 |
| 74 | 1 | 1 | 3771 | gnl\|PID\|d101199 | alkaline amylopullulanase [Bacillus sp.] | 82 | 68 | 3771 |
| 83 | 9 | 3696 | 3983 | gnl\|PID\|e305362 | unnamed protein product [_Streptococcus thermophilus_] | 82 | 52 | 288 |
| 86 | 13 | 10776 | 9394 | gi\|683583 | 5-enolpyruvylshikimate-3-phosphate synthase [_Lactococcus lactis_] | 82 | 67 | 1383 |
| 89 | 12 | 8295 | 9752 | gi\|40025 | homologous to E. coli 50K [_Bacillus subtilis_] | 82 | 66 | 1458 |
| 115 | 9 | 10347 | 8812 | gnl\|PID\|d102090 | (AV003927) phospho-beta-galactosidase [_Lactobacillus gasseri_] | 82 | 74 | 1536 |
| 118 | 1 | 1 | 1332 | gnl\|PID\|d100579 | seryl-tRNA synthetase [_Bacillus subtilis_] | 82 | 71 | 1332 |
| 151 | 1 | 4657 | 6246 | pir\|S06097\|S060 | type I site-specific deoxyribonuclease (EC 3.1.21.3) CfrA chain S - _Citrobacter freundii_ | 82 | 66 | 1590 |
| 173 | 6 | 4183 | 3503 | gi\|2313836 | (AE000584) conserved hypothetical protein [_Helicobacter pylori_] | 82 | 68 | 681 |
| 177 | 12 | 5481 | 7442 | gnl\|PID\|d101999 | (AV001341) NcrB [_Escherichia coli_] | 82 | 58 | 1962 |
| 193 | 2 | 178 | 576 | pir\|S08564\|R3BS | ribosomal protein S9 - Bacillus stearothermophilus | 82 | 70 | 399 |
| 245 | 2 | 258 | 845 | gi\|146402 | EcoA type I restriction-modification enzyme S subunit [_Escherichia coli_] | 82 | 68 | 588 |
| 9 | 5 | 3400 | 3146 | gnl\|PID\|d100576 | ribosomal protein S18 [_Bacillus subtilis_] | 81 | 66 | 255 |
| 16 | 7 | 7484 | 8413 | gi\|1100074 | tryptophanyl-tRNA synthetase [_Clostridium longisporum_] | 81 | 70 | 930 |
| 20 | 11 | 10308 | 13820 | gnl\|PID\|d100583 | transcription-repair coupling factor [_Bacillus subtilis_] | 81 | 63 | 3513 |
| 38 | 2 | 1232 | 1606 | gi\|2058543 | putative DNA binding protein [_Streptococcus gordonii_] | 81 | 63 | 375 |
| 45 | 2 | 3061 | 1751 | gi\|460259 | enolase [_Bacillus subtilis_] | 81 | 67 | 1311 |
| 46 | 1 | 2 | 1267 | gi\|431231 | uracil permease [_Bacillus caldolyticus_] | 81 | 61 | 1266 |
| 48 | 3 | 2453 | 1440 | gnl\|PID\|d100453 | Mannosephosphate Isomerase [_Streptococcus mutans_] | 81 | 70 | 1014 |
| 54 | 2 | 1106 | 336 | gi\|154752 | transport protein [_Agrobacterium tumefaciens_] | 81 | 64 | 771 |
| 65 | 22 | 10306 | 10821 | gi\|44073 | SecY protein [_Lactococcus lactis_] | 81 | 66 | 516 |
| 89 | 4 | 3874 | 2603 | gi\|556886 | Sering hydroxymethyltransferase [_Bacillus subtilis_] | 81 | 69 | 1272 |
| 99 | 16 | 19126 | 18929 | gi\|2313526 | (AE000557) H. pylori predicted coding region HP0411 [_Helicobacter pylori_] | 81 | 75 | 198 |
| 106 | 7 | 8373 | 7822 | gnl\|PID\|e199384 | pyrR [_Lactobacillus plantarum_] | 81 | 61 | 552 |
| 108 | 6 | 5054 | 6877 | gi\|1469939 | group B oligopeptidase PepB [_Streptococcus agalactiae_] | 81 | 66 | 1824 |
| 113 | 15 | 15899 | 18283 | pir\|S09411\|S094 | spoIIIE protein - Bacillus subtilis | 81 | 65 | 2385 |
| 128 | 5 | 3359 | 3634 | gi\|1685111 | orf1091 [_Streptococcus thermophilus_] | 81 | 69 | 276 |
| 151 | 1 | 830 | 3211 | gi\|304896 | EcoE type I restriction-modification enzyme R subunit [_Escherichia coli_] | 81 | 59 | 2382 |
| 159 | 11 | 6722 | 7837 | gi\|2239288 | GMP synthetase [_Bacillus subtilis_] | 81 | 69 | 1116 |
| 170 | 1 | 739 | 458 | gnl\|PID\|d102006 | (AB001488) FUNCTION UNKNOWN [_Bacillus subtilis_] | 81 | 55 | 282 |
| 191 | 2 | 1759 | 893 | gi\|149522 | tryptophan synthase alpha subunit [_Lactococcus lactis_] | 81 | 65 | 867 |
| 214 | 3 | 2290 | 1994 | gi\|157587 | reverse transcriptase endonuclease [_Drosophila virilis_] | 81 | 43 | 297 |
| 217 | 4 | 4415 | 4008 | gi\|466473 | cellobiose phosphotransferase enzyme II' [_Bacillus stearothermophilus_] | 81 | 59 | 408 |
| 262 | 2 | 569 | 868 | gi\|153675 | tagatose 6-P kinase [_Streptococcus mutans_] | 81 | 68 | 300 |
| 299 | 1 | 663 | 4 | gnl\|PIDp51 e301154 | StySKI methylase [_Salmonella enterica_] | 81 | 60 | 660 |
| 366 | 2 | 376 | 83 | gi\|149521 | tryptophan synthase beta subunit [_Lactococcus lactis_] | 81 | 65 | 294 |
| 12 | 10 | 8766 | 9242 | gi\|1216490 | DNA/pantothenate metabolism flavoprotein [_Streptococcus mutans_] | 80 | 64 | 477 |
| 17 | 11 | 6050 | 5748 | gnl\|PID\|e305362 | unnamed protein product [_Streptococcus thermophilus_] | 80 | 67 | 303 |
| 17 | 16 | 8455 | 9066 | gi\|703126 | leucocin A translocator [_Leuconostoc gelidum_] | 80 | 59 | 612 |
| 18 | 3 | 2440 | 1613 | gi\|1591672 | phosphate transport system ATP-binding protein [_Methanococcus jannaschii_] | 80 | 58 | 828 |
| 27 | 3 | 4248 | 1579 | gi\|452309 | valyl-tRNA synthetase [_Bacillus subtilis_] | 80 | 69 | 2670 |
| 28 | 7 | 3671 | 3288 | gi\|1573660 | H. influenzae predicted coding region HI0660 [_Haemophilus influenzae_] | 80 | 63 | 384 |
| 32 | 2 | 902 | 1933 | gnl\|PID\|e264499 | dihydroorotate dehydrogenase B [_Lactococcus lactis_] | 80 | 66 | 1032 |
| 39 | 1 |  | 1266 | gnl\|PID\|e2340478 | hom [_Lactococcus lactis_] | 80 | 63 | 1266 |
| 52 | 5 | 4363 | 3593 | gi\|1183884 | ATP-binding subunit [_Bacillus subtilis_] | 80 | 57 | 771 |
| 54 | 5 | 4550 | 4744 | gi\|2198820 | (AF004225) Cux/CDP(1B1); Cus/CDP homeoprotein [_Mus musculus_] | 80 | 60 | 195 |
| 59 | 11 | 7109 | 7486 | gi\|951052 | ORF9, putative [_Streptococcus pneumoniae_] | 80 | 68 | 378 |
| 65 | 3 | 1230 | 1550 | pir\|A02815\|R5BS | ribosomal protein L23 - Bacillus stearothermophilus | 80 | 69 | 321 |
| 65 | 12 | 5174 | 5503 | pir\|A02819\|R5BS | ribosomal protein L24 - Bacillus stearothermophilus | 80 | 70 | 330 |
| 66 | 9 | 9884 | 10687 | gi\|2313836 | (AE000584) conserved hypothetical protein [_Helicobacter pylori_] | 80 | 66 | 804 |
| 82 | 2 | 648 | 2438 | gi\|622991 | mannitol transport protein [_Bacillus stearothermophilus_] | 80 | 65 | 1791 |
| 85 | 1 | 950 | 630 | gi\|528995 | polyketide synthase [_Bacillus subtilis_] | 80 | 46 | 321 |
| 89 | 8 | 6870 | 5779 | gi\|853776 | peptide chain release factor 1 [_Bacillus subtilis_] | 80 | 63 | 1092 |
| 93 | 12 | 8718 | 7438 | gnl\|PID\|d101959 | hypothetical protein [Synechocystis sp.] | 80 | 60 | 1281 |
| 106 | 5 | 6854 | 5751 | gnl\|PID\|e199386 | glutaminase of carbomoyl-phosphate synthase [_Lactobacillus plantarum_] | 80 | 65 | 1104 |

TABLE 2-continued

*S. pneumoniae* - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 109 | 2 | 2160 | 1450 | gi\|40056 | phoP gene product [*Bacillus subtilis*] | 80 | 59 | 711 |
| 124 | 9 | 4246 | 3953 | gnl\|PID\|d102254 | 30S ribosomal protein S16 [*Bacillus subtilis*] | 80 | 65 | 294 |
| 128 | 8 | 5148 | 6428 | gi\|2281308 | phosphopentomutase [*Lactococcus lactis cremoris*] | 80 | 66 | 1281 |
| 337 | 19 | 12665 | 11376 | gi\|159109 | NADP-dependent glutamate dehydrogenase [*Glardia intestinalis*] | 80 | 68 | 1290 |
| 140 | 19 | 19699 | 19457 | gi\|517210 | putative transposase [*Streptococcus pyogenes*] | 80 | 70 | 243 |
| 158 | 2 | 2474 | 984 | gi\|1877423 | galactose-1-P-uridyl transferase [*Streptococcus mutans*] | 80 | 65 | 1491 |
| 171 | 10 | 7474 | 7728 | gi\|397800 | cyclophilin C-associated protein [*Mus musculus*] | 80 | 60 | 255 |
| 181 | 1 | 2 | 619 | gi\|149395 | lacC [*Lactococcus lactis*] | 80 | 66 | 618 |
| 313 | 1 | 27 | 539 | gi\|143467 | ribosomal protein S4 [*Bacillus subtilis*] | 80 | 80 | 513 |
| 329 | 2 | 1652 | 858 | gi\|533080 | RecF protein [*Streptococcus pyogenes*] | 80 | 63 | 795 |
| 371 | 1 | 2 | 958 | gi\|442360 | ClpC adenosine triphosphates [*Bacillus subtilis*] | 80 | 58 | 957 |
| 8 | 7 | 4312 | 5580 | gi\|149435 | putative [*Lactococcus lactis*] | 79 | 64 | 1269 |
| 23 | 1 | 1175 | 135 | gi\|1542975 | AbcB [*Thermoanaerobacterium thermosulfurigenes*] | 79 | 61 | 1041 |
| 33 | 14 | 9244 | 8201 | gnl\|PID\|e253891 | UDP-glucse 4-epimerase [*Bacillus subtilis*] | 79 | 62 | 1044 |
| 36 | 3 | 1242 | 2633 | gnl\|PID\|e324218 | ftsA [*Enterococcus hirae*] | 79 | 58 | 1392 |
| 38 | 13 | 7155 | 8378 | gi\|405134 | acetate kinase [*Bacillus subtilis*] | 79 | 58 | 1224 |
| 55 | 7 | 9011 | 8229 | gi\|1146234 | dihydroipicolinate reductase [*Bacillus subtilis*] | 79 | 56 | 783 |
| 65 | 19 | 8661 | 8915 | gi\|2078380 | ribosomal protein L30 [*Staphylococcus aureus*] | 79 | 68 | 255 |
| 69 | 4 | 3678 | 2128 | gnl\|PID\|e311452 | unknown [*Bacillus subtilis*] | 79 | 64 | 1551 |
| 69 | 9 | 7881 | 7279 | gi\|677850 | hypothetical protein [*Staphylococcus aureus*] | 79 | 59 | 603 |
| 72 | 10 | 8491 | 9783 | gnl\|PID\|d101091 | hypothetical protein [*Synechocystis sp.*] | 79 | 62 | 1293 |
| 80 | 3 | 2906 | 7300 | gi\|143342 | polymerase III [*Bacillus subtilis*] | 79 | 65 | 4395 |
| 82 | 14 | 13326 | 15689 | gnl\|PID\|e255093 | hypothetical protein [*Bacillus subtilis*] | 79 | 65 | 2364 |
| 86 | 13 | 12233 | 11118 | gi\|683582 | prephenate dehydrogenase [*Lactococcus lactis*] | 79 | 58 | 1116 |
| 92 | 3 | 940 | 1734 | gi\|537286 | triosephosphate isomerase [*Lactococcus lactis*] | 79 | 65 | 795 |
| 98 | 6 | 4023 | 4742 | gnl\|PID\|d100262 | LivG protein [*Salmonella typhimurium*] | 79 | 63 | 720 |
| 99 | 12 | 16315 | 14150 | gi\|153736 | a-galactosidase [*Streptococcus mutans*] | 79 | 64 | 2166 |
| 107 | 7 | 5684 | 6406 | gi\|460080 | D-alanine:D-alanine ligase-related protein [*Enterococcus faecalis*] | 79 | 58 | 723 |
| 113 | 9 | 6858 | 8303 | gi\|466882 | ppsl; B1496_C2_189 [*Mycobacterium leprae*] | 79 | 64 | 1446 |
| 151 | 10 | 13424 | 12213 | gi\|450686 | 3-phosphoglycerate kinase [*Thermotoga maritima*] | 79 | 60 | 1212 |
| 162 | 2 | 1158 | 3017 | gi\|506700 | CapD [*Staphylococcus aureus*] | 79 | 67 | 1860 |
| 177 | 5 | 2876 | 3052 | gi\|912423 | putative [*Lactococcus lactis*] | 79 | 61 | 177 |
| 177 | 8 | 4198 | 4563 | gi\|149429 | putative [*Lactococcus lactis*] | 79 | 61 | 366 |
| 187 | 3 | 2728 | 2907 | gnl\|PID\|d102002 | (AB001488) FUNCTION UNKNOWN [*Bacillus subtilis*] | 79 | 53 | 180 |
| 189 | 7 | 3589 | 4350 | gnl\|PID\|e183449 | putative ATP-binding protein of ABC-type [*Bacillus subtilis*] | 79 | 61 | 762 |
| 191 | 5 | 4249 | 3449 | gi\|149519 | indoleglycerol phosphate synthase [*Lactococcus lactis*] | 79 | 66 | 801 |
| 211 | 3 | 1805 | 2737 | gi\|147404 | mannose permease subunit II-M-Man [*Escherichia coli*] | 79 | 57 | 933 |
| 212 | 3 | 3863 | 3621 | gnl\|PID\|e209004 | glutaredoxin-like protein [*Lactococcus lactis*] | 79 | 58 | 243 |
| 215 | 1 | 987 | 715 | gi\|1183242 | (AF008220) arginine succinate synthase [*Bacillus subtilis*] | 79 | 64 | 273 |
| 323 | 2 | 530 | 781 | gi\|897795 | 30S ribosomal protein [*Pediococcus acidilactici*] | 79 | 67 | 252 |
| 380 | 1 | 694 | 2 | gi\|1184680 | polynucleotide phosphorylase [*Bacillus subtilis*] | 79 | 64 | 693 |
| 384 | 2 | 655 | 239 | gi\|143328 | phoP protein (put.); putative [*Bacillus subtilis*] | 79 | 59 | 417 |
| 6 | 3 | 2820 | 4091 | gi\|853767 | UDP-N-acetylglucosamine 1-carboxyvinyltransferase [*Bacillus subtilis*] | 78 | 62 | 1272 |
| 8 | 1 | 50 | 1786 | gi\|149432 | putative [*Lactococcus lactis*] | 78 | 63 | 1737 |
| 9 | 1 | 351 | 124 | gi\|897793 | y98 gene product [*Pediococcus acidilactici*] | 78 | 59 | 228 |
| 15 | 8 | 7364 | 8314 | gnl\|PID\|d100585 | cystein synthetase [*Bacillus subtilis*] | 78 | 63 | 951 |
| 20 | 10 | 9783 | 10310 | gnl\|PID\|d100583 | stage V sporulation [*Bacillus subtilis*] | 78 | 58 | 573 |
| 20 | 16 | 17165 | 17713 | gi\|49105 | hypoxanthine phosphoribosyltransferase [*Lactococcus lactis*] | 78 | 59 | 549 |
| 22 | 22 | 17388 | 18416 | gnl\|PID\|d101315 | Ygfe [*Bacillus subtilis*] | 78 | 60 | 1029 |
| 22 | 27 | 20971 | 20612 | gi\|299163 | alanine dehydrogenase [*Bacillus subtilis*] | 78 | 59 | 360 |
| 34 | 8 | 7407 | 7105 | gi\|41015 | aspartate-tRNA ligase [*Escherichia coli*] | 78 | 55 | 303 |
| 35 | 8 | 6257 | 5196 | gi\|1657644 | Cap8E [*Staphylococcus aureus*] | 78 | 60 | 1062 |
| 40 | 11 | 9287 | 8001 | gi\|1173518 | GTP cyclohydrase II 3,4-dihydroxy-2-butanone-4-phosphate synthase [*Actinobacillus pleuropneumoniae*] | 78 | 58 | 1287 |
| 48 | 31 | 22422 | 23183 | gi\|2314330 | (AE000623) glutamine ABC transporter, ATP-binding protein (glnQ) [*Helicobacter pylori*] | 78 | 58 | 762 |
| 52 | 2 | 2101 | 1430 | gi\|1183887 | integral membrane protein [*Bacillus subtilis*] | 78 | 54 | 672 |
| 55 | 14 | 13605 | 12712 | gnl\|PID\|d102026 | (AB002150) YbbP [*Bacillus subtilis*] | 78 | 58 | 894 |
| 55 | 17 | 16637 | 15612 | gnl\|PID\|e313027 | hypothetical protein [*Bacillus subtilis*] | 78 | 51 | 1026 |
| 71 | 14 | 19756 | 19598 | gi\|179764 | calcium channel alpha-1D subunit [*Homo sapiens*] | 78 | 57 | 159 |
| 74 | 11 | 15031 | 14018 | gi\|1573279 | Holliday junction DNA helicase (rubB) [*Haemophilus influenzae*] | 78 | 57 | 1014 |
| 75 | 9 | 6623 | 7972 | gi\|1877423 | galactose-1-P-uridyl transferase [*Streptococcus mutans*] | 78 | 62 | 1350 |
| 81 | 12 | 12125 | 13906 | gi\|1573607 | L-fucose isomerase (fucI) [*Haemophilus influenzae*] | 78 | 66 | 1782 |
| 82 | 3 | 2423 | 4417 | gi\|153744 | ORF X; putative [*Streptococcus mutans*] | 78 | 64 | 1995 |
| 83 | 18 | 16926 | 18500 | gi\|143373 | phosphoribosyl aminoimidazole carboxy formyl formyltransferase/inosine monophosphate cyclohydrolase (PUR-H(J)) [*Bacillus subtilis*] | 78 | 63 | 1575 |
| 83 | 20 | 20212 | 20775 | gi\|143364 | phosphoribosyl aminoimidazole carboxylase I (PUR-E) [*Bacillus subtilis*] | 78 | 64 | 564 |
| 92 | 2 | 165 | 878 | gnl\|PID\|d101190 | ORF2 [*Streptococcus mutans*] | 78 | 62 | 714 |
| 98 | 8 | 5863 | 6909 | gi\|2331287 | (AF013188) release factor 2 [*Bacillus subtilis*] | 78 | 63 | 1047 |
| 113 | 3 | 1071 | 2741 | gi\|580914 | dnaZX [*Bacillus subtilis*] | 78 | 64 | 1671 |
| 127 | 4 | 1133 | 2071 | gi\|142463 | RNA polymerase alpha-core-subunit [*Bacillus subtilis*] | 78 | 59 | 939 |

TABLE 2-continued

S. pneumoniae - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 132 | 1 | 2782 | 497 | gi\|1561763 | pullulanase [Bacteroides thetaiotaomicron] | 78 | 58 | 2286 |
| 135 | 4 | 2698 | 3537 | gi\|1788036 | (AE000269) NH3-dependent AND synthetase [Escherichia coli] | 78 | 66 | 840 |
| 140 | 24 | 26853 | 25423 | gi\|1100077 | phospho-beta-glucosidase [Clostridium longisporum] | 78 | 64 | 1431 |
| 150 | 5 | 4690 | 4514 | gi\|149464 | amino peptidase [Lactococcus lactis] | 78 | 42 | 177 |
| 152 | 1 | 1 | 795 | gi\|639915 | NADH dehydrogenase subunit [Thunbergia alata] | 78 | 43 | 795 |
| 162 | 4 | 4997 | 4110 | gnl\|PID\|e323528 | putative YhaP protein [Bacillus subtilis] | 78 | 64 | 888 |
| 181 | 10 | 8651 | 7947 | gi\|149402 | lactose repressor (lacR; alt.) [Lactococcus lactis] | 78 | 48 | 705 |
| 200 | 4 | 3627 | 4958 | gnl\|PID\|d100172 | invertase [Zymomonas mobilis] | 78 | 61 | 1332 |
| 203 | 3 | 3230 | 3015 | gi\|1174237 | CycK [Pseudomonas fluorescens] | 78 | 57 | 216 |
| 210 | 9 | 6789 | 7172 | gi\|580902 | ORF6 gene product [Bacillus subtilis] | 78 | 42 | 384 |
| 214 | 6 | 3810 | 2797 | gnl\|PID\|d102049 | P. haemolytica o-sialoglycoproptein endopeptidase; P36174 (660) transmembrane [Bacillus subtilis] | 78 | 60 | 1014 |
| 214 | 13 | 6322 | 8163 | gi\|1377831 | unknown [Bacillus subtilis] | 78 | 62 | 1842 |
| 217 | 1 | 9 | 2717 | gi\|488430 | alcohol dehydrogenase 2 [Entamoeba histolytica] | 78 | 64 | 2709 |
| 222 | 3 | 2316 | 3098 | gi\|15733047 | spore gemination and vegetative growth protein (gerC2) [Haemophilus influenzae] | 78 | 65 | 783 |
| 268 | 1 | 742 | 8 | gi\|517210 | putative transposase [Streptococcus pyogenes] | 78 | 65 | 735 |
| 276 | 1 | 223 | 753 | gnl\|PID\|d100306 | ribosomal protein L1 [Bacillus subtilis] | 78 | 65 | 531 |
| 312 | 3 | 1567 | 1079 | gi\|289261 | comE ORF2 [Bacillus subtilis] | 78 | 54 | 489 |
| 339 | 1 | 117 | 794 | gi\|1916729 | CadD [Staphylococcus aureus] | 78 | 53 | 678 |
| 342 | 2 | 762 | 265 | gi\|1842439 | phosphatidylglycerophosphate synthase [Bacillus subtilis] | 78 | 59 | 498 |
| 383 | 1 | 737 | 3 | gi\|1184680 | polynucleotide phosphorylase [Bacillus subtilis] | 78 | 64 | 735 |
| 7 | 15 | 11923 | 11018 | gi\|1399855 | carboxyltransferase beta subunit [Synechococcus PCC7942] | 77 | 63 | 906 |
| 8 | 2 | 1698 | 2255 | gi\|149433 | putative [Lactococcus lactis] | 77 | 59 | 558 |
| 17 | 14 | 6948 | 7550 | gi\|520738 | comA protein [Streptococcus pneumoniae] | 77 | 60 | 603 |
| 30 | 12 | 9761 | 8967 | gi\|1000451 | TreP [Bacillus subtilis] | 77 | 43 | 795 |
| 36 | 14 | 11421 | 12131 | gi\|1573766 | phosphoglyceromutase (gpmA) [Haemophilus influenzae] | 77 | 64 | 711 |
| 55 | 3 | 3836 | 4096 | gi\|1708640 | YeaB [Bacillus subtilis] | 77 | 55 | 261 |
| 61 | 8 | 8377 | 8054 | gi\|1890649 | multidrug resistance protein LmrA [Lactococcus lactis] | 77 | 51 | 324 |
| 65 | 2 | 607 | 1254 | gi\|40103 | ribosomal protein L4 [Bacillus stearothermophilus] | 77 | 63 | 648 |
| 68 | 8 | 7509 | 7240 | gi\|47551 | MRP [Streptococcus suis] | 77 | 68 | 270 |
| 69 | 1 | 1083 | 118 | gnl\|PID\|e311493 | unknown [Bacillus subtilis] | 77 | 57 | 966 |
| 77 | 5 | 4583 | 4026 | gnl\|PID51 e281578 | hypothetical 12.2 kd protein [Bacillus subtilis] | 77 | 60 | 558 |
| 83 | 14 | 13104 | 14552 | gi\|1590947 | amidophosphoribosyltransferase [Methanococcus jannaschii] | 77 | 56 | 1449 |
| 94 | 4 | 3006 | 5444 | gnl\|PID\|e329895 | (AJ000496) cyclic nucleotide-gated channel beta subunit [Rattus norvegicus] | 77 | 66 | 2439 |
| 96 | 11 | 8518 | 8880 | gi\|551879 | ORF 1 [Lactococcus lactis] | 77 | 62 | 363 |
| 99 | 11 | 14082 | 12799 | gi\|153737 | sugar-binding protein [Streptococcus mutans] | 77 | 61 | 1284 |
| 106 | 2 | 361 | 1176 | gi\|148921 | LicD protein [Haemophilus influenzae] | 77 | 51 | 816 |
| 108 | 4 | 3152 | 4030 | gi\|1574730 | tellurite resistance protein (tehB) [Haemophilus influenzae] | 77 | 58 | 879 |
| 118 | 4 | 3520 | 3131 | gi\|1573900 | D-alanine permease (dagA) [Haemophilus influenzae] | 77 | 57 | 390 |
| 124 | 4 | 1796 | 1071 | gi\|1573162 | tRNA (guanine-N1)-methyltransferase (trmD) [Haemorphilus influenzae] | 77 | 58 | 726 |
| 126 | 4 | 5909 | 4614 | gnl\|PID\|d101163 | Srb [Bacillus subtilis] | 77 | 62 | 1296 |
| 128 | 2 | 630 | 1373 | gnl\|PID\|d101328 | YqiZ [Bacillus subtilis] | 77 | 58 | 744 |
| 130 | 1 | 1 | 1287 | gnl\|PID\|e325013 | hypothetical protein [Bacillus subtilis] | 77 | 61 | 1287 |
| 139 | 5 | 4388 | 3639 | gi\|2293302 | (AF008220) YtqA [Bacillus subtilis] | 77 | 59 | 750 |
| 140 | 11 | 10931 | 9582 | gi\|289284 | cysteinyl-tRNA synthetase [Bacillus subtilis] | 77 | 64 | 1350 |
| 140 | 18 | 19451 | 19263 | gi\|517210 | putative transposase [Streptococcus pyogenes] | 77 | 66 | 189 |
| 141 | 2 | 976 | 1683 | gnl\|PID\|e157887 | URF5 (aa 1–573) [Drosophila yakuba] | 77 | 50 | 708 |
| 141 | 4 | 2735 | 5293 | gi\|556258 | secA [Listeria monocytogenes] | 77 | 59 | 2559 |
| 144 | 2 | 671 | 2173 | gnl\|PID\|d100585 | lysyl-tRNA thynthetase [Bacillus subtilis] | 77 | 61 | 1503 |
| 163 | 5 | 6412 | 7398 | gi\|511015 | dihydroorotate dehydrogenase A [Lactococcus lactis] | 77 | 62 | 987 |
| 164 | 10 | 7841 | 7074 | gni\|PID\|d100964 | homologue of iron dicitrate transport ATP-binding protein FecE of E. coli [Bacillus subtilis] | 77 | 52 | 768 |
| 191 | 8 | 7257 | 5791 | gi\|149516 | anthranilate synthase alpha subunit [Lactococcus lactis] | 77 | 57 | 1467 |
| 198 | 8 | 5377 | 5177 | gi\|1573856 | hypothetical [Haemophilus influenzae] | 77 | 66 | 201 |
| 213 | 1 | 202 | 462 | gi\|1743860 | Brac2 ]Mus musculus] | 77 | 50 | 261 |
| 250 | 2 | 231 | 509 | gnl\|PID\|e334776 | YlbH protein [Bacillus subtilis] | 77 | 60 | 279 |
| 289 | 3 | 1737 | 1276 | gnl\|PID\|d100947 | Ribosomal Protein L10 [Bacillus subtilis] | 77 | 62 | 462 |
| 292 | 2 | 1399 | 668 | gi\|143004 | transfer RNA-Gln synthetase [Bacillus stearothermophilus] | 77 | 58 | 732 |
| 7 | 3 | 2734 | 1166 | gnl\|PID\|d101824 | peptide-chain-release factor 3 [Synechocystis sp.] | 76 | 53 | 1569 |
| 7 | 23 | 18474 | 18235 | gi\|455157 | acyl carrier protein [Crypotomas phi] | 76 | 57 | 240 |
| 9 | 8 | 5706 | 4342 | gi\|1146247 | asparaginyl-tRNA synthetase [Bacillus subtilis] | 76 | 61 | 1365 |
| 10 | 5 | 4531 | 4385 | gnl\|PID\|e314495 | hypothetical protein [Clostridium perfringens] | 76 | 53 | 147 |
| 18 | 2 | 1615 | 842 | gi\|1591672 | phosphate transport system ATP-binding protein [Methanococcus jannaschii] | 76 | 56 | 774 |
| 22 | 37 | 27796 | 28173 | gnl\|PID\|e13389 | translation initiation factor IF3 (AA 1–172) [Bacillus stearothermophilus] | 76 | 64 | 378 |
| 35 | 6 | 3869 | 2682 | gi\|1773346 | Cap5G [Staphylococcus aureus] | 76 | 61 | 1188 |
| 48 | 28 | 21113 | 21787 | gi\|2314328 | (AE000623) glutamine ABC transporter, permease protein (glnP) [Helicobacter pylori] | 76 | 52 | 675 |
| 52 | 12 | 12881 | 13786 | gi\|142521 | deoxyribodipyrimidine photolyase [Bacillus subtilis] | 76 | 58 | 906 |
| 55 | 10 | 11521 | 10571 | gnl\|PID\|e283110 | femD [Staphylococcus aureus] | 76 | 61 | 951 |

TABLE 2-continued

_S. pneumoniae - Putative coding regions of novel proteins similar to known proteins_

| Contig ID | ORF ID | Start (nt) | Stop (nt) | match acession | match gene name | % sim | % ident | length (nt) |
|---|---|---|---|---|---|---|---|---|
| 57 | 8 | 7824 | 6559 | gi\|290561 | o188 [*Escherichia coli*] | 76 | 47 | 1266 |
| 62 | 5 | 2406 | 2095 | gnl\|PID\|e313024 | hypothetical protein [*Bacillus subtilis*] | 76 | 59 | 312 |
| 65 | 9 | 4223 | 4441 | gi\|40148 | L29 protein (AA 1–66) [*Bacillus subtilis*] | 76 | 58 | 219 |
| 68 | 2 | 1328 | 2371 | gnl\|PID\|e284233 | anabolic ornithine carbamoyltransferase [*Lactobacillus plantarum*] | 76 | 61 | 1044 |
| 69 | 8 | 7297 | 6005 | gnl\|PID\|d101420 | Pyrimidine nucleoside phosphorylase [*Bacillus stearothermophilus*] | 76 | 61 | 1293 |
| 73 | 12 | 7839 | 7267 | gnl\|PID\|e243629 | unknown [*Mycobacterium tubercolosis*] | 76 | 53 | 573 |
| 74 | 5 | 8433 | 7039 | gnl\|PID\|d102048 | C. thermocellum beta-glucosidase; P2208 (985) [*Bacillus subtilis*] | 76 | 60 | 1395 |
| 80 | 5 | 7643 | 7936 | gi\|2314030 | (AE000599) conserved hypothetical protein [*Helicobacter pylori*] | 76 | 61 | 294 |
| 82 | 15 | 16019 | 16996 | gi\|1573900 | D-alanine permease (dagA) [*Haemophilus influenzae*] | 76 | 56 | 978 |
| 83 | 19 | 18616 | 19884 | gi\|143374 | phosphoribosyl glycinamide synthetase (PUR-D; gtg start condon) [*Bacillus subtilis*] | 76 | 60 | 1269 |
| 86 | 14 | 13409 | 12231 | gi\|143806 | AroF [*Bacillus subtilis*] | 76 | 58 | 1179 |
| 87 | 1 | 3 | 1442 | gi\|153804 | sucrose-6-phosphate hydrolase [*Streptococcus mutans*] | 76 | 59 | 1440 |
| 87 | 16 | 15754 | 15110 | gnl\|PID\|e323500 | putative Gmk protein [*Bacillus subtilis*] | 76 | 56 | 645 |
| 93 | 4 | 1769 | 1539 | gi\|1574820 | 1,4-alpha-glucan branching enzyme (glgB) [*Haemophilus influenzae*] | 76 | 46 | 231 |
| 94 | 1 | 51 | 365 | gi\|144313 | 6.0 kd ORF [Plasmid ColE1] | 76 | 73 | 315 |
| 116 | 2 | 2151 | 1678 | gi\|153841 | pneumococcal surface protein A [*Streptococcus pneumoniae*] | 76 | 59 | 474 |
| 123 | 6 | 3442 | 5895 | gi\|1314297 | ClpC ATPase [*Listeria monocytogenes*] | 76 | 59 | 2454 |
| 126 | 2 | 2156 | 2932 | gnl\|PID\|d101328 | YqiZ [*Bacillus subtilis*] | 76 | 61 | 777 |
| 128 | 10 | 6973 | 7797 | gi\|944944 | purine nucleoside phosphorylase [*Bacillus subtilis*] | 76 | 60 | 825 |
| 131 | 11 | 6186 | 5812 | gi\|1674310 | (AE000058) Mycoplasma pneumoniae, MG085 homolog, from *M. genitalium* [*Mycoplasma pneumoniae*] | 76 | 47 | 375 |
| 139 | 4 | 3641 | 3192 | gi\|2293302 | (AF008220) YtgA [*Bacillus subtilis*] | 76 | 53 | 450 |
| 140 | 14 | 14872 | 12536 | gi\|1184680 | polynucleotide phosphorylase [*Bacillus subtilis*] | 76 | 62 | 2337 |
| 143 | 2 | 2583 | 3905 | gi\|143795 | transfer RNA-Tyr synthetase [*Bacillus subtilis*] | 76 | 61 | 1323 |
| 170 | 6 | 5095 | 6114 | gnl\|PID\|d100959 | ycgQ [*Bacillus subtilis*] | 76 | 44 | 1020 |
| 180 | 2 | 1927 | 557 | gi\|40019 | ORF 821 (aa 1–821) [*Bacillus subtilis*] | 76 | 53 | 1371 |
| 191 | 7 | 5815 | 5228 | gi\|551880 | anthranilate synthase beta subunit [*Lactococcus lactis*] | 76 | 61 | 588 |
| 195 | 3 | 3829 | 2444 | gi\|2149905 | D-glutamic acid adding enzyme [*Enterococcus faecalis*] | 76 | 60 | 1386 |
| 200 | 3 | 1914 | 3629 | gi\|431272 | lysis protein [*Bacillus subtilis*] | 76 | 58 | 1716 |
| 201 | 1 | 431 | 207 | gi\|2208998 | dextran glucosidase DexS [*Streptococcus suis*] | 76 | 57 | 225 |
| 214 | 2 | 1283 | 2380 | gi\|553278 | transposase [*Streptococcus pneumoniae*] | 76 | 55 | 1098 |
| 225 | 3 | 2338 | 3411 | gi\|1552775 | ATP-binding protein [*Escherichia coli*] | 76 | 56 | 1074 |
| 233 | 1 | 2 | 724 | gi\|1163115 | neuraminidase B [*Streptococcus pneumoniae*] | 76 | 60 | 723 |
| 347 | 1 | 523 | 38 | gi\|537033 | ORF_f356 [*Escherichia coli*] | 76 | 60 | 486 |
| 356 | 2 | 842 | 165 | gi\|2149905 | D-glutamic acid adding enzyme [*Enterococcus faecalis*] | 76 | 61 | 678 |
| 366 | 3 | 734 | 348 | gi\|149520 | phosphoribosyl anthranilate isomerase [*Lactococcus lactis*] | 76 | 69 | 387 |
| 5 | 8 | 12599 | 11484 | gi\|1574293 | fimbrial transcription regulation repressor (pilB) [*Haemophilus influenzae*] | 75 | 61 | 1116 |
| 6 | 13 | 12553 | 11894 | gnl\|PID\|d102050 | ydiH [*Bacillus subtilis*] | 75 | 51 | 660 |
| 9 | 10 | 7282 | 6062 | gi\|142538 | aspartate aminotransferase [Bacillus sp.] | 75 | 55 | 1221 |
| 10 | 12 | 8080 | 7940 | gi\|149493 | SCRFI methylase [*Lactococcus lactis*] | 75 | 56 | 141 |
| 18 | 5 | 4266 | 3301 | gnl\|PID\|d101319 | YqgH [*Bacillus subtilis*] | 75 | 52 | 966 |
| 22 | 4 | 1838 | 2728 | gi\|1373157 | orf-X; hypothetical protein; Method: conceptual translation supplied by author [*Bacillus subtilis*] | 75 | 62 | 891 |
| 30 | 11 | 9015 | 7828 | gi\|153801 | enzyme scr-II [*Streptococcus mutans*] | 75 | 64 | 1188 |
| 31 | 5 | 2362 | 2030 | gi\|2293211 | (AF008220) putative thioredoxin [*Bacillus subtilis*] | 75 | 53 | 333 |
| 32 | 9 | 7484 | 8359 | gnl\|PID\|d100560 | formamidopyrimidine-DNA glycosylase [*Streptococcus mutans*] | 75 | 61 | 876 |
| 33 | 4 | 1735 | 1448 | gi\|413976 | ipa-52r gene product [*Bacillus subtilis*] | 75 | 53 | 288 |
| 33 | 10 | 6470 | 5769 | gi\|533105 | unknown [*Bacillus subtilis*] | 75 | 56 | 702 |
| 33 | 12 | 6878 | 7183 | pir\|A00205\|FECL | ferredoxin [4Fe-4S] - Clostridium thermaceticum | 75 | 56 | 306 |
| 36 | 1 | 181 | 2 | gi\|2088739 | (AF003141) strong similarity to the FABP/P2/CRBP/CRABP family of transporters [*Caenorhabditis elegans*] | 75 | 43 | 180 |
| 38 | 22 | 14510 | 15379 | gi\|1574058 | hypothetical [*Haemophilus influenzae*] | 75 | 56 | 870 |
| 48 | 33 | 23398 | 24066 | gi\|1930092 | outer membrane protein [*Campylobacter jejuni*] | 75 | 56 | 669 |
| 51 | 1 | 2 | 319 | gi\|43985 | nifS-like gene [*Lactobacillus delbrueckii*] | 75 | 55 | 318 |
| 51 | 10 | 8318 | 11683 | gi\|537192 | CG Site No. 620; alternate gene names hs, hsp, hsr, rm; apparent frameshift in GenBank Accession Number X06545 [*Escherichia coli*] | 75 | 50 | 3366 |
| 54 | 18 | 19566 | 20759 | gi\|666069 | orf2 gene product [*Lactobacillus leichmannii*] | 75 | 58 | 1194 |
| 57 | 9 | 8448 | 7822 | gi\|290561 | o188 [*Escherichia coli*] | 75 | 50 | 627 |
| 65 | 14 | 6072 | 6356 | gi\|606241 | 30S ribosomal subunit protein S14 [*Escherichia coli*] | 75 | 64 | 285 |
| 70 | 4 | 3071 | 2472 | gi\|1256617 | adenine phosphoribosyltransferase [*Bacillus subtilis*] | 75 | 57 | 600 |
| 71 | 24 | 30399 | 29404 | gi\|1574390 | C4-dicarboxylate transport protein [*Haemophilus influenzae*] | 75 | 57 | 996 |
| 73 | 2 | 910 | 455 | gnl\|PID\|e249656 | YneT [*Bacillus subtilis*] | 75 | 57 | 456 |
| 79 | 1 | 1810 | 491 | gi\|1146219 | 28.2% of identity to the *Escherichia coli* GTP-binding protein Era; putative [*Bacillus subtilis*] | 75 | 59 | 1320 |
| 82 | 5 | 6360 | 6536 | gi\|1655715 | BztD [*Rhodobacter capsulatus*] | 75 | 55 | 177 |
| 83 | 6 | 1938 | 2975 | gnl\|PID\|e323529 | putative PlsX protein [*Bacillus subtilis*] | 75 | 56 | 1038 |
| 93 | 11 | 7368 | 5317 | gi\|39989 | methionyl-tRNA synthetase [*Bacillus stearothermophilus*] | 75 | 58 | 2052 |
| 93 | 13 | 9409 | 8699 | gi\|1591493 | glutamine transport ATP-binding protein Q [*Methanococcus jannaschii*] | 75 | 54 | 711 |
| 95 | 1 | 1795 | 47 | gnl\|PID\|e323510 | Ylov protein [*Bacillus subtilis*] | 75 | 57 | 1749 |
| 103 | 2 | 362 | 1186 | gnl\|PID\|e266928 | unknown [*Mycobacterium tuberculosis*] | 75 | 64 | 825 |
| 104 | 1 | 691 | 915 | gi\|460026 | repressor protein [*Streptococcus pneumoniae*] | 75 | 54 | 225 |

TABLE 2-continued

*S. pneumoniae* - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 113 | 5 | 2951 | 3883 | gnl\|PID\|d101119 | ABC transporter subunit [*Synechocystis* sp.] | 75 | 55 | 933 |
| 121 | 1 | 320 | 1390 | gi\|2145131 | repressor of class I heat shock gene expression HrcA [*Streptococcus mutans*] | 75 | 58 | 1071 |
| 127 | 6 | 2614 | 3000 | gi\|1500451 | *M. jannaschii* predicted coding region MJ1558 [*Methanococcus jannaschii*] | 75 | 44 | 387 |
| 137 | 18 | 10082 | 10687 | gi\|393116 | P-glycoprotein 5 [*Entamoeba histolytica*] | 75 | 52 | 606 |
| 149 | 11 | 8499 | 9338 | gnl\|PID\|d100582 | unknown [*Bacillus subtilis*] | 75 | 55 | 840 |
| 151 | 6 | 9100 | 7673 | gi\|40467 | HsdS polypeptide, part of CfrA family [*Citrobacter freundii*] | 75 | 57 | 1428 |
| 158 | 1 | 986 | 3 | gnl\|PID\|e253891 | UDP-glucose 4-epimerase [*Bacillus subtilis*] | 75 | 63 | 984 |
| 172 | 8 | 5653 | 6774 | gi\|142978 | glycerol dehydrogenase [*Bacillus stearothermophilus*] | 75 | 56 | 1122 |
| 172 | 9 | 7139 | 9730 | gnl\|PID\|e268456 | unknown [*Mycobacterium tuberculosis*] | 75 | 58 | 2592 |
| 173 | 1 | 261 | 79 | gnl\|PID\|e236469 | C10C5.6 [*Caenorhabditis elegans*] | 75 | 50 | 183 |
| 185 | 3 | 3066 | 2014 | gi\|1574806 | spermidine/putrescine transport ATP-binding protein (potA) [*Haemophilus influenzae*] | 75 | 56 | 1053 |
| 191 | 6 | 5235 | 4213 | gi\|149518 | phosphoribosyl anthranilate transferase [*Lactococcus lactis*] | 75 | 61 | 1023 |
| 226 | 2 | 1774 | 1181 | gi\|2314588 | (Ae000642) conserved hypothetical protein [*Helicobacter pylori*] | 75 | 65 | 594 |
| 231 | 1 | 1 | 153 | gi\|40173 | homolog of *E. coli* ribosomal protein L21 [*Bacillus subtilis*] | 75 | 57 | 153 |
| 234 | 1 | 2 | 418 | gi\|2293259 | (AF008220) YtqI [*Bacillus subtilis*] | 75 | 59 | 417 |
| 279 | 1 | 552 | 151 | gi\|1119198 | unknown protein [*Bacillus subtilis*] | 75 | 50 | 402 |
| 291 | 7 | 3558 | 3827 | gi\|40011 | ORF17 (AA 1–161) [*Bacillus subtilis*] | 75 | 48 | 270 |
| 375 | 2 | 137 | 628 | gi\|410137 | ORFX13 [*Bacillus subtilis*] | 75 | 58 | 492 |
| 6 | 20 | 16721 | 17560 | gi\|2293323 | (AF008220) YtdI [*Bacillus subtilis*] | 74 | 53 | 840 |
| 7 | 6 | 4682 | 6052 | gi\|1354211 | PET112-like protein [*Bacillus subtilis*] | 74 | 60 | 1371 |
| 18 | 4 | 3341 | 2427 | gnl\|PID\|d101319 | YqgI [*Bacillus subtilis*] | 74 | 54 | 915 |
| 21 | 6 | 5885 | 4800 | gi\|1072381 | glutamyl-aminopeptidase [*Lactococcus lactis*] | 74 | 59 | 1086 |
| 24 | 2 | 739 | 548 | gi\|2314762 | (AE000655) ABC transporter, permease protein (yaeE) [*Helicobacter pylori*] | 74 | 46 | 192 |
| 25 | 1 | 2 | 367 | gnl\|PID\|d100932 | H2O-forming NADH Oxidase [*Streptococcus mutans*] | 74 | 63 | 366 |
| 38 | 18 | 11432 | 12964 | gi\|537034 | ORF_o488 [*Escherichia coli*] | 74 | 57 | 1533 |
| 48 | 10 | 8924 | 6669 | gi\|1513069 | P-type adenosine triphosphatase [*Listeria monocytogenes*] | 74 | 53 | 2256 |
| 55 | 11 | 11964 | 11401 | gnl\|PID\|e283110 | femD [*Staphylococcus aureus*] | 74 | 64 | 564 |
| 61 | 2 | 1782 | 427 | gi\|2293216 | (AF008220) putative UDP-N-acetylmuramate-alanine ligase [*Bacillus subtilis*] | 74 | 55 | 1356 |
| 76 | 10 | 9414 | 8065 | gnl\|PID\|d101325 | YaiB [*Bacillus subtilis*] | 74 | 54 | 1350 |
| 83 | 2 | 666 | 926 | pir\|C33496\|C334 | hisC homolog - *Bacillus subtilis* | 74 | 55 | 261 |
| 86 | 9 | 8985 | 8080 | gi\|683585 | prephenate dehydratase [*Lactococcus lactis*] | 74 | 55 | 906 |
| 102 | 5 | 5005 | 5652 | gi\|143394 | OMP-PRPP transferase [*Bacillus subtilis*] | 74 | 57 | 648 |
| 103 | 5 | 4364 | 3267 | gnl\|PID\|e323524 | YloN protein [*Bacillus subtilis*] | 74 | 62 | 1098 |
| 108 | 7 | 6864 | 7592 | gnl\|PID\|e257631 | methyltransferase [*Lactococcus lactis*] | 74 | 56 | 729 |
| 131 | 2 | 478 | 146 | gnl\|PID\|d101320 | YqgZ [*Bacillus subtilis*] | 74 | 45 | 333 |
| 133 | 2 | 1380 | 919 | gnl\|PID\|e313025 | hypothetical protein [*Bacillus subtilis*] | 74 | 60 | 462 |
| 137 | 9 | 6167 | 6787 | gnl\|PID\|d100479 | Na+ -ATPase subunit D [*Enterococcus hirae*] | 74 | 53 | 621 |
| 149 | 4 | 3008 | 3883 | gnl\|PID\|d100581 | high level kasgamycin resistance [*Bacillus subtilis*] | 74 | 55 | 876 |
| 157 | 2 | 243 | 824 | gi\|1573373 | methylated-DNA--protein-cysteine methyltransferase (dat1) [*Haemophilus influenzae*] | 74 | 48 | 582 |
| 164 | 6 | 3515 | 4249 | gi\|410131 | ORFX7 [*Bacillus subtilis*] | 74 | 48 | 735 |
| 167 | 7 | 5446 | 5201 | gi\|413927 | ipa-3r gene product [*Bacillus subtilis*] | 74 | 55 | 246 |
| 171 | 1 | 1 | 1818 | gnl\|PID\|d102251 | beta-galactosidase [*Bacillus circulans*] | 74 | 62 | 1818 |
| 172 | 4 | 1064 | 2392 | gi\|466474 | cellobiose phosphotransferase enzyme II" [*Bacillus stearothermophilus*] | 74 | 50 | 1329 |
| 185 | 1 | 326 | 3 | gi\|1573646 | Mg(2+) transport ATPase protein C (mgtC) (SP:P22037) [*Haemophilus influenzae*] | 74 | 68 | 324 |
| 188 | 2 | 1089 | 2018 | gi\|1573008 | ATP dependent translocator homolog (msbA) [*Haemophilus influenzae*] | 74 | 44 | 930 |
| 189 | 11 | 6491 | 7174 | gi\|1661199 | sakacin A production response regulator [*Streptococcus mutans*] | 74 | 60 | 684 |
| 210 | 2 | 520 | 1287 | gi\|2293207 | (AF008220) YtmQ [*Bacillus subtilis*] | 74 | 60 | 768 |
| 261 | 1 | 836 | 192 | gi\|666983 | putative ATP binding subunit [*Bacillus subtilis*] | 74 | 55 | 645 |
| 263 | 3 | 1619 | 3655 | gi\|663232 | Similarity with *S. cerevisiae* hypothetical 137.7 kD protein in subtelomeric Y' repeat region [*Saccharomyces cerevisiae*] | 74 | 42 | 2037 |
| 265 | 2 | 844 | 1227 | gi\|49272 | Asparaginase [*Bacillus licheniformis*] | 74 | 64 | 384 |
| 368 | 1 | 1 | 942 | gi\|603998 | unknown [*Saccharomyces cerevisiae*] | 74 | 39 | 942 |
| 7 | 16 | 13357 | 11921 | gnl\|PID\|d101324 | YqhX [*Bacillus subtilis*] | 73 | 57 | 1437 |
| 17 | 10 | 5706 | 5449 | gnl\|PID\|e305362 | unnamed protein product [*Streptococcus thermophilus*] | 73 | 47 | 258 |
| 31 | 2 | 522 | 244 | gnl\|PID\|d100576 | single strand DNA binding protein [*Bacillus subtilis*] | 73 | 55 | 279 |
| 32 | 6 | 5667 | 6194 | gnl\|PID\|d101315 | YqfG [*Bacillus subtilis*] | 73 | 58 | 528 |
| 34 | 15 | 10281 | 9790 | gnl\|PID\|d102151 | (AB001684) ORF42c [*Chlorella vulgaris*] | 73 | 46 | 492 |
| 40 | 12 | 9876 | 9226 | gi\|1173517 | riboflavin synthase alpha subunit [*Actinobacillus pleuropneumoniae*] | 73 | 55 | 651 |
| 55 | 2 | 3592 | 839 | gnl\|PID\|d101887 | cation-transporting ATPase PacL [*Synechocystis* sp.] | 73 | 60 | 2754 |
| 55 | 18 | 17494 | 16586 | gnl\|PID\|e265580 | unknown [*Mycobacterium tuberculosis*] | 73 | 52 | 909 |
| 65 | 16 | 7213 | 7767 | gi\|143419 | ribosomal protein L6 [*Bacillus stearothermophilus*] | 73 | 60 | 555 |
| 66 | 3 | 3300 | 3659 | gnl\|PID\|e269883 | LacF [*Lactobacillus casei*] | 73 | 52 | 360 |
| 70 | 10 | 5557 | 5733 | gi\|857631 | envelope protein [Human immunodeficiency virus type 1] | 73 | 60 | 177 |
| 71 | 4 | 6133 | 8262 | gnl\|PID\|e322063 | ss-1,4-galactosyltransferase [*Streptococcus pneumoniae*] | 73 | 45 | 2130 |

TABLE 2-continued

*S. pneumoniae* - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 72 | 1 | 3 | 851 | gi|1183177 | (AF008220) transporter [*Bacillus subtilis*] | 73 | 50 | 849 |
| 76 | 7 | 7019 | 6195 | gnl|PID|d101325 | YqiF [*Bacillus subtilis*] | 73 | 66 | 825 |
| 76 | 12 | 10009 | 9533 | gi|1573086 | uridine kinase (uridine monophosphokinase) (udk) [*Haemophilus influenzae*] | 73 | 54 | 477 |
| 80 | 7 | 8113 | 9372 | gi|1377823 | aminopeptidase [*Bacillus subtilis*] | 73 | 60 | 1260 |
| 97 | 5 | 3389 | 1668 | gnl|PID|d101954 | dihydroxyacid dehydratase [*Synechocytis sp.*] | 73 | 54 | 1722 |
| 98 | 9 | 6912 | 7619 | gnl|PID|e314991 | FtsE [*Mycobacterium tuberculosis*] | 73 | 54 | 708 |
| 108 | 11 | 10928 | 10440 | gi|388109 | regulatory protein [*Enterococcus faecalis*] | 73 | 54 | 489 |
| 128 | 6 | 3632 | 4222 | gi|1685111 | orf1091 [*Streptococcus thermophilus*] | 73 | 63 | 591 |
| 138 | 2 | 1575 | 394 | gi|147326 | transport protein [*Escherichia coli*] | 73 | 60 | 1182 |
| 140 | 13 | 12538 | 11903 | pir|E53402|E534 | serine O-acetyltransferase (EC 2.3.1.30) - *Bacillus stearothermophilus* | 73 | 55 | 636 |
| 162 | 5 | 5701 | 4991 | gnl|PID|e323511 | putative YhaQ protein [*Bacillus subtilis*] | 73 | 50 | 711 |
| 164 | 4 | 2323 | 2790 | gi|1592076 | hypothetical protein (SP:P25768) [*Methanococcus jannaschii*] | 73 | 52 | 468 |
| 164 | 8 | 4815 | 5546 | gi|410137 | ORFX13 [*Bacillus subtilis*] | 73 | 56 | 732 |
| 170 | 5 | 4394 | 5302 | gnl|PID|d100959 | homologue of unidentified protein of *E. coli* [*Bacillus subtilis*] | 73 | 46 | 909 |
| 178 | 7 | 3893 | 4855 | gi|46242 | nodulation protein B, 5'end [*Rhizobium loti*] | 73 | 56 | 963 |
| 204 | 6 | 5096 | 4278 | gnl|PID|e214719 | PlcR protein [*Bacillus thuringiensis*] | 73 | 41 | 819 |
| 213 | 2 | 832 | 2037 | gi|156296 | ribosomal protein S1 homolog; sequence specific DNA-binding protein [*Leuconostoc lactis*] | 73 | 55 | 1206 |
| 231 | 2 | 84 | 287 | gi|40173 | homolog of *E. coli* ribosomal protein L21 [*Bacillus subtilis*] | 73 | 61 | 204 |
| 237 | 1 | 2 | 505 | gi|1773151 | adenine phosphoribosyltransferase [*Escherichia coli*] | 73 | 51 | 504 |
| 269 | 1 | 2 | 691 | gnl|PID|d101328 | YqiX [*Bacillus subtilis*] | 73 | 36 | 690 |
| 289 | 2 | 1272 | 832 | pir|A02771|R7MC | ribosomal protein L/L12 - *Micrococcus luteus* | 73 | 66 | 441 |
| 343 | 1 | 14 | 484 | gi|1788125 | (AE000276) hypothetical 30.4 kD protein in manZ-cpsC intergenic region [*Escherichia coli*] | 73 | 47 | 471 |
| 356 | 1 | 222 | 4 | gi|2149905 | D-glutamic acid adding enzyme [*Enterococcus faecalis*] | 73 | 50 | 219 |
| 7 | 5 | 3165 | 4691 | gnl|PID|d101833 | amidase [*Synechocystis sp.*] | 72 | 52 | 1527 |
| 7 | 9 | 7195 | 7647 | gi|146976 | nusB [*Escherichia coli*] | 72 | 54 | 453 |
| 7 | 17 | 13743 | 13300 | gnl|PID|e289141 | similar to hydroxymyristoyl-(acyl carrier protein) dehydratase [*Bacillus subtilis*] | 72 | 59 | 444 |
| 22 | 19 | 15367 | 16224 | gnl|PID|d101929 | ribosome releasing factor [*Synechocystis sp.*] | 72 | 51 | 588 |
| 33 | 17 | 12111 | 11425 | gnl|PID|d101190 | ORF3 [*Streptococcus mutans*] | 72 | 55 | 687 |
| 34 | 7 | 7147 | 5627 | gi|396501 | aspartyl-tRNA synthetase [*Thermus thermophilus*] | 72 | 52 | 1521 |
| 38 | 23 | 15372 | 16085 | pir|H64108|H641 | L-ribulose-phosphate 4-epimerase (araD) homolog - *Haemophilus influenzae* (strain Rd KW20) | 72 | 54 | 714 |
| 39 | 5 | 5094 | 6905 | gnl|PID|e254877 | unknown [*Mycobacterium tuberculosis*] | 72 | 56 | 1812 |
| 40 | 6 | 4469 | 4636 | gi|153672 | lactose repressor [*Streptococcus mutans*] | 72 | 58 | 168 |
| 48 | 2 | 1459 | 1253 | gi|310380 | inhibin beta-A-subunit [*Ovis aries*] | 72 | 33 | 207 |
| 48 | 29 | 21729 | 22424 | gi|2314329 | (AE000623) glutamine ABC transporter, permease protein (glnP) [*Helicobacter pylori*] | 72 | 49 | 696 |
| 50 | 5 | 4529 | 3288 | gi|1750108 | YnbA [*Bacillus subtilis*] | 72 | 54 | 1242 |
| 51 | 3 | 1044 | 2282 | gi|2293230 | (AF008220) YtbJ [*Bacillus subtilis*] | 72 | 54 | 1239 |
| 52 | 13 | 13681 | 13938 | gi|142521 | deoxyribodipyrimidine photolyase [*Bacillus subtilis*] | 72 | 45 | 258 |
| 55 | 1 | 841 | 35 | gi|882518 | ORF_o304; GTG start [*Escherichia coli*] | 72 | 59 | 807 |
| 75 | 5 | 2832 | 3191 | gnl|PID|e209886 | mercuric resistance operon regulatory protein [*Bacillus subtilis*] | 72 | 44 | 360 |
| 76 | 6 | 6229 | 5771 | gi|142450 | ahrC protein [*Bacillus subtilis*] | 72 | 53 | 459 |
| 79 | 5 | 5065 | 4592 | gi|2293279 | (AF008220) YtcG [*Bacillus subtilis*] | 72 | 46 | 474 |
| 87 | 14 | 14726 | 12309 | gnl|PID|e323502 | putative PriA protein [*Bacillus subtilis*] | 72 | 52 | 2418 |
| 91 | 1 | 444 | 662 | gi|500691 | MY01 gene product [*Saccharomyces cerevisiae*] | 72 | 50 | 219 |
| 91 | 7 | 4516 | 4764 | gi|829615 | skeletal muscle sodium channel alpha-subunit [*Equus caballus*] | 72 | 38 | 249 |
| 95 | 2 | 2004 | 1717 | gnl|PID|e323527 | putative Asp23 protein [*Bacillus subtilis*] | 72 | 40 | 288 |
| 109 | 1 | 1452 | 118 | gi|143331 | alkaline phosphatase regulatory protein [*Bacillus subtilis*] | 72 | 52 | 1335 |
| 126 | 1 | 3 | 2192 | gnl|PID|d101831 | glutamine-binding periplasmic protein [*Synechocystis sp.*] | 72 | 46 | 2190 |
| 130 | 3 | 1735 | 2478 | gi|2415396 | (AF015775) carboxypeptidase [*Bacillus subtilis*] | 72 | 53 | 744 |
| 137 | 6 | 2585 | 2929 | gi|472922 | v-type Na-ATPase [*Enterococcus hirae*] | 72 | 46 | 345 |
| 140 | 10 | 9601 | 9203 | gi|49224 | URF 4 [*Synechococcus sp.*] | 72 | 48 | 399 |
| 146 | 5 | 1906 | 1247 | gnl|PID|e324945 | hypothetical protein [*Bacillus subtilis*] | 72 | 45 | 660 |
| 147 | 2 | 2084 | 1083 | gnl|PID|e325016 | hypothetical protein [*Bacillus subtilis*] | 72 | 56 | 1002 |
| 147 | 5 | 6156 | 5146 | gi|472327 | TPP-dependent acetoin dehydrogenase beta-subunit [*Clostridium magnum*] | 72 | 56 | 1011 |
| 148 | 8 | 5381 | 6433 | gi|974332 | NAD(P)H-dependent dihydroxyacetone-phosphate reductase [*Bacillus subtilis*] | 72 | 54 | 1053 |
| 148 | 14 | 10256 | 9675 | gnl|PID|d101319 | YqgN [*Bacillus subtilis*] | 72 | 50 | 582 |
| 159 | 8 | 4005 | 4949 | gi|1788770 | (AE000330) o463; 24 pct identical (44 gaps) to 338 residues from penicillin-binding protein 4*, PBPE_BACSU SW; P32959 (451 aa) [*Escherichia coli*] | 72 | 43 | 945 |
| 172 | 10 | 9907 | 10620 | gi|763387 | unknown [*Saccharomyces cerevisiae*] | 72 | 55 | 714 |
| 220 | 3 | 2862 | 3602 | gi|1574175 | hypothetical [*Haemophilus influenzae*] | 72 | 50 | 741 |
| 267 | 1 | 3 | 449 | gi|290513 | f470 [*Escherichia coli*] | 72 | 48 | 447 |
| 281 | 2 | 899 | 540 | gnl|PID|d100964 | homologue of aspartokinase 2 alpha and beta subunits LysC of *B. subtilis* [*Bacillus subtilis*] | 72 | 45 | 360 |

TABLE 2-continued

_S. pneumoniae_ - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 290 | 1 | 1018 | 14 | gi\|474195 | This ORF is homologous to a 40.0 kd hypothetical protein in the htrB 3' region from _E. coli_, Accession Number X61000 [Mycoplasma-like organism] | 72 | 54 | 1005 |
| 300 | 1 | 63 | 587 | gi\|746399 | transcription elongation factor [_Escherichia coli_] | 72 | 50 | 525 |
| 316 | 1 | 1326 | 4 | gi\|158127 | protein kinase C [_Drosophila melanogaster_] | 72 | 40 | 1323 |
| 342 | 1 | 227 | 3 | gnl\|PID\|d101164 | unknown [_Bacillus subtilis_] | 72 | 54 | 225 |
| 354 | 1 | 1 | 1005 | gnl\|PID\|d102048 | _C. thermocellum_ beta-glucosidase; P26208 (985) [_Bacillus subtilis_] | 72 | 52 | 1005 |
| 6 | 10 | 8134 | 10467 | gnl\|PID\|e264229 | unknown [_Mycobacterium tuberculosis_] | 71 | 57 | 2334 |
| 7 | 20 | 16231 | 15464 | gi\|18046 | 3-oxoacyl-[acyl-carrier protein] reductase [_Cuphea lanceolata_] | 71 | 52 | 768 |
| 15 | 1 | 1297 | 2 | gnl\|PID\|d100571 | replicative DNA helicase [_Bacillus subtilis_] | 71 | 51 | 1296 |
| 15 | 4 | 4435 | 3869 | gi\|499384 | orf189 [_Bacillus subtilis_] | 71 | 47 | 567 |
| 18 | 6 | 5120 | 4218 | gnl\|PID\|d101318 | YqgG [_Bacillus subtilis_] | 71 | 51 | 903 |
| 29 | 1 | 1 | 540 | gi\|17773142 | similar to the 20.2kd protein in TETB-EXOA region of _B. subtilis_ [_Escherichia coli_] | 71 | 56 | 540 |
| 38 | 20 | 13327 | 13830 | gi\|537036 | ORF_o158 [_Escherichia coli_] | 71 | 48 | 504 |
| 51 | 12 | 15015 | 12676 | gi\|149528 | dipeptidyl peptidase IV [_Lactococcus lactis_] | 71 | 59 | 2340 |
| 55 | 23 | 21040 | 20585 | gi\|2343285 | (AF015453) surface located protein [_Lactobacillus rhamonus_] | 71 | 58 | 456 |
| 60 | 2 | 705 | 265 | gnl\|PID\|d101320 | YqgZ [_Bacillus subtilis_] | 71 | 44 | 441 |
| 71 | 18 | 24679 | 26226 | gi\|580920 | rodD (gtaA) polypeptide (AA 1–673) [_Bacillus subtilis_] | 71 | 44 | 1548 |
| 71 | 25 | 30587 | 30360 | gi\|606028 | ORF_o414; Geneplot suggests frameshift near start but none found [_Escherichia coli_] | 71 | 50 | 228 |
| 72 | 6 | 5239 | 6729 | gi\|580835 | lysine decarboxylase [_Bacillus subtilis_] | 71 | 48 | 1491 |
| 72 | 14 | 11991 | 12878 | gi\|624085 | similar to rat beta-alanine synthetase encoded by GenBank Accession Number S27881; contains ATP/GTP binding motif [_Paramecium bursaria_ Chlorella virus 1] | 71 | 54 | 888 |
| 73 | 11 | 7269 | 7033 | gi\|1906594 | PN1 [_Rattus norvegicus_] | 71 | 42 | 237 |
| 74 | 6 | 10385 | 8517 | gi\|1573733 | prolyl-tRNA synthetase (proS) [_Haemophilus influenzae_] | 71 | 52 | 1869 |
| 81 | 9 | 5772 | 6578 | gi\|147404 | mannose permease subunit II-M-Man [_Escherichia coli_] | 71 | 45 | 807 |
| 86 | 5 | 4602 | 3604 | gnl\|PID\|e322063 | ss-1,4-galactosyltransferase [_Streptococcus pneumoniae_] | 71 | 53 | 999 |
| 105 | 4 | 3619 | 4707 | gi\|2323341 | (AF014460) PepQ [_Streptococcus mutans_] | 71 | 58 | 1089 |
| 106 | 13 | 13557 | 12955 | gi\|1519287 | LemA [_Listeria monocytogenes_] | 71 | 48 | 603 |
| 114 | 2 | 1029 | 1979 | gi\|310303 | mosA [_Rhizobium meliloti_] | 71 | 55 | 951 |
| 122 | 2 | 564 | 1205 | gi\|1649037 | glutamine transport ATP-binding protein GLNQ [_Salmonella typhimurium_] | 71 | 50 | 642 |
| 132 | 5 | 9018 | 7063 | gnl\|PID\|d102049 | _H. influenzae_ hypothetical ABC transporter; P44808 (974) [_Bacillus subtilis_] | 71 | 51 | 1956 |
| 140 | 1 | 1141 | 227 | gi\|1673788 | (AE00015) _Mycoplasma pneumonia_, fructose-bisphosphate aldolase; similar to Swiss-Prot Accession Number P13243, from _B. subtilis_ [_Mycoplasma pneumoniae_] | 71 | 49 | 915 |
| 140 | 5 | 5635 | 4973 | gnl\|PID\|d100964 | homologue of hypothetical protein in a rapamycin synthesis gene cluster of _Streptomyces hygroscopicus_ [_Bacillus subtilis_] | 71 | 48 | 663 |
| 141 | 7 | 7369 | 7845 | gnl\|PID\|d102005 | (AB001488) FUNCTION UNKNOWN, SIMILAR PRODUCT IN _E. COLI_ AND _MYCOPLASMA PNEUMONIAE_. [_Bacillus subtilis_] | 71 | 51 | 477 |
| 193 | 1 | 1 | 165 | gi\|46912 | ribosomal protein L13 [_Staphylococcus carnosus_] | 71 | 59 | 165 |
| 194 | 3 | 2205 | 1594 | gi\|535351 | CodY [_Bacillus subtilis_] | 71 | 52 | 612 |
| 199 | 3 | 1510 | 1319 | gi\|2182574 | (AE000090) Y4pE [Rhizobium sp. NGR234] | 71 | 45 | 192 |
| 208 | 2 | 2616 | 3752 | gi\|1787378 | (AE000213) hypothetical protein in purB 5' region [_Escherichia coli_] | 71 | 57 | 1137 |
| 209 | 2 | 2022 | 1141 | gi\|41432 | fepC gene product [_Escherichia coli_] | 71 | 46 | 882 |
| 210 | 5 | 1911 | 3071 | gi\|49316 | ORF2 gene product [_Bacillus subtilis_] | 71 | 45 | 1161 |
| 210 | 6 | 3069 | 3386 | gi\|580900 | ORF3 gene product [_Bacillus subtilis_] | 71 | 48 | 318 |
| 212 | 2 | 3561 | 1381 | gi\|557567 | ribonucleotide reductase R1 subunit [_Mycobacterium tubercolosis_] | 71 | 53 | 2181 |
| 233 | 3 | 2003 | 2920 | gnl\|PID\|d101320 | YqgR [_Bacillus subtilis_] | 71 | 50 | 918 |
| 244 | 1 | 13 | 1053 | gnl\|PID\|d100964 | homologue of aspartokinase 2 alpha and beta subunits LysC or _B. subtilis_ [_Bacillus subtilis_] | 71 | 55 | 1041 |
| 251 | 2 | 1008 | 1874 | gi\|755601 | unknown [_Bacillus subtilis_] | 71 | 46 | 867 |
| 282 | 2 | 906 | 712 | gi\|1353874 | unknown [_Rhodobacter capsulatus_] | 71 | 46 | 195 |
| 312 | 4 | 2137 | 1565 | gnl\|PID\|d102245 | (AB005554) yxbF [_Bacillus subtilis_] | 71 | 34 | 573 |
| 338 | 1 | 3 | 683 | gi\|1591045 | hypothetical protein (SP:P31466) [_Methanococcus jannaschii_] | 71 | 48 | 681 |
| 346 | 1 | 3 | 164 | gi\|1591234 | hypothetical protein (SP:P42297) [_Methanococcus jannaschii_] | 71 | 36 | 162 |
| 374 | 1 | 619 | 2 | gi\|397526 | clumping factor [_Staphylococcus aureus_] | 71 | 23 | 618 |
| 377 | 1 | 688 | 2 | gi\|397526 | clumping factor [_Staphylococcus aureus_] | 71 | 23 | 687 |
| 3 | 8 | 7419 | 6958 | gnl\|PID\|e269486 | Unknown [_Bacillus subtilis_] | 70 | 42 | 462 |
| 3 | 10 | 8395 | 9075 | gnl\|PID\|e255543 | putative iron dependant repressor [_Staphylococcus epidermidis_] | 70 | 46 | 681 |
| 7 | 14 | 11024 | 10254 | gnl\|PID\|d100290 | undefined open reading frame [_Bacillus stearothermophilus_] | 70 | 55 | 771 |
| 7 | 18 | 14213 | 13719 | gnl\|PID\|d101090 | biotin carboxyl carrier protein of acetyl-CoA carboxylase [Synechocystis sp.] | 70 | 56 | 495 |
| 9 | 2 | 1057 | 287 | gnl\|PID\|d100581 | unknown [_Bacillus subtilis_] | 70 | 52 | 771 |
| 12 | 4 | 2610 | 1789 | gnl\|PID\|d101195 | yycJ [_Bacillus subtilis_] | 70 | 52 | 822 |
| 21 | 2 | 2586 | 1846 | gi\|2293447 | (AF008930) ATPase [_Bacillus subtilis_] | 70 | 54 | 741 |
| 22 | 13 | 10955 | 11512 | gi\|1165295 | Ydr540cp [_Saccharomyces cerevisiae_] | 70 | 50 | 558 |
| 30 | 6 | 4315 | 3980 | gi\|39478 | ATP binding protein of transport ATPase [_Bacillus firmus_] | 70 | 51 | 336 |
| 31 | 1 | 370 | 113 | gi\|662792 | single-stranded DNA binding protein [unidentified eubacterium] | 70 | 36 | 258 |
| 33 | 15 | 10639 | 9521 | gi\|1161219 | homologous to D-amino acid dehydrogenase enzyme [_Pseudomonas aeruginosa_] | 70 | 50 | 1119 |

TABLE 2-continued

_S. pneumoniae_ - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 38 | 6 | 3812 | 4312 | gi\|2058547 | ComYD [_Streptococcus gordonii_] | 70 | 48 | 501 |
| 38 | 25 | 17986 | 18477 | gi\|537033 | ORF_f356 [_Escherichia coli_] | 70 | 58 | 492 |
| 40 | 13 | 11054 | 9846 | gi\|1173516 | riboflavin-specific deaminase [_Actinobacillus pleuropneumoniae_] | 70 | 52 | 1209 |
| 42 | 2 | 722 | 1954 | gi\|1146183 | putative [_Bacillus subtilis_] | 70 | 51 | 1233 |
| 43 | 3 | 2373 | 1612 | gi\|1591493 | glutamine transport ATP-binding protein Q [_Methanococcus jannaschii_] | 70 | 48 | 762 |
| 45 | 8 | 9197 | 8049 | gnl\|PID\|d102036 | subunit of ADP-glucose pyrophosphorylase [_Bacillus stearothermophilus_] | 70 | 54 | 1149 |
| 59 | 2 | 567 | 956 | gnl\|PID\|d100302 | neopullulanase [Bacillus sp.] | 70 | 42 | 390 |
| 60 | 3 | 1874 | 795 | gnl\|PID\|e276466 | aminopeptidase P [_Lactococcus lactis_] | 70 | 48 | 1080 |
| 61 | 4 | 5553 | 2437 | gnl\|PID\|e275074 | SNF [_Bacillus cereus_] | 70 | 51 | 3117 |
| 61 | 7 | 7914 | 6802 | gi\|1573037 | cystathionine gamma-synthase (metB) [_Haemophilus influenzae_] | 70 | 52 | 1113 |
| 63 | 7 | 5372 | 7222 | gnl\|PID\|d100974 | unknown [_Bacillus subtilis_] | 70 | 54 | 1851 |
| 68 | 7 | 7126 | 6962 | gi\|1263014 | emm18.1 gene product [_Streptococcus pyogenes_] | 70 | 37 | 165 |
| 72 | 12 | 10081 | 10911 | gi\|2313093 | (AE000524) carboxynorspermidine decarboxylase (nspC) [_Helicobacter pylori_] | 70 | 56 | 831 |
| 75 | 10 | 7888 | 8124 | gi\|1877423 | galactose-1-P-uridyl transferase [_Streptococcus mutans_] | 70 | 59 | 237 |
| 79 | 3 | 3424 | 2525 | gi\|39881 | ORK 311 (AA 1–311) [_Bacillus subtilis_] | 70 | 47 | 900 |
| 87 | 10 | 9369 | 7324 | gnl\|PID\|e323506 | putative Pkn2 protein [_Bacillus subtilis_] | 70 | 52 | 2046 |
| 96 | 14 | 10640 | 11788 | gi\|1573209 | tRNA-guanine transglycosylase (tgt) [_Haemophilus influenzae_] | 70 | 52 | 1149 |
| 113 | 2 | 574 | 1086 | gi\|433630 | A180 [_Saccharomyces cerevisiae_] | 70 | 59 | 513 |
| 123 | 5 | 2901 | 3461 | gnl\|PID\|d100585 | unknown [_Bacillus subtilis_] | 70 | 45 | 561 |
| 125 | 5 | 4593 | 4282 | gnl\|PID\|e276474 | capacitative calcium entry channel 1 [_Bos taurus_] | 70 | 35 | 312 |
| 129 | 5 | 4500 | 3454 | gnl\|PID\|d101314 | YqeT [_Bacillus subtilis_] | 70 | 47 | 1047 |
| 133 | 3 | 2608 | 1394 | gi\|2293312 | (AF008220) YtfP [_Bacillus subtilis_] | 70 | 50 | 1215 |
| 135 | 1 | 420 | 662 | gnl\|PID\|e265530 | yorfE [_Streptococcus pneumoniae_] | 70 | 47 | 243 |
| 137 | 3 | 438 | 932 | gi\|472919 | v-type Na-ATPase [_Enterococcus hirae_] | 70 | 57 | 495 |
| 138 | 1 | 440 | 1 | gi\|147336 | transmembrane protein [_Escherichia coli_] | 70 | 42 | 438 |
| 140 | 16 | 18796 | 16364 | gi\|976441 | N5-methyltetrahydrofolate homocysteine methyltransferase [_Saccharomyces cerevisiae_] | 70 | 53 | 2433 |
| 167 | 10 | 8263 | 6695 | gi\|149535 | D-alanine activating enzyme [_lactobacillus casei_] | 70 | 52 | 1569 |
| 204 | 4 | 3226 | 2747 | gnl\|PID\|d102049 | E. coli hypothetical protein; P31805 (267) [_Bacillus subtilis_] | 70 | 51 | 480 |
| 207 | 3 | 2627 | 2869 | gnl\|PID\|e309213 | racGAP [_Dictyostelium discoidem_] | 70 | 45 | 243 |
| 282 | 3 | 1136 | 882 | gi\|1353874 | unknown [_Rhodobacter capsulatus_] | 70 | 50 | 255 |
| 6 | 21 | 17554 | 18453 | gnl\|PID\|e233879 | hypothetical protein [_Bacillus subtilis_] | 69 | 44 | 900 |
| 6 | 22 | 18482 | 19474 | gi\|580883 | ipa-88d gene product [_Bacillus subtilis_] | 69 | 53 | 990 |
| 22 | 6 | 4682 | 5824 | gi\|2209379 | (AF006720) ProJ [_Bacillus subtilis_] | 69 | 48 | 1143 |
| 22 | 9 | 7992 | 8651 | gnl\|PID\|d100580 | unknown [_Bacillus subtilis_] | 69 | 51 | 660 |
| 22 | 12 | 9871 | 10767 | gnl\|PID\|d100581 | unknown [_Bacillus subtilis_] | 69 | 51 | 897 |
| 27 | 7 | 5857 | 5348 | gnl\|PID\|d102012 | (AB001488) FUNCTION UNKNOWN. [_Bacillus subtilis_] | 69 | 28 | 510 |
| 36 | 10 | 7294 | 10116 | gi\|437916 | isoleucyl-tRNA synthetase [_Staphylococcus aureus_] | 69 | 53 | 2823 |
| 38 | 1 | 2 | 1090 | gi\|141900 | alcohol dehydrogenase (EC 1.1.1.1) [_Alcaligenes eutrophus_] | 69 | 48 | 1089 |
| 40 | 14 | 11333 | 11944 | gi\|1573280 | Holliday junction DNA helicase (ruvA) [_Haemophilus influenzae_] | 69 | 44 | 612 |
| 40 | 15 | 11942 | 12517 | gi\|1573653 | DNA-3-methyladenine glycosidase I (tagI) [_Haemophilus influenzae_] | 69 | 50 | 576 |
| 45 | 6 | 6947 | 5490 | gi\|580887 | starch (bacterial glycogen) synthase [_Bacillus subtilis_] | 69 | 47 | 1458 |
| 48 | 34 | 24932 | 24153 | gnl\|PID\|e233870 | hypothetical protein [_Bacillus subtilis_] | 69 | 36 | 780 |
| 49 | 6 | 6183 | 6521 | gi\|396297 | similar to phosphotransferase system enzyme II [_Escherichia coli_] | 69 | 50 | 339 |
| 49 | 8 | 7586 | 8338 | gi\|396420 | similar to Alcaligenes eutrophus pHG1 D-ribulose-5-phosphate 3 epimerase [_Escherichia coli_] | 69 | 49 | 753 |
| 55 | 6 | 8262 | 7033 | gi\|1146238 | poly(A) polymerase [_Bacillus subtilis_] | 69 | 50 | 1230 |
| 59 | 3 | 954 | 2333 | gnl\|PID\|e313038 | hypothetical protein [_Bacillus subtilis_] | 69 | 54 | 1380 |
| 62 | 3 | 1170 | 1418 | gnl\|PID\|d101915 | hypothetical protein [Synechocystis sp.] | 69 | 49 | 249 |
| 63 | 8 | 7298 | 7762 | gi\|293017 | ORF3 (put.); putative [_Lactococcus lactis_] | 69 | 42 | 465 |
| 66 | 4 | 3657 | 5081 | gi\|153755 | phospho-beta-D-galactosidase (EC 3.2.1.85) [_Lactococcus lactis cremoris_] | 69 | 49 | 1425 |
| 66 | 5 | 5126 | 6829 | gi\|433809 | enzyme II [_Streptococcus mutans_] | 69 | 46 | 1704 |
| 71 | 6 | 10017 | 10664 | gnl\|PID\|e322063 | ss-1,4-galactosyltransferase [_Streptococcus pneumoniae_] | 69 | 39 | 648 |
| 71 | 21 | 27730 | 27966 | gnl\|PID\|d400649 | DE-cadherin [_Drosophila melanogaster_] | 69 | 30 | 237 |
| 77 | 1 | 1 | 237 | gi\|287870 | groES gene product [_Lactococcus lactis_] | 69 | 44 | 237 |
| 81 | 5 | 3622 | 4101 | gi\|1573605 | fucose operon protein (fucU) [_Haemophilus influenzae_] | 69 | 52 | 480 |
| 83 | 1 | 40 | 714 | pir\|C33496\|C334 | hisC homolog - Bacillus subtilis | 69 | 46 | 675 |
| 83 | 16 | 15742 | 16335 | gi\|143372 | phosphoribosyl glycinamide formyltransferase (PUR-N) [_Bacillus subtilis_] | 69 | 46 | 594 |
| 85 | 2 | 1212 | 916 | gi\|194097 | IFN-response element binding factor 1 [_Mus musculus_] | 69 | 48 | 297 |
| 91 | 5 | 3678 | 4274 | gi\|1574712 | anaerobic ribonucleoside-triphosphate reductase activating protein (nrdG) [_Haemophilus influenzae_] | 69 | 44 | 597 |
| 98 | 5 | 3247 | 4032 | gnl\|PID\|d100262 | LivF protein [_Salmonella typhimurium_] | 69 | 51 | 786 |
| 108 | 5 | 4085 | 5056 | gnl\|PID\|e257629 | transcription factor [_Lactococcus lactis_] | 69 | 49 | 972 |
| 126 | 3 | 3078 | 4568 | gnl\|PID\|d101329 | YqjJ [_Bacillus subtilis_] | 69 | 49 | 1491 |
| 131 | 6 | 4121 | 2889 | gnl\|PID\|d101314 | YqeR [_Bacillus subtilis_] | 69 | 47 | 1233 |
| 136 | 2 | 1505 | 2299 | gnl\|PID\|d100581 | unknown [_Bacillus subtilis_] | 69 | 47 | 795 |
| 149 | 5 | 3852 | 4763 | gnl\|PID\|e323525 | YloQ protein [_Bacillus subtilis_] | 69 | 50 | 912 |
| 149 | 12 | 9336 | 10655 | gi\|151571 | Homology with E. coli and P. aeruginosa lysA gene; product of unknown function; putative [_Pseudomonas syringae_] | 69 | 52 | 1320 |

TABLE 2-continued

S. pneumoniae - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 153 | 4 | 3191 | 3829 | gi\|1710373 | BrnQ [*Bacillus subtilis*] | 69 | 44 | 639 |
| 169 | 3 | 849 | 2324 | gnl\|PID\|d100582 | temperature sensitive cell division [*Bacillus subtilis*] | 69 | 49 | 1476 |
| 180 | 1 | 566 | 3 | gi\|488339 | alpha-amylase [unidentified cloning vector] | 69 | 50 | 564 |
| 212 | 1 | 1196 | 231 | gi\|1395209 | ribonucleotide reductase R2-2 small subunit [*Mycobacterium tuberculosis*] | 69 | 53 | 966 |
| 226 | 1 | 2 | 661 | pir\|JQ2285\|JQ22 | nodulin-26 - soybean | 69 | 41 | 660 |
| 233 | 5 | 3249 | 4766 | gi\|472918 | v-type Na-ATPase [*Enterococcus hirae*] | 69 | 56 | 1518 |
| 235 | 3 | 660 | 1766 | gi\|148945 | methylase [*Haemophilus influenzae*] | 69 | 43 | 1107 |
| 243 | 2 | 865 | 2361 | gnl\|PID\|d100225 | ORF5 [Barley yellow dwarf virus] | 69 | 69 | 1497 |
| 251 | 3 | 2899 | 1967 | gi\|2289231 | macrolide-efflux protein [*Streptococcus agalactiae*] | 69 | 51 | 933 |
| 310 | 1 | 1 | 282 | gnl\|PID\|e322442 | peptide deformylase [*Clostridium beijerinckii*] | 69 | 55 | 282 |
| 369 | 1 | 868 | 2 | gi\|397526 | clumping factor [*Staphylococcus aureus*] | 69 | 55 | 282 |
| 370 | 1 | 749 | 3 | gi\|397526 | clumping factor [*Staphylococcus aureus*] | 69 | 21 | 747 |
| 379 | 1 | 44 | 280 | gnl\|PID\|d100649 | DE-cadherin [*Drosophila melanogaster*] | 69 | 30 | 237 |
| 388 | 1 | 260 | 72 | gi\|1787524 | (AE000225) hypothetical 32.7 kD protein in trpL-btuR intergenic region [*Escherichia coli*] | 69 | 44 | 189 |
| 1 | 2 | 2006 | 3040 | gnl\|PID\|d101809 | ABC transporter [*Synechocystis sp.*] | 68 | 43 | 1035 |
| 12 | 5 | 3958 | 2600 | gi\|2182992 | histidine kinase [*Lactococcus lactis cremoris*] | 68 | 45 | 1359 |
| 15 | 2 | 1790 | 1311 | pir\|S16974\|R5BS | ribosomal protein L9 - *Bacillus stearothermophilus* | 68 | 56 | 480 |
| 16 | 6 | 7353 | 5701 | gi\|1787041 | (AE000184) o530; This 530 aa orf is 33 pct identical (14 gaps) to 525 residues of an approx. 640 aa protein YHES_HAEIN SW; P44808 [*Escherichia coli*] | 68 | 45 | 1653 |
| 17 | 12 | 6479 | 6805 | gi\|553165 | acetylcholinesterase [*Homo sapiens*] | 68 | 68 | 327 |
| 20 | 13 | 14128 | 14505 | gi\|142700 | P competence protein (ttg start codon) (put.); putative [*Bacillus subtilis*] | 68 | 40 | 378 |
| 22 | 32 | 24612 | 25397 | gi\|289262 | comE ORF3 [*Bacillus subtilis*] | 68 | 36 | 786 |
| 30 | 7 | 4548 | 4288 | gi\|311388 | ORF1 [*Azorhizobium caulinodans*] | 68 | 46 | 261 |
| 36 | 5 | 3911 | 4585 | gi\|1573041 | hypothetical [*Haemophilus influenzae*] | 68 | 54 | 675 |
| 46 | 6 | 5219 | 6040 | gi\|1790131 | (AE000446) hypothetical 29.7 kD protein in ibpA-gyrB intergenic region [*Escherichia coli*] | 68 | 47 | 822 |
| 54 | 10 | 6235 | 7086 | gi\|882579 | CF Site No. 29739 [*Escherichia coli*] | 68 | 55 | 852 |
| 55 | 5 | 7069 | 5165 | gnl\|PID\|d101914 | ABC transporter [*Synechocystis sp.*] | 68 | 45 | 1905 |
| 71 | 3 | 6134 | 5613 | gi\|1573353 | outer membrane integrity protein (tolA) [*Haemophilus influenzae*] | 68 | 50 | 522 |
| 71 | 10 | 15342 | 16613 | gi\|580866 | ipa-12d gene product [*Bacillus subtilis*] | 68 | 31 | 1272 |
| 71 | 12 | 17560 | 18792 | gi\|44073 | SecY protein [*Lactococcus lactis*] | 68 | 35 | 1233 |
| 71 | 17 | 22295 | 24703 | gi\|1762349 | involved in protein export [*Bacillus subtilis*] | 68 | 50 | 2409 |
| 73 | 16 | 10208 | 9729 | gi\|1353537 | dUTPase [Bacteriophage rit] | 68 | 51 | 480 |
| 86 | 18 | 17198 | 16011 | gi\|413943 | ipa-19d gene product [*Bacillus subtilis*] | 68 | 53 | 1188 |
| 87 | 17 | 17491 | 15866 | gi\|150209 | ORF 1 [*Mycoplasma mycoides*] | 68 | 43 | 1626 |
| 89 | 6 | 5139 | 1454 | gi\|1498824 | *M. jannaschii* predicted coding region MJ0062 [*Methanococcus jannaschii*] | 68 | 40 | 786 |
| 89 | 11 | 8021 | 8242 | gi\|150974 | 4-oxalocrotonate tautomerase [*Pseudomonas putida*] | 68 | 43 | 222 |
| 97 | 8 | 6755 | 5394 | gi\|2367358 | (AE000491) hypothetical 52.9 kD protein in aidB-rspF intergenic region [*Escherichia coli*] | 68 | 41 | 1362 |
| 98 | 3 | 1418 | 2308 | gni\|PID\|d100261 | LivA protein [*Salmonella typhimurium*] | 68 | 40 | 891 |
| 99 | 13 | 16414 | 17280 | gi\|455363 | regulatory protein [*Streptococcus mutans*] | 68 | 50 | 867 |
| 115 | 3 | 5054 | 3693 | gi\|466474 | cellobiose phosphotransferase enzyme II" [*Bacillus stearothermophilus*] | 68 | 44 | 1362 |
| 124 | 7 | 3394 | 3221 | gnl\|PID\|d100702 | cut14 protein [*Schizosaccharomyces pombe*] | 68 | 56 | 174 |
| 125 | 2 | 2923 | 1922 | gi\|450566 | transmembrane protein [*Bacillus subtilis*] | 68 | 50 | 1002 |
| 132 | 2 | 4858 | 2888 | gnl\|PID\|d101732 | DNA ligase [*Synechocystis sp.*] | 68 | 52 | 1971 |
| 140 | 7 | 7765 | 7580 | gi\|1209711 | unknown [*Saccharomyces cerevisiae*] | 68 | 47 | 186 |
| 150 | 1 | 539 | 3 | gi\|402490 | ADP-ribosylarginine hydrolase [*Mus musculus*] | 68 | 59 | 537 |
| 164 | 1 | 58 | 867 | gnl\|PID\|e255114 | glutamate racemase [*Bacillus subtilis*] | 68 | 49 | 810 |
| 164 | 2 | 819 | 1835 | gnl\|PID\|e255117 | hypothetical protein [*Bacillus subtilis*] | 68 | 50 | 1017 |
| 169 | 7 | 3946 | 4104 | pir\|B54545\|B545 | hypothetical protein - *Lactococcus lactis* subsp. lactis plasmid pSL2 | 68 | 40 | 159 |
| 170 | 4 | 4247 | 4396 | gi\|304146 | spore coat protein [*Bacillus subtilis*] | 68 | 52 | 150 |
| 171 | 8 | 6002 | 7054 | gi\|38722 | precursor (aa -20 to 381) [*Acinetobacter calcoaceticus*] | 68 | 54 | 1053 |
| 198 | 3 | 2473 | 1871 | gnl\|PID\|d313075 | hypothetical [*Bacillus subtilis*] | 68 | 46 | 603 |
| 211 | 2 | 969 | 1802 | gi\|1439528 | EIIC-man [*Lactobacillus curvatus*] | 68 | 45 | 834 |
| 214 | 8 | 4926 | 4231 | gnl\|PID\|d102049 | *H. influenzae* hypothetical protein, P43990 (182) [*Bacillus subtilis*] | 68 | 50 | 696 |
| 217 | 6 | 4955 | 5170 | gnl\|PID\|e326966 | similar to *B. vulgaris* CMS-associated mitochondrial . . . (reverse transcriptase) [*Arabidopsis thaliana*] | 68 | 36 | 216 |
| 218 | 7 | 3930 | 4745 | go\|2293198 | (AF008220) YtgP [*Bacillus subtilis*] | 68 | 38 | 816 |
| 220 | 6 | 4628 | 4338 | gnl\|PID\|e325791 | (AJ000005) orf1 [*Bacillus magaterium*] | 68 | 51 | 291 |
| 236 | 1 | 746 | 108 | gi\|410137 | ORFX13 [*Bacillus subtilis*] | 68 | 46 | 639 |
| 237 | 2 | 675 | 1451 | gi\|396348 | homoserine transsuccinylase [*Escherichia coli*] | 68 | 49 | 777 |
| 250 | 4 | 771 | 1229 | gi\|310859 | ORF2 [*Synechococcus sp.*] | 68 | 50 | 459 |
| 254 | 1 | 517 | 155 | gi\|1787105 | (AE000189) o648 was o669; This 669 aa orf is 40 pct identical (1 gaps) to 217 residues of an approx. 232 as protein YBBA_HAEIN SW; P45247 [*Escherichia coli*] | 68 | 44 | 363 |
| 337 | 1 | 1 | 774 | gnl\|PID\|e261990 | putative orf [*Bacillus subtilis*] | 68 | 47 | 774 |
| 345 | 1 | 3 | 653 | gi\|149513 | thymidylate sythase (EX 2.1.1.45) [*Lactococcus lactis*] | 68 | 61 | 651 |

TABLE 2-continued

_S. pneumoniae_ - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 386 | 2 | 417 | 4 | gi\|1573353 | outer membrane integrity protein (tolA) [_Haemophilus influenzae_] | 68 | 51 | 414 |
| 2 | 4 | 5722 | 4697 | gi\|1592141 | _M. jannaschii_ predicted coding region MJ1507 [_Methanococcus jannaschii_] | 67 | 26 | 1026 |
| 3 | 6 | 5397 | 4591 | gi\|2293175 | (AF008220) signal transduction regulator [_Bacillus subtilis_] | 67 | 44 | 807 |
| 5 | 2 | 2301 | 574 | gi*2313385 | (AE000547) para-aminobenzoate synthetase (pabB) [_Helicobacter pylori_] | 67 | 48 | 1728 |
| 6 | 19 | 16063 | 16758 | gi\|413931 | ipa-7d gene product [_Bacillus subtilis_] | 67 | 41 | 696 |
| 22 | 8 | 7094 | 7897 | gi\|1928962 | pyrroline-5-carboxylate reductase [_Actinidia deliciosa_] | 67 | 51 | 804 |
| 29 | 10 | 8335 | 9072 | go\|468745 | gtcR gene product [_Bacillus brevis_] | 67 | 41 | 738 |
| 31 | 3 | 1379 | 585 | gi\|2425123 | (AF019986) PksB [_Dictyostelium discoideum_] | 67 | 49 | 795 |
| 32 | 11 | 8849 | 10150 | gi\|42029 | ORF1 gene product [_Escherichia coli_] | 67 | 47 | 1302 |
| 36 | 16 | 14830 | 15546 | gi\|1592142 | ABC transporter, probable ATP-binding subunit [_Methanococcus jannaschii_] | 67 | 43 | 717 |
| 38 | 9 | 4958 | 5392 | gnl\|PID\|e214803 | T2283.3 [_Caenorhabditis elegans_] | 67 | 47 | 435 |
| 38 | 21 | 13775 | 14512 | gi\|537037 | ORF_o216 [_Escherichia coli_] | 67 | 52 | 738 |
| 45 | 9 | 10428 | 9181 | gi\|551710 | branching enzyme (glgB) (EC 2.4.1.18) [_Bacillus stearothermophilus_] | 67 | 51 | 1248 |
| 48 | 23 | 18334 | 17514 | gi\|413949 | ipa-25d gene product [_Bacillus subtilis_] | 67 | 50 | 831 |
| 50 | 2 | 1773 | 952 | gnl\|PID\|d101330 | YqjQ [_Bacillus subtilis_] | 67 | 55 | 822 |
| 53 | 1 | 431 | 3 | gi\|1574291 | fimbrial transcription regulation repressor (pilB) [_Haemophilus influenzae_] | 67 | 40 | 429 |
| 55 | 13 | 12740 | 11946 | gnl\|PID\|e252990 | ORF YDL037c [_Saccharomyces cerevisiae_] | 67 | 51 | 795 |
| 61 | 9 | 9210 | 8329 | gnl\|PID\|e264711 | ATP-binding cassette transporter A [_Staphylococcus aureus_] | 67 | 50 | 882 |
| 71 | 2 | 5614 | 6117 | gi\|1197667 | vitellogenin [_Anolis pulchellus_] | 67 | 36 | 504 |
| 81 | 7 | 4489 | 4983 | gi\|1142714 | phosphoenolpyruvate:mannose phosphotransferase element IIB [_Lactobacillus curvatus_] | 67 | 42 | 495 |
| 83 | 7 | 2957 | 3214 | gi\|1276746 | Acyl carrier protein [_Porphyra purpurea_] | 67 | 37 | 258 |
| 86 | 8 | 8140 | 6809 | gi\|1147744 | PSR [_Enterococcus hirae_] | 67 | 45 | 1332 |
| 97 | 3 | 986 | 1366 | gnl\|PID\|d102235 | (AB000631) unnamed protein product [_Streptococcus mutans_] | 67 | 43 | 381 |
| 102 | 1 | 601 | 1413 | gi\|682765 | mccB gene product [_Escherichia coli_] | 67 | 36 | 813 |
| 106 | 3 | 1109 | 1987 | gi\|148921 | LicD protein [_Haemophilus influenzae_] | 67 | 43 | 879 |
| 115 | 4 | 5982 | 5656 | gi\|8955750 | putative cellobiose phosphotransferase enzyme III [_Bacillus subtilis_] | 67 | 44 | 327 |
| 115 | 7 | 8421 | 8077 | gi\|466473 | cellobiose phosphotransferase enzyme II' [_Bacillus stearothermophilus_] | 67 | 51 | 345 |
| 127 | 13 | 8127 | 7021 | gi\|147326 | transport protein [_Escherichia coli_] | 67 | 45 | 1107 |
| 136 | 3 | 2215 | 2859 | gnl\|PID\|d100581 | unknown [_Bacillus subtilis_] | 67 | 49 | 645 |
| 140 | 21 | 23317 | 20906 | gnl\|PID\|d101912 | phenylalanyl-tRNA synthetase [Synechocystis sp.] | 67 | 43 | 2412 |
| 146 | 6 | 2894 | 1893 | gi\|2182994 | histidine kinase [_Lactococcus lactis cremoris_] | 67 | 44 | 1002 |
| 151 | 8 | 11476 | 11117 | gnl\|PID\|d100085 | ORF129 [_Bacillus cereus_] | 67 | 48 | 360 |
| 160 | 10 | 7453 | 8646 | gi\|2281317 | OrfB; similar to a _Streptococcus pneumoniae_ putative membrane protein encoded by GenBank Accession Number X99400; inactivation of the OrfB gene leads to UV-sensitivity and to decrease of homologous recombination (plasmidic test) [Lactococcus 1 | 67 | 46 | 1194 |
| 163 | 3 | 3099 | 4505 | gnl\|PID\|d101317 | YqfR [_Bacillus subtilis_] | 67 | 47 | 1407 |
| 167 | 8 | 6704 | 5454 | gi\|1161933 | DibB [_Lactobacillus casei_] | 67 | 45 | 1251 |
| 169 | 4 | 2322 | 2879 | gnl\|PID\|d101331 | YqkG [_Bacillus subtilis_] | 67 | 41 | 558 |
| 171 | 11 | 7656 | 8384 | gi\|153841 | pneumococcal surface protein A [_Streptococcus pneumoniae_] | 67 | 50 | 729 |
| 188 | 3 | 1930 | 3723 | gi\|1542975 | AbcB [_Thermoanaerobacterium thermosulfurigenes_] | 67 | 46 | 1794 |
| 189 | 6 | 3599 | 3141 | gnl\|PID\|e325178 | Hypothetical protein [_Bacillus subtilis_] | 67 | 52 | 459 |
| 205 | 3 | 1663 | 2211 | gi\|606073 | ORF_o169 [_Escherichia coli_] | 67 | 47 | 549 |
| 207 | 4 | 2896 | 3456 | gi\|2276374 | DtxR/iron regulated lipoprotein precursor [_Corynebacterium diphtheriae_] | 67 | 49 | 561 |
| 217 | 3 | 4086 | 3703 | gi\|895750 | putative cellobiose phosphotransferase enzyme III [_Bacillus subtilis_] | 67 | 42 | 384 |
| 246 | 2 | 291 | 662 | gi\|1842438 | unknown [_Bacillus subtilis_] | 67 | 43 | 372 |
| 252 | 1 | 2 | 745 | gi\|2341768 | PspA [_Streptococcus pneumoniae_] | 67 | 41 | 744 |
| 265 | 3 | 1134 | 1811 | gi\|2313847 | (AE000585) L-asparaginase II (ansB) [_Helicobacter pylori_] | 67 | 42 | 678 |
| 295 | 1 | 1 | 375 | gi\|2276374 | DtxR/iron regulated lipoprotein precursor [_Corynebacterium diphtheriae_] | 67 | 43 | 375 |
| 1 | 7 | 4898 | 5146 | gnl\|PID\|e255179 | unknown [_Mycobacterium tuberculosis_] | 66 | 56 | 249 |
| 3 | 1 | 389 | 3 | gnl\|PID\|e269548 | Unknown [_Bacillus subtilis_] | 66 | 48 | 387 |
| 3 | 20 | 19267 | 20805 | gi\|39956 | IIGlc [_Bacillus subtilis_] | 68 | 50 | 1539 |
| 4 | 3 | 2545 | 2718 | gi\|1787564 | (AE000228) phage shock protein C [_Escherichia coli_] | 66 | 36 | 174 |
| 5 | 9 | 13197 | 12592 | gi\|1574291 | fimbrial transcription regulation repressor (pilB) [_Haemophilus influenzae_] | 66 | 46 | 606 |
| 9 | 4 | 2872 | 1451 | gnl\|PID\|e266928 | unknown [_Mycobacterium tuberculosis_] | 66 | 43 | 1422 |
| 12 | 2 | 1469 | 1200 | gi\|520407 | orf2; GTG start codon [_Bacillus thuringiensis_] | 66 | 42 | 270 |
| 15 | 12 | 10979 | 9897 | gi\|2314738 | (AE0000653) translation elongation factor EF-Ts (tsf) [_Helicobacter pylori_] | 66 | 49 | 1083 |
| 16 | 2 | 1312 | 734 | gnl\|PID\|d102245 | (AB005554) yxbF [_Bacillus subtilis_] | 66 | 35 | 579 |
| 22 | 3 | 1372 | 1851 | gi\|1480916 | signal peptidase type II [_Lactococcus lactis_] | 66 | 38 | 480 |
| 22 | 7 | 5828 | 7096 | gnl\|PID\|e206261 | gamma-glutamyl phosphate reductase [_Streptococcus thermophilus_] | 66 | 51 | 1269 |
| 22 | 20 | 16194 | 17138 | gnl\|PID\|e281914 | YitL [_Bacillus subtilis_] | 66 | 50 | 945 |
| 30 | 2 | 530 | 976 | gi\|2314379 | (AE000627) ABC transporter, ATP-binding protein (yhcG) [_Helicobacter pylori_] | 66 | 40 | 447 |
| 32 | 1 | 199 | 984 | gi\|312444 | ORF2 [_Bacillus caldolyticus_] | 66 | 49 | 786 |

TABLE 2-continued

S. pneumoniae - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 33 | 13 | 8352 | 7234 | gi\|1387979 | 44% identity over 302 residues with hypothetical protein from Synechocystis sp, accession D64006_CD; expression induced by environmental stress; some similarity to glycosyl transferases; two potential membrane-spanning helices [Bacillus subtil | 66 | 44 | 1119 |
| 34 | 6 | 5658 | 4708 | gnl\|PID\|e250724 | orf2 [Lactobacillus sake] | 66 | 39 | 951 |
| 34 | 14 | 9792 | 9574 | gi\|1590997 | M jannaschii predicted coding region MJ0272 [Methanococcus jannaschii] | 66 | 48 | 219 |
| 35 | 16 | 15163 | 14501 | gi\|1773352 | Cap5M [Staphylococcus aureus] | 66 | 46 | 663 |
| 36 | 9 | 6173 | 6976 | gi\|1518680 | minicell-associated protein DivIVA [Bacillus subtilis] | 66 | 35 | 804 |
| 36 | 11 | 10396 | 10824 | bbs\|155344 | insulin activator factor, INSAF [human, Pancreatic insulinoma, Peptide Partial, 744 aa] [Homo sapiens] | 66 | 43 | 429 |
| 48 | 1 | 28 | 1419 | gnl\|PID\|e325204 | hypothetical protein [Bacillus subtilis] | 66 | 50 | 1392 |
| 48 | 7 | 3810 | 4112 | gi\|2182574 | (AE000090) Y4pE [Rhizobium sp. NGR234] | 66 | 40 | 303 |
| 52 | 4 | 3595 | 2789 | gi\|388565 | major cell-binding factor [Campylobacter jejuni] | 66 | 52 | 807 |
| 54 | 3 | 2662 | 1076 | gnl\|PID\|d101831 | glutamine-binding periplasmic protein [Synechocystis sp.] | 66 | 43 | 1587 |
| 61 | 10 | 9740 | 9183 | gnl\|PID\|e154144 | mdr gene product [Staphylococcus aureus] | 66 | 44 | 558 |
| 72 | 13 | 10893 | 11993 | gi\|2313129 | (AE000526) H. pylori predicted coding region HP0049 [Helicobacter pylori] | 66 | 44 | 1101 |
| 74 | 9 | 13267 | 12476 | gi\|1573941 | hypothetical [Haemophilus influenzae] | 66 | 43 | 792 |
| 75 | 1 | 2 | 868 | gi\|1574631 | nicotinamide mononucleotide transporter (pnuC) [Haemophilus influenzae] | 66 | 48 | 867 |
| 75 | 7 | 5303 | 4275 | gi\|41312 | put. EBG repressor protein [Escherichia coli] | 66 | 40 | 1029 |
| 82 | 7 | 6813 | 8123 | gnl\|PID\|e255128 | trigger factor [Bacillus subtilis] | 66 | 53 | 1311 |
| 83 | 3 | 905 | 1219 | pir\|C33496\|C334 | hisC homolog - Bacillus subtilis | 66 | 44 | 315 |
| 86 | 10 | 9407 | 8925 | gi\|683584 | shikimate kinase [Lactococcus lactis] | 66 | 41 | 483 |
| 88 | 10 | 7001 | 6060 | gi\|2098719 | putative fimbrial-associated protein [Actinomyces naeslundii] | 66 | 52 | 942 |
| 89 | 1 | 951 | 4 | gi\|410118 | ORFX19 [Bacillus subtilis] | 66 | 41 | 948 |
| 93 | 7 | 3661 | 2711 | gi\|1787936 | (Ae000260) f298; This 298 as orf is 51 pct identical (5 gaps) to 297 residue of an approx. 304 as protein YCSN_BACSU SW; P42972 [Escherichia coli] | 66 | 49 | 951 |
| 104 | 3 | 1805 | 3049 | gi\|1469784 | putative cell division protein ftsW [Enterococcus hirae] | 66 | 48 | 1245 |
| 106 | 14 | 13576 | 14253 | gi\|40027 | homologous to E. coli gidB [Bacillus subtilis] | 66 | 52 | 678 |
| 107 | 3 | 965 | 1864 | gi\|144858 | ORF A [Clostridium perfringens] | 66 | 49 | 900 |
| 112 | 7 | 5718 | 6593 | gi\|609332 | DprA [Haemophilus influenzae] | 66 | 43 | 876 |
| 115 | 1 | 3 | 302 | gi\|727367 | Hyrlp [Saccharomyces cerevisiae] | 66 | 56 | 300 |
| 122 | 1 | 3 | 566 | gnl\|PID\|d101328 | YqiY [Bacillus subtilis] | 66 | 36 | 564 |
| 126 | 8 | 11759 | 11046 | gnl\|PID\|d101163 | ORF3 [Bacillus subtilis] | 66 | 48 | 714 |
| 128 | 11 | 8201 | 8431 | gi\|726288 | growth associated protein GAP-43 [Xenopus laevis] | 66 | 41 | 231 |
| 131 | 8 | 4894 | 4508 | gi\|486661 | TMnm related protein [Saccharomyces cerevisiae] | 66 | 39 | 387 |
| 140 | 3 | 3236 | 2574 | gi\|40056 | phoP gene product [Bacillus subtilis] | 66 | 36 | 663 |
| 140 | 15 | 16318 | 15434 | gi\|1658189 | 5,10-methylenetetrahydrofolate reductase [Erwinia carotovara] | 66 | 48 | 885 |
| 146 | 12 | 7926 | 7636 | gnl\|PID\|d101140 | transposase [Synechocystis sp.] | 66 | 42 | 291 |
| 147 | 6 | 7137 | 6154 | gi\|472326 | TPP-dependent acetoin dehydrogenase alpha-subunit [Clostridium magnum] | 66 | 48 | 984 |
| 149 | 6 | 4435 | 5430 | gnl\|PID\|d101887 | pentose-5-phosphate-3-epimerase [Synechocystis sp.] | 66 | 46 | 996 |
| 149 | 13 | 10754 | 11575 | gi\|42371 | pyruvate formate-lyase activating enzyme (AA 1–246) [Escherichia coli] | 66 | 42 | 822 |
| 186 | 4 | 2578 | 2270 | gnl\|PID\|d101199 | ORF11 [Enterococcus faecalis] | 66 | 4 | 309 |
| 207 | 2 | 2340 | 2597 | gnl\|PID\|e321893 | envelope glycoprotein gp160 [Human immunodeficiency virus type 1] | 66 | 46 | 258 |
| 210 | 7 | 3358 | 3678 | gi\|49318 | ORF4 gene product [Bacillus subtilis] | 66 | 46 | 321 |
| 217 | 8 | 5143 | 5355 | gi\|49538 | thrombin receptor [Cricetulus longicaudatus] | 66 | 38 | 213 |
| 220 | 4 | 3875 | 3642 | gi\|466648 | alternate name ORFD of L23635 [Escherichia coli] | 66 | 33 | 234 |
| 223 | 1 | 1070 | 138 | gnl\|PID\|e247187 | zinc finger protein [Bacteriophage phigle] | 66 | 45 | 933 |
| 224 | 2 | 1864 | 2640 | gi\|1176399 | putative ABC transporter subunit [Staphylococcus epidermidis] | 66 | 41 | 777 |
| 243 | 1 | 3 | 872 | dbj\|AB000617_2 | (AB000617) YcdH [Bacillus subtilis] | 66 | 45 | 870 |
| 268 | 2 | 891 | 568 | gi\|517210 | putative transposase [Streptococcus pyogenes] | 66 | 60 | 324 |
| 322 | 1 | 2 | 643 | gi\|1499836 | Zn protease [Methanococcus jannaschii] | 66 | 40 | 642 |
| 5 | 10 | 13909 | 13178 | gi\|1574292 | hypothetical [Haemophilus influenzae] | 65 | 34 | 732 |
| 6 | 11 | 10465 | 11190 | gi\|142854 | homologous to E. coli radC gene product and to unidentified protein from Staphylococcus aureus [Bacillus subtilis] | 65 | 48 | 726 |
| 7 | 2 | 647 | 405 | pir\|C64146\|C641 | hypothetical protein HI0259 - Haemophilus influenzae (strain RD KW20) | 65 | 42 | 243 |
| 7 | 7 | 6246 | 6821 | gni\|PID\|d101323 | YqhU [Bacillus subtilis] | 65 | 50 | 576 |
| 10 | 2 | 1873 | 1397 | gi\|1163111 | ORF-1 [Streptococcus pneumoniae] | 65 | 54 | 477 |
| 16 | 3 | 1428 | 2222 | gnl\|PID\|e325010 | hypothetical protein [Bacillus subtilis] | 65 | 45 | 795 |
| 21 | 4 | 3815 | 3357 | gnl\|PID\|e314910 | hypothetical protein [Staphylococcus sciuri] | 65 | 40 | 459 |
| 22 | 34 | 25776 | 26384 | gi\|1123030 | CpxA [Actinobacillus pleuropneumoniae] | 65 | 42 | 609 |
| 43 | 2 | 1648 | 290 | gi\|1044826 | F14E5.1 [Caenorhabditis elegans] | 65 | 38 | 1359 |
| 48 | 13 | 10062 | 10856 | gi\|1573390 | hypothetical [Haemophilus influenzae] | 65 | 45 | 795 |
| 48 | 22 | 17521 | 16883 | gi\|1573391 | hypothetical [Haemophilus influenzae] | 65 | 37 | 639 |
| 48 | 25 | 19027 | 18533 | gnl\|PID\|e264484 | YCR020c, len:215 [Saccharomyces cerevisiae] | 65 | 38 | 495 |
| 49 | 3 | 3856 | 5334 | gi\|1480429 | putative transcriptional regulator [Bacillus stearothermophilus] | 65 | 32 | 1479 |
| 50 | 6 | 5337 | 4519 | gi\|171963 | tRNA isopentenyl transferase [Saccharomyces cerevisiae] | 65 | 42 | 819 |

TABLE 2-continued

_S. pneumoniae_ - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 52 | 15 | 14728 | 15588 | gi\|1499745 | M. jannaschii predicted coding region MJ0912 [Methanococcus jannaschii] | 65 | 46 | 861 |
| 59 | 7 | 3963 | 4745 | gi\|496514 | orf zeta [Streptococcus pyogenes] | 54 | 42 | 783 |
| 68 | 3 | 2500 | 3483 | gi\|887824 | ORF_o310 [Escherichia coli] | 65 | 46 | 984 |
| 69 | 3 | 2171 | 1077 | gnl\|PID\|e311453 | unknown [Bacillus subtilis] | 65 | 42 | 1095 |
| 69 | 7 | 6029 | 5325 | gi\|809660 | deoxyribose-phosphate aldolase [Bacillus subtilis] | 65 | 55 | 705 |
| 71 | 5 | 8536 | 9783 | gi\|1573224 | glycosyl transferase lgtC (GP:U14554_4) [Haemophilus influenzae] | 65 | 42 | 1248 |
| 72 | 8 | 7664 | 8527 | gnl\|PID\|e267589 | Unknown, highly similar to several spermidine synthases [Bacillus subtilis] | 65 | 39 | 864 |
| 76 | 5 | 5773 | 4097 | gnl\|PID\|d101723 | DNA REPAIR PROTEIN RECN (RECOMBINATION PROTEIN N). [Escherichia coli] | 65 | 44 | 1677 |
| 76 | 9 | 8099 | 7875 | gi\|1574276 | exodeoxyribonuclease, small subunit (xseB) [Haemophilus influenzae] | 65 | 38 | 225 |
| 84 | 2 | 2870 | 2352 | gi\|2313188 | (AE000532) conserved hypothetical protein [Helicobacter pylori] | 65 | 41 | 519 |
| 86 | 15 | 14495 | 13407 | gnl\|PID\|d101880 | 3-dehydroquinate synthase [Synechocystis sp.] | 65 | 44 | 1089 |
| 87 | 3 | 3706 | 2423 | gi\|151259 | HMG-CoA reductase (EC 1.1.1.88) [Pseudomonas mevalonii] | 65 | 51 | 1284 |
| 88 | 3 | 2425 | 2736 | gi\|1098510 | unknown [Lactococcus lactis] | 65 | 30 | 213 |
| 89 | 2 | 1627 | 1007 | gnl\|PID\|d102008 | (AB001488) SIMILAR TO ORF14 OF ENTEROCOCCUS FAECALIS TRANSPOSON TN916. [Bacillus subtilis] | 65 | 41 | 621 |
| 111 | 6 | 6635 | 6186 | gnl\|PID\|e246063 | NM23/nucleoside diphosphate kinase [Xenopus laevis] | 65 | 50 | 450 |
| 116 | 1 | 3 | 1016 | gnl\|PID\|d101125 | queuosine biosynthesis protein QueA [Synechocystis sp.] | 65 | 44 | 1014 |
| 123 | 1 | 69 | 389 | gi\|498839 | ORF2 [Clostridium perfringens] | 65 | 36 | 321 |
| 123 | 7 | 6522 | 7190 | gi\|1575577 | DNA-binding response regulator [Thermotoga maritima] | 65 | 39 | 669 |
| 125 | 3 | 3821 | 2859 | gnl\|PID\|e257609 | sugar-binding transport protein [Anaerocellum thermophilum] | 65 | 47 | 963 |
| 137 | 12 | 8015 | 7818 | gi\|2182574 | (AE000090) Y4pE [Rhizobium sp. NGR234] | 65 | 41 | 198 |
| 147 | 4 | 5021 | 3884 | gi\|472329 | dihydrolipoamide acetyltransferase [Clostridium magnum] | 65 | 47 | 1137 |
| 148 | 2 | 1053 | 1931 | gnl\|PID\|d101319 | YqgH [Bacillus subtilis] | 65 | 42 | 879 |
| 151 | 2 | 3212 | 4687 | gi\|304987 | EcoE type I restriction modification enzyme M subunit [Escherichia coli] | 65 | 50 | 1476 |
| 156 | 2 | 730 | 437 | gi\|310893 | membrane protein [Theileria parva] | 65 | 47 | 294 |
| 164 | 5 | 4256 | 4837 | gi\|410132 | ORFX8 [Bacillus subtilis] | 65 | 48 | 582 |
| 169 | 5 | 3192 | 3914 | gi\|1552737 | similar to purine nucleoside phosphorylase (deoD) [Escherichia coli] | 65 | 41 | 723 |
| 176 | 4 | 2951 | 2220 | gnl\|PID\|e339500 | oligopeptide binding lipoprotein [Streptococcus pneumoniae] | 65 | 43 | 732 |
| 195 | 4 | 4556 | 3900 | gi\|1592142 | ABC transporter, probable ATP-binding subunit [Methanococcus jannaschii] | 65 | 40 | 657 |
| 196 | 1 | 160 | 1572 | gnl\|PID\|d102004 | (AB001488) PROBABLE UDP-N-ACETYLMURAMOYLALANYL-D-GLUTAMYL-2,6-DIAMINOLIGASE (EC 6.3.2.15). [Bacillus subtilis] | 65 | 51 | 1413 |
| 204 | 2 | 2246 | 1215 | gi\|143156 | membrane bound protein [Bacillus subtilis] | 65 | 37 | 1032 |
| 210 | 4 | 1544 | 1891 | gi\|49315 | ORF1 gene product [Bacillus subtilis] | 65 | 48 | 348 |
| 242 | 2 | 1625 | 723 | gi\|1787540 | (AE000226) f249; This 249 aa orf is 32 pct identical (8 gaps) to 244 residues of an approx. 272 as protein AGAR_ECOLI SW: P42902 [Escherichia coli] | 65 | 42 | 903 |
| 284 | 1 | 1 | 900 | gi\|559861 | clyM [Plasmid pAD1] | 65 | 36 | 900 |
| 304 | 1 | 2 | 574 | gnl\|PID\|e290934 | unknown [Mycobacterium tuberculosis] | 65 | 52 | 573 |
| 315 | 1 | 2 | 1483 | gi\|790694 | mannuronan C-5-epimerase [Azotobacter vinelandi] | 65 | 57 | 1482 |
| 120 | 1 | 3 | 569 | gnl\|PID\|d102048 | K. aerogenes, histidine utilization repressor; P12380 (199) DNA binding [Bacillus subtilis] | 65 | 46 | 567 |
| 358 | 1 | 1 | 309 | gnl\|PID\|e323508 | YloS protein [Bacillus subtilis] | 65 | 55 | 309 |
| 2 | 7 | 7571 | 6696 | gi\|1498753 | nicotinate-nucleotide pyrophosphorylase [Rhodospirillum rubrum] | 64 | 47 | 876 |
| 6 | 6 | 5924 | 6802 | gnl\|PID\|d101111 | methionine aminopeptidase [Synechocystis sp.] | 64 | 52 | 879 |
| 8 | 4 | 3417 | 3686 | gi\|1045935 | DNA helicase II [Mycoplasma genitalium] | 64 | 58 | 270 |
| 11 | 4 | 3249 | 2689 | gnl\|PID\|e265529 | OrfB [Streptococcus pneumoniae] | 64 | 46 | 561 |
| 15 | 7 | 6504 | 7145 | gi\|1762328 | Ycr59c/YigZ homolog [Bacillus subtilis] | 64 | 45 | 642 |
| 22 | 11 | 9548 | 9895 | gnl\|PID\|d100581 | unknown [Bacillus subtilis] | 64 | 38 | 348 |
| 22 | 30 | 22503 | 23174 | gi\|289260 | comE ORF1 [Bacillus subtilis] | 64 | 44 | 672 |
| 26 | 7 | 14375 | 14199 | gi\|409286 | bmrU [Bacillus subtilis] | 64 | 30 | 177 |
| 27 | 2 | 1510 | 1334 | gi\|40795 | DdeI methylase [Desulfovibrio vulgaris] | 64 | 51 | 177 |
| 29 | 2 | 614 | 297 | gi\|2326168 | type VII collagen [Mus musculus] | 64 | 50 | 318 |
| 35 | 2 | 368 | 721 | pir\|JC1151\|JC11 | hypothetical 20.3K protein (insertion sequence IS1131) - Agrobacterium tumefaciens (strain PO22) plasmid Ti | 64 | 50 | 354 |
| 40 | 1 | 3 | 449 | gi\|46970 | epiD gene product [Staphylococcus epidermidis] | 64 | 41 | 447 |
| 40 | 7 | 4683 | 4976 | gnl\|PID\|e325792 | (AJ000005) glucose kinase [Bacillus megaterium] | 64 | 45 | 294 |
| 45 | 7 | 8068 | 6920 | gnl\|PID\|d102036 | subunit of ADP-glucose pyrophosphorylase [Bacillus stearothermophilus] | 64 | 40 | 1149 |
| 51 | 2 | 301 | 1059 | gi\|43985 | nifS-like gene [Lactobacillus delbrueckii] | 64 | 54 | 759 |
| 51 | 13 | 15251 | 18397 | gi\|2293260 | (Af008220) DNA-polymerase III alpha-chain [Bacillus subtilis] | 64 | 46 | 3147 |
| 53 | 3 | 1157 | 555 | gi\|1574292 | hypothetical [Haemophilus influenzae] | 64 | 47 | 603 |
| 58 | 2 | 4236 | 1606 | gi\|1573826 | alanyl-tRNA synthetase (alaS) [Haemophilus influenzae] | 64 | 51 | 2631 |
| 66 | 1 | 3 | 1259 | gi\|895749 | putative cellobiose phosphotransferase enzyme II" [Bacillus subtilis] | 64 | 42 | 1257 |
| 68 | 5 | 5213 | 6556 | gi\|436965 | [malA] gene products [Bacillus stearothermophilus] | 64 | 47 | 1344 |
| 69 | 6 | 5356 | 4949 | gnl\|PID\|d101316 | Cdd [Bacillus subtilis] | 64 | 52 | 408 |
| 74 | 4 | 5948 | 5038 | gi\|726480 | L-glutamine-D-fructose-6-phosphate amidotransferase [Bacillus subtilis] | 64 | 50 | 1911 |

TABLE 2-continued

S. pneumoniae - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 75 | 3 | 1283 | 1465 | bbs\|133379 | TLS-CHOP = fusion protein (CHOP = C/EBP transcription factor, TLS = nuclear RNA-binding protein) (human, myxoid liposarcomas cells, Peptide Mutant, 462 aa) [Homo sapiens] | 64 | 57 | 183 |
| 81 | 13 | 14016 | 14231 | gi\|143175 | methanol dehydrogenase alpha-10 subunit [Bacillus sp.] | 64 | 35 | 216 |
| 83 | 22 | 21851 | 22090 | gnl\|PID\|d01315 | YqfA [Bacillus subtilis] | 64 | 44 | 240 |
| 87 | 11 | 10046 | 9300 | gnl\|PID\|e323505 | putative PtcI protein [Bacillus subtilis] | 64 | 43 | 747 |
| 98 | 7 | 5032 | 5706 | gnl\|PID\|e233880 | hypothetical protein [Bacillus subtilis] | 64 | 38 | 675 |
| 105 | 1 | 2 | 1276 | gi\|1657503 | similar to S. aureus mercury(II) reductase [Escherichia coli] | 64 | 45 | 1275 |
| 113 | 7 | 5136 | 6410 | gnl\|PID\|d101119 | NifS [Synechocystis sp.] | 64 | 50 | 1275 |
| 119 | 1 | 2 | 1297 | gnl\|PID\|e320520 | hypothetical protein [Natronobacterium pharaonis] | 64 | 37 | 1296 |
| 123 | 3 | 1125 | 2156 | gnl\|PID\|e253284 | ORF YDL44w [Saccharomyces cerevisiae] | 64 | 40 | 1032 |
| 124 | 5 | 2331 | 1780 | gnl\|PID\|d101884 | hypothetical protein [Synechocystis sp.] | 64 | 50 | 552 |
| 129 | 4 | 3467 | 2709 | gnl\|PID\|d101314 | YqeU [Bacillus subtilis] | 64 | 52 | 759 |
| 131 | 1 | 152 | 3 | gi\|1377841 | unknown [Bacillus subtilis] | 64 | 42 | 150 |
| 137 | 11 | 7196 | 7549 | pir\|JC1151\|JC11 | hypothetical 20.3K protein (insertion sequence IS1131) - Agrobacterium tumefaciens (strain PO22) plasmid Ti | 64 | 50 | 354 |
| 139 | 3 | 3226 | 2651 | gi\|2293301 | (AF008220) YtqB [Bacillus subtilis] | 64 | 44 | 576 |
| 146 | 10 | 6730 | 5648 | gi\|1322245 | mevalonate pyrophosphate decarboxylase [Rattus norvegicus] | 64 | 45 | 1083 |
| 147 | 1 | 2 | 1018 | gnl\|PID\|e137033 | unknown gene product [Lactobacillus leichmannii] | 64 | 46 | 1017 |
| 148 | 11 | 8430 | 8783 | gi\|2130630 | (AF000430) dynamin-like protein [Homo sapiens] | 64 | 28 | 354 |
| 156 | 7 | 4313 | 3612 | gnl\|PID\|d102050 | transmembrane [Bacillus subtilis] | 64 | 31 | 702 |
| 157 | 4 | 1299 | 2114 | gnl\|PID\|d100892 | homologous to Gln transport system permease proteins [Bacillus subtilis] | 64 | 43 | 816 |
| 162 | 6 | 5880 | 6362 | gi\|517204 | ORF1, putative 42 kDa protein [Streptococcus pyogenes] | 64 | 58 | 483 |
| 164 | 13 | 9707 | 8769 | gnl\|PID\|d100964 | homologue of ferric anguibactin transport system permease protein FatD of V. anguillarum [Bacillus subtilis] | 64 | 40 | 939 |
| 175 | 5 | 3906 | 3598 | gi\|534045 | antiterminator [Bacillus subtilis] | 64 | 39 | 693 |
| 189 | 10 | 6154 | 6507 | gi\|581307 | response regulator [Lactobacillus plantarum] | 64 | 33 | 354 |
| 191 | 4 | 3519 | 2863 | gi\|149520 | phosphoribosyl anthranilate isomerase [Lactococcus lactis] | 64 | 46 | 657 |
| 202 | 1 | 76 | 1140 | gnl\|PID\|e293806 | o-acetylhomoserine sulfhydrylase [Leptospira meyeri] | 64 | 47 | 1065 |
| 224 | 1 | 234 | 1571 | gi\|1573393 | collagenase (prtC) [Haemophilus influenzae] | 64 | 42 | 1338 |
| 231 | 3 | 291 | 647 | gi\|40174 | ORF X [Bacillus subtilis] | 64 | 43 | 357 |
| 253 | 3 | 709 | 1089 | pir\|JC1151\|HC11 | hypothetical 20.3K protein (insertion sequence IS1131) - Agrobacterium tumefaciens (strain PO22) plasmid Ti | 64 | 50 | 381 |
| 265 | 1 | 820 | 2 | gi\|1377832 | unknown [Bacillus subtilis] | 64 | 31 | 819 |
| 297 | 1 | 1 | 660 | gi\|1590871 | collagenase [Methanococcus jannaschii] | 64 | 48 | 660 |
| 328 | 1 | 263 | 21 | gi\|992651 | Gln4p [Saccharomyces cerevisiae] | 64 | 41 | 243 |
| 5 | 4 | 8730 | 8098 | gi\|556885 | Unknown [Bacillus subtilis] | 64 | 48 | 633 |
| 10 | 6 | 5178 | 4483 | gi\|1573101 | hypothetical [Haemophilus influenzae] | 63 | 40 | 696 |
| 12 | 11 | 9324 | 9902 | gi\|806536 | membrane protein [Bacillus acidopullulyticus] | 63 | 42 | 579 |
| 15 | 10 | 8897 | 9187 | gi\|722339 | unknown [Acetobacter xylinum] | 63 | 40 | 291 |
| 17 | 2 | 1031 | 309 | gnl\|PID\|e217602 | PlnU [Lactobacillus plantarum] | 63 | 32 | 723 |
| 18 | 8 | 7778 | 6975 | gi\|1377843 | unknown [Bacillus subtilis] | 63 | 45 | 804 |
| 26 | 4 | 9780 | 7078 | gi\|142440 | ATP-dependent nuclease [Bacillus subtilis] | 63 | 46 | 2703 |
| 29 | 5 | 3488 | 4192 | gi\|1377829 | unknown [Bacillus subtilis] | 63 | 35 | 705 |
| 34 | 11 | 8830 | 7988 | gnl\|PID\|d101198 | ORF8 [Enterococcus faecalis] | 63 | 45 | 843 |
| 35 | 3 | 1187 | 876 | gi\|722339 | unknown [Acetobacter xylinum] | 63 | 39 | 312 |
| 48 | 15 | 12509 | 11691 | gi\|1573389 | hypothetical [Haemophilus influenzae] | 63 | 41 | 819 |
| 51 | 11 | 12719 | 12189 | gi\|142450 | ahrC protein [Bacillus subtilis] | 63 | 35 | 531 |
| 55 | 4 | 3979 | 5022 | gi\|1708640 | YeaB [Bacillus subtilis] | 63 | 41 | 1044 |
| 55 | 15 | 13669 | 14670 | gnl\|PID\|e311502 | thioredoxin reductase [Bacillus subtilis] | 63 | 44 | 1002 |
| 68 | 10 | 9242 | 8919 | sp\|P37686\|YIAY_ | HYPOTHETICAL 40.2 KD PROTEIN IN AVTA-SELB INTERGENIC REGION (F382) | 63 | 40 | 324 |
| 86 | 7 | 6554 | 5685 | gi\|1574382 | lic-1 operon protein (licD) [Haemophilus influenzae] | 63 | 41 | 870 |
| 88 | 8 | 6085 | 5180 | gi\|2098719 | putative fimbrial-associated protein [Actinomyces naeslundii] | 63 | 43 | 906 |
| 96 | 8 | 5858 | 6484 | gi\|1052803 | orflgyrb gene product [Streptococcus pneumoniae] | 63 | 38 | 627 |
| 100 | 1 | 240 | 1940 | gi\|7171 | fucosidase [Dictyostelium discoideum] | 63 | 36 | 1701 |
| 104 | 4 | 3063 | 5765 | gi\|144985 | phosphoenolpyrubate carboxylase [Corynebacterium glutamicum] | 63 | 46 | 2703 |
| 106 | 8 | 9189 | 8554 | gi\|533099 | endonuclease II [Bacillus subtilis] | 63 | 45 | 636 |
| 122 | 6 | 4704 | 4886 | gnl\|PID\|d101139 | transposase [Synechosystis sp.] | 63 | 39 | 183 |
| 128 | 7 | 4517 | 5203 | gnl\|PID\|d101434 | orf2 [Methanobacterium thermoautotrophicum] | 63 | 50 | 687 |
| 137 | 4 | 963 | 1547 | gi\|472920 | v-type Na-ATPase [Enterococcus hirae] | 63 | 27 | 585 |
| 142 | 7 | 4100 | 4585 | gnl\|PID\|e313025 | hypothetical protein [Bacillus subtilis] | 63 | 44 | 486 |
| 159 | 5 | 1741 | 2571 | gi\|1787043 | (AE000184) f271; This 271 aa orf is 24 pct identical (16 gaps) to 265 residues of an approx. 272 aa protein YIDA_ECOLI SW: PO9997 [Escherichia coli] | 63 | 39 | 831 |
| 171 | 12 | 8803 | 14406 | gnl\|PID\|e324918 | Iga1 protease [Streptococcus sanguis] | 63 | 48 | 5604 |
| 177 | 1 | 3 | 347 | gi\|1773150 | hypothetical 14.8kd protein [Escherichia coli] | 63 | 34 | 345 |
| 178 | 2 | 423 | 917 | gi\|722339 | unknown [Acetobacter xylinum] | 63 | 41 | 495 |
| 178 | 3 | 794 | 1012 | gi\|1591582 | cobalamin biosynthesis protein N [Methanococcus jannaschii] | 63 | 36 | 219 |
| 195 | 1 | 1377 | 175 | gnl\|PID\|e324217 | ftsQ [Enterococcus hirae] | 63 | 33 | 1203 |
| 234 | 5 | 1739 | 1527 | gi\|1591582 | cobalamin biosynthesis protein N [Methanococcus jannaschii] | 63 | 36 | 213 |
| 249 | 1 | 81 | 257 | gi\|1000453 | TreR [Bacillus subtilis] | 63 | 41 | 177 |
| 283 | 1 | 127 | 1347 | gi\|396486 | ORF8 [Bacillus subtilis] | 63 | 44 | 1221 |

TABLE 2-continued

*S. pneumoniae* - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 293 | 3 | 2804 | 3466 | gi|722339 | unknown [*Acetobacter xylinum*] | 63 | 37 | 663 |
| 311 | 1 | 905 | 486 | gi|1877424 | UDP-galactose 4-epimerase [*Streptococcus mutans*] | 63 | 46 | 420 |
| 324 | 1 | 2 | 556 | gi|1477741 | histidine periplasmic binding protein P29 [*Campylobacter jejuni*] | 63 | 36 | 555 |
| 365 | 1 | 219 | 13 | gi|2252843 | (AF013293) No definition line found [*Arabidopsis thaliana*] | 63 | 33 | 207 |
| 382 | 1 | 88 | 378 | gi|722339 | unknown [*Acetobacter xylinum*] | 63 | 40 | 291 |
| 385 | 3 | 364 | 158 | gi|2252843 | (AF013293) No definition line found [*Arabidopsis thaliana*] | 63 | 33 | 207 |
| 2 | 1 | 2495 | 288 | gnl|PID|e325007 | penicillin-binding protein [*Bacillus subtilis*] | 62 | 42 | 2208 |
| 3 | 23 | 23374 | 24231 | gnl|PID|e254993 | hypothetical protein [*Bacillus subtilis*] | 62 | 35 | 858 |
| 6 | 16 | 14320 | 13193 | gnl|PID|e349614 | nifS-like protein [*Mycobacterium leprae*] | 62 | 37 | 1128 |
| 7 | 8 | 6819 | 7232 | gnl|PID|d101324 | YqhY [*Bacillus subtilis*] | 62 | 32 | 414 |
| 7 | 19 | 15466 | 14207 | gnl|PID|d101804 | beta ketoacyl-acyl carrier protein syntase [*Synechocystis sp.*] | 62 | 43 | 1260 |
| 7 | 21 | 17155 | 16229 | gnl|PID|e323514 | putative FabD protein [*Bacillus subtilis*] | 62 | 46 | 927 |
| 7 | 24 | 19526 | 18519 | gi|1276434 | beta-ketoacyl-ACP synthase III [*Cuphea wrightii*] | 62 | 37 | 1008 |
| 12 | 7 | 5904 | 4702 | gi|1573768 | A/G-specific adenine glycosylase (mutY) [*Haemophilus influenzae*] | 62 | 43 | 1203 |
| 12 | 9 | 8032 | 8793 | gi|1591587 | pantothenate metabolism flavoprotein [*Methanococcus jannaschii*] | 62 | 33 | 762 |
| 15 | 11 | 9678 | 9328 | pir|JC1151|JC11 | hypothetical 20.3K protein (insertion sequence IS1131) - *Agrobacterium tumefaciens* (strain PO22) plasmid Ti | 62 | 43 | 351 |
| 17 | 4 | 2609 | 2442 | gi|1591081 | *M. jannaschii* predicted coding region MJ0374 [*Methanococcus jannaschii*] | 62 | 43 | 168 |
| 17 | 5 | 3053 | 2835 | gi|149570 | role in the expression of lactacin F, part of the laf operon [*Lactobacillus sp.*] | 62 | 44 | 219 |
| 22 | 10 | 8627 | 9538 | gnl|PID|d100580 | similar to *B. subtilis* DnaH [*Bacillus subtilis*] | 62 | 43 | 912 |
| 30 | 3 | 865 | 2043 | gi|2314379 | (AE000627) ABC transporter, ATP-binding protein (yhcG) [*Helicobacter pylori*] | 62 | 43 | 1179 |
| 33 | 5 | 2235 | 1636 | gi|413976 | ipa-52r gene product [*Bacillus subtilis*] | 62 | 44 | 600 |
| 38 | 11 | 5689 | 6123 | gi|148231 | o251 [*Escherichia coli*] | 62 | 34 | 435 |
| 40 | 17 | 14272 | 13328 | gnl|PID|d101904 | hypothetical protein [Synechocystis sp.] | 62 | 43 | 945 |
| 42 | 1 | 3 | 311 | gi|1146182 | putative [*Bacillus subtilis*] | 62 | 41 | 309 |
| 44 | 2 | 1267 | 4005 | gi|1786952 | (AE000176) o877; 100 pct identical to the first 86 residues of the 100 aa hypothetical protein fragment YBGB_ECOLI SW: P54746 [*Escherichia coli*] | 62 | 43 | 2739 |
| 48 | 12 | 9732 | 9304 | gi|662920 | repressor protein [*Enterococcus hirae*] | 62 | 32 | 429 |
| 51 | 8 | 5664 | 7181 | gnl|PID|e301153 | StySKI methylase [*Salmonella enterica*] | 62 | 44 | 1518 |
| 52 | 3 | 2791 | 2099 | gi|1183886 | integral membrane protein [*Bacillus subtilis*] | 62 | 41 | 693 |
| 55 | 16 | 15702 | 14704 | gnl|PID|e313028 | hypothetical protein [*Bacillus subtilis*] | 62 | 40 | 999 |
| 59 | 6 | 3418 | 3984 | gi|2065483 | unknown [*Lactococcus lactis lactis*] | 62 | 32 | 567 |
| 63 | 5 | 4997 | 4809 | gi|149771 | pilin gene inverting protein (PivML) [*Moraxella lacunata*] | 62 | 28 | 189 |
| 70 | 14 | 10002 | 10739 | gi|992977 | hplG gene product [*Bordetella pertussis*] | 62 | 45 | 738 |
| 71 | 13 | 18790 | 20382 | gi|1280135 | coded for by *C. elegans* cDNA cm21e6; coded for by *C. elegans* cDNA cm01e2; similar to melibiose carrier protein (thiomethylgalactoside permease II) [*Caenorhabditis elegans*] | 62 | 62 | 1593 |
| 71 | 28 | 32217 | 32768 | gnl|PID|d101312 | YqeG [*Bacillus subtilis*] | 62 | 35 | 552 |
| 74 | 7 | 11666 | 10383 | gi|1552753 | hypothetical [*Escherichia coli*] | 62 | 38 | 1284 |
| 80 | 8 | 9370 | 9609 | gnl|PID|d102002 | (AB001488) FUNCTION UNKNOWN. [*Bacillus subtilis*] | 62 | 46 | 240 |
| 97 | 10 | 9068 | 7041 | gi|882463 | protein-N(pi)-phosphohistidine-sugar phosphotransferase [*Escherichia coli*] | 62 | 42 | 2028 |
| 98 | 4 | 2306 | 3268 | gnl|PID|d101496 | BraE (integral membrane protein) [*Pseudomonas aeruginosa*] | 62 | 42 | 963 |
| 102 | 3 | 2823 | 3539 | gnl|PID|e313010 | hypothetical protein [*Bacillus subtilis*] | 62 | 24 | 717 |
| 103 | 3 | 2795 | 1242 | gnl|PID|d102049 | *H. influenzae* hypothetical ABC transporter; P44808 (974) [*Bacillus subtilis*] | 62 | 41 | 1554 |
| 111 | 2 | 2035 | 3462 | gi|581297 | NisP [*Lactococcus lactis*] | 62 | 44 | 1428 |
| 112 | 4 | 3154 | 4080 | gi|1574379 | lic-1 operon protein (licA) [*Haemophilus influenzae*] | 62 | 39 | 927 |
| 112 | 6 | 4939 | 5649 | gi|1574381 | lic-1 operon protein (licC) [*Haemophilus influenzae*] | 62 | 39 | 711 |
| 124 | 3 | 1137 | 721 | gi|1573024 | anaerobic ribonucleoside-triphosphate reductase (nrdD) [*Haemophilus influenzae*] | 62 | 45 | 417 |
| 124 | 6 | 3162 | 2329 | gi|609076 | leucyl aminopeptidase [*Lactobacillus delbrueckii*] | 62 | 40 | 834 |
| 126 | 7 | 11073 | 7516 | gnl|PID|d101163 | ORF4 [*Bacillus subtilis*] | 62 | 38 | 3558 |
| 129 | 6 | 4983 | 4540 | pir|S41509|S415 | zinc finger protein EF6 - Chilo iridescent virus | 62 | 48 | 444 |
| 131 | 7 | 4510 | 4103 | gi|1857245 | unknown [*Lactococcus lactis*] | 62 | 42 | 408 |
| 149 | 2 | 1923 | 2579 | gi|1592142 | ABC transporter, probable ATP-binding subunit [*Methanococcus jannaschii*] | 62 | 41 | 657 |
| 149 | 7 | 5360 | 6055 | gnl|PID|e323508 | YloS protein [*Bacillus subtilis*] | 62 | 40 | 696 |
| 156 | 1 | 450 | 238 | gnl|PID|e254644 | membrane protein [*Streptococcus pneumoniae*] | 62 | 40 | 213 |
| 156 | 6 | 3606 | 2935 | gnl|PID|d102050 | transmembrane [*Bacillus subtilis*] | 62 | 37 | 672 |
| 171 | 2 | 1779 | 2291 | gi|43941 | EIII-B Sor PTS [*Klebsiella pneumoniae*] | 62 | 35 | 513 |
| 172 | 2 | 385 | 723 | gi|895750 | putative cellobiose phosphotransferase enzyme III [*Bacillus subtilis*] | 62 | 39 | 339 |
| 173 | 3 | 2599 | 893 | gi|1591732 | cobalt transport ATP-binding protein O [*Methanococcus jannaschii*] | 62 | 42 | 1707 |
| 179 | 2 | 492 | 1754 | gi|1574071 | *H. influenzae* predicted coding region HI1038 [*Haemophilus influenzae*] | 62 | 38 | 1263 |
| 181 | 6 | 2856 | 3707 | gi|1777435 | LacT [*Lactobacillus casei*] | 62 | 42 | 852 |
| 185 | 2 | 2074 | 311 | gi|2182397 | (AE00073) Y4fN [Rhizobium sp. NGR234] | 62 | 41 | 1764 |
| 200 | 2 | 1061 | 1984 | gi|450566 | transmembrane protein [*Bacillus subtilis*] | 62 | 37 | 924 |
| 202 | 3 | 2583 | 3473 | gi|42219 | P35 gene product (AA 1–314) [*Escherichia coli*] | 62 | 41 | 891 |
| 210 | 3 | 1374 | 1565 | gi|49315 | ORF1 gene product [*Bacillus subtilis*] | 62 | 45 | 192 |

TABLE 2-continued

_S. pneumoniae_ - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 211 | 1 | 3 | 971 | gi\|147402 | mannose permease subunit III-Man [_Escherichia coli_] | 62 | 43 | 969 |
| 223 | 2 | 1495 | 1034 | gnl\|PID\|d101190 | ORF2 [_Streptococcus mutans_] | 62 | 41 | 462 |
| 228 | 1 | 34 | 909 | gi\|530063 | glycerol uptake facilitator [_Streptococcus pneumoniae_] | 62 | 44 | 876 |
| 234 | 2 | 90 | 917 | gi\|2293259 | (AF008220) YtqI [_Bacillus subtilis_] | 62 | 38 | 828 |
| 282 | 5 | 1765 | 1487 | gnl\|PID\|e273475 | galactokinase [_Arabidopsis thaliana_] | 62 | 33 | 279 |
| 375 | 1 | 1 | 159 | gi\|1674231 | (AE000052) _Mycoplasma pneumoniae_, hypothetical protein homolog; similar to Swiss-Prot Accession Number P35155, form _B. subtilis_ [_Mycoplasma pneumoniae_] | 62 | 40 | 159 |
| 385 | 5 | 584 | 357 | gi\|1573353 | outer membrane integrity protein (tolA) [_Haemophilus influenzae_] | 62 | 47 | 228 |
| 3 | 19 | 18550 | 19269 | gi\|606162 | ORF_f229 [_Escherichia coli_] | 61 | 41 | 720 |
| 7 | 4 | 2725 | 3225 | gi\|2114425 | similar to Synechocystis sp. hypothetical protein, encoded by GenBank Accession Number D64006 [_Bacillus subtilis_] | 61 | 42 | 501 |
| 17 | 6 | 3326 | 3054 | gi\|149569 | lactacin F [_Lactobacillus_ sp.] | 61 | 43 | 273 |
| 44 | 3 | 4061 | 4957 | gnl\|PID\|d101068 | xylose repressor [_Synechocystis_ sp.] | 61 | 38 | 897 |
| 54 | 11 | 8388 | 7234 | gnl\|PID\|d101329 | YqjH [_Bacillus subtilis_] | 61 | 42 | 1155 |
| 57 | 6 | 3974 | 6037 | gnl\|PID\|d101316 | YqfK [_Bacillus subtilis_] | 61 | 42 | 2064 |
| 58 | 5 | 7356 | 6565 | sp\|P45169\|POTC_ | SPERMIDINE/PUTRESCINE TRANSPORT SYSTEM PERMEASE PROTEIN POTC. | 61 | 34 | 792 |
| 67 | 1 | 3 | 692 | gi\|537108 | ORF_f254 [_Escherichia coli_] | 61 | 46 | 690 |
| 68 | 9 | 8816 | 7890 | gi\|19501 | pPLX12 gene product (AA 1–184) [_Lupinus polyphyllus_] | 61 | 41 | 927 |
| 70 | 15 | 10737 | 12008 | gi\|992976 | bplF gene product [_Bordetella pertussis_] | 61 | 44 | 1272 |
| 72 | 11 | 9759 | 10202 | gnl\|PID\|d101833 | carboxynorspermidine decarboxylase [_Synechocystis_ sp.] | 61 | 36 | 444 |
| 76 | 8 | 7881 | 7003 | gnl\|PID\|d100305 | farnesyl disphosphate syntase [_Bacillus stearothermophilus_] | 61 | 45 | 879 |
| 87 | 4 | 4914 | 3697 | gi\|528991 | unknown [_Bacillus subtilis_] | 61 | 42 | 1218 |
| 87 | 13 | 12311 | 11361 | gi\|1789683 | (AE000407) methionyl-tRNA formultransferase [_Escherichia coli_] | 61 | 44 | 951 |
| 91 | 2 | 731 | 2989 | gi\|537080 | ribonucleoside triphosphate reductase [_Escherichia coli_] | 61 | 45 | 2259 |
| 105 | 3 | 2711 | 3499 | gnl\|PID\|d101851 | hypothetical protein [_Synechocystis_ sp.] | 61 | 44 | 789 |
| 115 | 6 | 7986 | 6478 | gi\|895747 | putative cel operon regulator [_Bacillus subtilis_] | 61 | 36 | 1491 |
| 123 | 8 | 7181 | 8518 | gi\|1209527 | protein histidine kinase [_Enterococcus faecalis_] | 61 | 40 | 1338 |
| 126 | 6 | 7525 | 6725 | gi\|1787043 | (AE000184) f271; This 271 as orf is 24 pct identical (16 gaps) to 265 residues of an approx. 272 as protein YIDA_ECOLI SW; PO9997 [_Escherichia coli_] | 61 | 38 | 801 |
| 128 | 1 | 11 1 | 639 | gnl\|PID\|d101328 | YqiY [_Bacillus subtilis_] | 61 | 41 | 639 |
| 139 | 7 | 4794 | 5054 | gi\|1022726 | unknown [_Staphylococcus haemolyticus_] | 61 | 41 | 261 |
| 139 | 9 | 12632 | 5913 | gnl\|PID\|e270014 | beta-galactosidase [_Thermoanaerobacter ethanolicus_] | 61 | 41 | 6720 |
| 143 | 1 | 2552 | 42 | gi\|520541 | penicillin-binding proteins 1A and 1B [_Bacillus subtilis_] | 61 | 42 | 2511 |
| 148 | 16 | 12125 | 11424 | gi\|1552743 | tetrahydrodipicolinate N-succinyltransferase [_Escherichia coli_] | 61 | 42 | 702 |
| 162 | 3 | 4112 | 3456 | gnl\|PID\|d101829 | phosphoglycolate phosphatase [_Synechocystis_ sp.] | 61 | 30 | 657 |
| 172 | 3 | 727 | 1077 | gnl\|PID\|d102048 | _B. subtilis_, cellobiose phosphotransferase system, celA; P46318 (220) [_Bacillus subtilis_] | 61 | 44 | 351 |
| 177 | 3 | 1101 | 1772 | gnl\|PID\|d100574 | unknown [_Bacillus subtilis_] | 61 | 43 | 672 |
| 202 | 2 | 1278 | 2585 | gi\|1045831 | hypothetical protein (GB:L18965_6) [_Mycoplasma genitalium_] | 61 | 36 | 1308 |
| 224 | 3 | 2782 | 3144 | gi\|1591144 | _M. jannaschii_ predicted coding region MJ0440 [_Methanococcus jannaschii_] | 61 | 30 | 363 |
| 225 | 4 | 3395 | 3766 | gi\|1552774 | hypothetical [_Escherichia coli_] | 61 | 40 | 372 |
| 249 | 2 | 212 | 802 | gnl\|PID\|d100453 | TreR [_Bacillus subtilis_] | 61 | 42 | 591 |
| 254 | 2 | 843 | 484 | gnl\|PID\|d100417 | ORF120 [_Escherichia coli_] | 61 | 36 | 360 |
| 257 | 1 | 3 | 350 | gnl\|PID\|e255315 | unknown [_Mycobacterium tuberculosis_] | 61 | 42 | 348 |
| 293 | 4 | 3971 | 3657 | pir\|JC1151\|JC11 | hypothetical 20.3K protein (insertion sequence IS1131) - _Agrobacterium tumefaciens_ (strain PO22) plasmid Ti | 61 | 45 | 315 |
| 301 | 1 | 949 | 17 | gi\|2291209 | (AF016424) contains similarity to acyltransferases [_Caenorhabditis elegans_] | 61 | 33 | 933 |
| 373 | 1 | 1066 | 287 | gi\|393396 | Tb-292 membrane associated protein [_Trypanosoma brucei_ subgroup] | 61 | 38 | 780 |
| 3 | 24 | 24473 | 24955 | gi\|537093 | ORF_o153b [_Escherichia coli_] | 60 | 27 | 483 |
| 6 | 5 | 4636 | 5739 | gi\|2293258 | (AF008220) YtoI [_Bacillus subtilis_] | 60 | 35 | 1104 |
| 6 | 12 | 11936 | 11187 | gi\|293017 | ORF3 (put.); putative [_Lactococcus lactis_] | 60 | 44 | 750 |
| 17 | 13 | 6708 | 6484 | gi\|149569 | lactacin F [_Lactobacillus_ sp.] | 60 | 32 | 225 |
| 18 | 7 | 6977 | 5670 | gi\|1788140 | (AE000278) o481; This 481 as orf is 35 pct identical (19 gaps) to 309 residues of an approx. 856 aa protein NOL1_HUMAN SW: P46087 [_Escherichia coli_] | 60 | 43 | 1308 |
| 20 | 15 | 15878 | 17167 | gnl\|PID\|d100584 | unknown [_Bacillus subtilis_] | 60 | 44 | 1290 |
| 22 | 1 | 1 | 243 | gnl\|PID\|d102050 | transmembrane [_Bacillus subtilis_] | 60 | 36 | 243 |
| 32 | 10 | 8296 | 8964 | gi\|2293275 | (AF008220) YtaG [_Bacillus subtilis_] | 60 | 37 | 669 |
| 38 | 15 | 8837 | 9697 | gi\|40023 | _B. subtilis_ genes rpmH, rnpA, 50kd, gidA and gidB [_Bacillus subtilis_] | 60 | 35 | 861 |
| 43 | 6 | 6610 | 5944 | gi\|171787 | protein kinase 1 [_Saccharomyces cerevisiae_] | 60 | 36 | 2667 |
| 44 | 1 | 1 | 1269 | gnl\|PID\|e235823 | unknown [_Schizosaccharomyces pombe_] | 60 | 44 | 1269 |
| 45 | 10 | 11138 | 10368 | gi\|397488 | 1,4-alpha-glucan branching enzyme [_Bacillus subtilis_] | 60 | 43 | 771 |
| 48 | 19 | 15766 | 14378 | gnl\|PID\|e205173 | orf1 [_Lactobacillus helveticus_] | 60 | 39 | 1389 |
| 48 | 21 | 16727 | 16951 | gnl\|PID\|d102041 | (AB002668) unnamed protein product [_Haemophilus actinomycetemcomitans_] | 60 | 32 | 225 |
| 50 | 1 | 2 | 898 | gnl\|PID\|e246537 | ORF286 protein [_Pseudomonas stutzeri_] | 60 | 31 | 897 |
| 62 | 2 | 638 | 1177 | gnl\|PID\|d100587 | unknown [_Bacillus subtilis_] | 60 | 42 | 540 |
| 68 | 4 | 3590 | 5203 | gi\|1573583 | _H. influenzae_ predicted coding region HI0594 [_Haemophilus influenzae_] | 60 | 36 | 1614 |

TABLE 2-continued

*S. pneumoniae* - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 70 | 11 | 5781 | 6182 | gnl\|PID\|d102014 | (AB001488) SIMILAR TO YDFR GENE PRODUCT OF THIS ENTRY (YDFR_BACSU) [*Bacillus subtilis*] | 60 | 33 | 402 |
| 70 | 12 | 6343 | 8133 | gnl\|PID\|e324970 | hypothetical protein [*Bacillus subtilis*] | 60 | 38 | 1791 |
| 71 | 8 | 11701 | 14157 | gi\|580866 | ipa-12d gene product [*Bacillus subtilis*] | 60 | 33 | 2457 |
| 74 | 8 | 12509 | 11664 | gnl\|PID\|d101832 | phosphatidate cytidylyltransferase [*Synechocystis sp.*] | 60 | 45 | 846 |
| 76 | 4 | 4116 | 3367 | gi\|2352096 | orf; similar to serine/threonine protein phosphatase [*Fervidobacterium islandicum*] | 60 | 39 | 750 |
| 80 | 4 | 7372 | 7665 | gi\|1786420 | (AE000131) f86; 100 pct identical to GB: ECODINJ_6 ACCESSION: D38582 [*Bacillus subtilis*] | 60 | 30 | 294 |
| 81 | 6 | 4073 | 4522 | gi\|147402 | mannose permease subunit III-Man [*Escherichia coli*] | 60 | 35 | 450 |
| 86 | 1 | 940 | 155 | gi\|143177 | putative [*Bacillus subtilis*] | 60 | 26 | 786 |
| 92 | 1 | 1 | 192 | gi\|396348 | homoserine transsuccinylase [*Escherichia coli*] | 60 | 45 | 192 |
| 93 | 14 | 10619 | 9384 | gi\|1788389 | (AE000297) o464; This 464 aa orf is 33 pct identical (9 gaps) to 331 residues of an approx. 416 aa protein MTRC_NEIGO SW: P43505 [*Escherichia coli*] | 60 | 27 | 1236 |
| 94 | 5 | 5548 | 8121 | gnl\|PID\|e329895 | (AJ000496) cyclic nucleotide-gated channel beta subunit [*Rattus norvegicus*] | 60 | 50 | 2574 |
| 97 | 7 | 5397 | 4533 | gi\|1591396 | transketolase' [*Methanococcus jannaschii*] | 60 | 43 | 864 |
| 102 | 2 | 2081 | 2833 | gnl\|PID\|e320929 | hypothetical protein [*Mycobacterium tuberculosis*] | 60 | 43 | 753 |
| 106 | 9 | 9773 | 9183 | gnl\|PID\|e334782 | YlbN protein [*Bacillus subtilis*] | 60 | 31 | 591 |
| 113 | 8 | 6361 | 6837 | gi\|466875 | nifU; BB1496_C1_157 [*Mycobacterium laprae*] | 60 | 43 | 477 |
| 115 | 2 | 2755 | 524 | gnl\|PID\|e328143 | (AJ000332) Glucosidase II [*Homo sapiens*] | 60 | 32 | 2232 |
| 122 | 7 | 4763 | 5068 | gnl\|PID\|d101876 | transposase [*Synechocystis sp.*] | 60 | 39 | 306 |
| 127 | 8 | 4510 | 5283 | gi\|1777938 | Pgm [*Treponema pallidum*] | 60 | 38 | 774 |
| 138 | 4 | 3082 | 2672 | gnl\|PID\|e325196 | hypothetical protein [*Bacillus subtilis*] | 60 | 36 | 411 |
| 139 | 1 | 177 | 4 | gnl\|PID\|d100680 | ORF [*Thermus thermophilus*] | 60 | 39 | 174 |
| 139 | 11 | 14520 | 13009 | gi\|537145 | ORF_f437 [*Escherichia coli*] | 60 | 30 | 1512 |
| 140 | 2 | 2592 | 1249 | gi\|1209527 | protein histidine kinase [*Enterococcus faecalis*] | 60 | 37 | 1344 |
| 141 | 1 | 210 | 1049 | gi\|463181 | E5 ORF from bp 3842 to 4081; putative [Human papillomavirus type 33] | 60 | 34 | 840 |
| 141 | 5 | 5368 | 6405 | gi\|145362 | tyrosine-sensitive DAHP synthase (aroF) [*Escherichia coli*] | 60 | 41 | 1038 |
| 142 | 6 | 3558 | 4049 | gi\|600711 | putative [*Bacillus subtilis*] | 60 | 37 | 492 |
| 148 | 10 | 7742 | 8713 | gnl\|PID\|e313022 | hypothetical protein [*Bacillus subtilis*] | 60 | 27 | 972 |
| 153 | 5 | 3667 | 4278 | gi\|2293322 | (AF008220) branch-chain amino acid transporter [*Bacillus subtilis*] | 60 | 42 | 612 |
| 155 | 1 | 1413 | 748 | gi\|2104504 | putative UDP-glucos dehydrogenase [*Escherichia coli*] | 60 | 40 | 666 |
| 158 | 3 | 3116 | 2472 | gnl\|PID\|d100872 | a negative regulator of pho regulon [*Pseudomonas aeruginosa*] | 60 | 37 | 645 |
| 159 | 3 | 778 | 3386 | gnl\|PID\|e308090 | product highly similar to *Bacillus anthracis* CapA [*Bacillus subtilis*] | 60 | 48 | 609 |
| 163 | 7 | 8049 | 8468 | gnl\|PID\|d101313 | YqeN [*Bacillus subtilis*] | 60 | 38 | 420 |
| 170 | 3 | 4130 | 2688 | gi\|1574179 | *H. influenzae* predicted coding region HI1244 [*Haemophilus influenzae*] | 60 | 39 | 1443 |
| 171 | 7 | 4717 | 5901 | gi\|606076 | ORF_o384 [*Escherichia coli*] | 60 | 44 | 1185 |
| 183 | 3 | 2440 | 2135 | gi\|1877427 | repressor [*Streptococcus pyogenes* phage T12] | 60 | 38 | 306 |
| 191 | 10 | 9444 | 8428 | gi\|415664 | catabolite control protein [*Bacillus megaterium*] | 60 | 42 | 1017 |
| 200 | 1 | 139 | 1083 | gi\|438462 | transmembrane protein [*Bacillus subtilis*] | 60 | 37 | 945 |
| 201 | 3 | 3895 | 1928 | gi\|475112 | enzyme IIabc [*Pediococcus pentosaceus*] | 60 | 39 | 1968 |
| 214 | 15 | 10930 | 10439 | gi\|1573407 | hypothetical [*Haemophilus influenzae*] | 60 | 39 | 492 |
| 218 | 4 | 2145 | 2363 | gi\|608520 | myosin heavy chain kinase A [*Dictyostelium discoideum*] | 60 | 31 | 219 |
| 226 | 4 | 2518 | 2351 | gi\|437705 | hyaluronidase [*Streptococcus pneumoniae*] | 60 | 53 | 168 |
| 242 | 1 | 725 | 3 | gi\|43938 | Sor regulator [*Klebsiella pneumoniae*] | 60 | 41 | 723 |
| 245 | 1 | 1 | 288 | gi\|304897 | EcoE type I restriction modification enzyme M subunit [*Escherichia coli*] | 60 | 56 | 288 |
| 251 | 1 | 905 | 45 | gi\|671632 | unknown [*Staphylococcus aureus*] | 60 | 36 | 861 |
| 259 | 1 | 969 | 82 | gi\|153794 | rgg [*Streptococcus gordonii*] | 60 | 32 | 888 |
| 260 | 2 | 1492 | 1662 | pir\|S31840\|S318 | probable transposase - *Bacillus stearothermophilus* | 60 | 26 | 171 |
| 274 | 1 | 836 | 96 | gi\|1592173 | N-ethylammeline chlorohydrolase [*Methanococcus jannaschii*] | 60 | 40 | 741 |
| 308 | 1 | 463 | 2 | gi\|1787397 | (AE000214) o157 [*Escherichia coli*] | 60 | 43 | 462 |
| 318 | 1 | 3 | 308 | gnl\|PID\|e137594 | xerC recombinase [*Lactobacillus leichmannii*] | 60 | 42 | 306 |
| 344 | 1 | 73 | 522 | gi\|509672 | repressor protein [Bacteriophage Tuc2009] | 60 | 32 | 450 |
| 5 | 1 | 576 | 4 | gi\|2293147 | (AF008220) YtxM [*Bacillus subtilis*] | 59 | 31 | 573 |
| 7 | 22 | 18140 | 17142 | gnl\|PID\|e280724 | unknown [*Mycobacterium tuberculosis*] | 59 | 39 | 999 |
| 10 | 1 | 1413 | 4 | gi\|1353880 | sialidase L [*Macrobdella decora*] | 59 | 41 | 1410 |
| 15 | 6 | 6463 | 5156 | gi\|580841 | F1 [*Bacillus subtilis*] | 59 | 35 | 1308 |
| 22 | 2 | 479 | 1393 | gi\|142469 | als operom regulatory protein [*Bacillus subtilis*] | 59 | 34 | 915 |
| 22 | 5 | 2698 | 4614 | gnl\|PID\|e280623 | PCPA [*Streptococcus pneumoniae*] | 59 | 44 | 1917 |
| 30 | 1 | 208 | 558 | gnl\|PID\|e233868 | hypothetical protein [*Bacillus subtilis*] | 59 | 37 | 351 |
| 30 | 4 | 3678 | 2455 | gnl\|PID\|e202290 | unknown [*Lactobacillus sake*] | 59 | 33 | 1224 |
| 35 | 13 | 12201 | 11071 | gnl\|PID\|e238664 | hypothetical protein [*Bacillus subtilis*] | 59 | 35 | 1131 |
| 35 | 14 | 13288 | 12182 | gi\|1657647 | Cap8H [*Staphylococcus aureus*] | 59 | 39 | 1107 |
| 36 | 18 | 18076 | 17897 | gi\|1500535 | *M. jannaschii* predicted coding region MJ1635 [*Methanococcus jannaschii*] | 59 | 33 | 180 |
| 38 | 12 | 6172 | 7137 | gi\|2293239 | (AF008220) YtxK [*Bacillus subtilis*] | 59 | 34 | 966 |
| 42 | 3 | 1952 | 3361 | gi\|1684845 | pinin [*Canis familiaris*] | 59 | 40 | 1410 |
| 50 | 3 | 2678 | 1728 | gnl\|PID\|d101329 | YqjK [*Bacillus subtilis*] | 59 | 41 | 951 |
| 56 | 5 | 1870 | 2388 | gnl\|PID\|e137594 | xerC recombinase [*Lactobacillus leichmannii*] | 59 | 41 | 519 |

TABLE 2-continued

S. pneumoniae - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 61 | 6 | 6812 | 5628 | gnl\|PID\|e311516 | aminotransferase [Bacillus subtilis] | 59 | 40 | 1185 |
| 67 | 5 | 2382 | 3023 | gi\|1146190 | 2-keto-3-deoxy-6-phosphogluconate aldolase [Bacillus subtilis] | 59 | 36 | 642 |
| 69 | 10 | 8567 | 8899 | gi\|1573628 | antothenate kinase (coaA) [Haemophilus influenzae] | 59 | 38 | 333 |
| 87 | 12 | 11383 | 10055 | gnl\|PID\|e323504 | putative Fmu protein [Bacillus subtilis] | 59 | 44 | 1325 |
| 113 | 14 | 13927 | 15894 | gi\|1673731 | (AE000010) Mycoplasma pneumoniae, fructose-permease IIBC component; similar to Swiss-Prot Accession Number P20966, from E. coli [Mycoplasma pneumoniae] | 59 | 43 | 1968 |
| 115 | 8 | 8766 | 8521 | gi\|1590886 | M. jannaschii predicted coding region MJ0110 [Methanococcus jannaschii] | 59 | 38 | 246 |
| 119 | 2 | 1966 | 1526 | gnl\|PID\|e209005 | homologous to ORF2 in nrdEF operons of E. coli and S. typhimurim [Lactococcus lactis] | 59 | 43 | 441 |
| 128 | 17 | 13438 | 13178 | gnl\|PID\|e279632 | unknown [Mycobacterium tuberculosis] | 59 | 38 | 261 |
| 140 | 22 | 23903 | 23388 | gi\|482922 | protein with homology to paiI repressor of B. subtilis [Lactobacillus delbrueckii] | 59 | 40 | 516 |
| 148 | 13 | 9697 | 9014 | gnl\|PID\|d102005 | (AB001488) FUNCTION UNKNOWN, SIMILAR PRODUCT IN H. INFLUENZAE AND SYNECHOCYSTIS. [Bacillus subtilis] | 59 | 32 | 684 |
| 149 | 10 | 7213 | 8244 | gi\|710422 | cmp-binding-factor 1 [Staphylococcus aureus] | 59 | 40 | 1032 |
| 164 | 9 | 6993 | 6013 | gnl\|PID\|d100965 | ferric anguibactin-binding protein precursor FabT of V. anguillarum [Bacillus subtilis] | 59 | 41 | 981 |
| 164 | 12 | 8836 | 7823 | gnl\|PID\|d100964 | homologue of ferric anguibactin transport system permease protein FatC of V. anguillarum [Bacillus subtilis] | 59 | 35 | 1014 |
| 177 | 2 | 401 | 1072 | gi\|289759 | coded for by C. elegans cDNA CE2G3 (GenBank:Z14728); putative [Caenorhabditis elegans] | 59 | 40 | 672 |
| 177 | 7 | 3841 | 4200 | gi\|2313445 | (AE000551) H. pylori predicted coding region HP0342 [Helicobacter pylori] | 59 | 38 | 360 |
| 183 | 4 | 2768 | 2508 | gi\|509672 | repressor protein [Bacteriophage Tuc2009] | 59 | 50 | 261 |
| 186 | 6 | 3398 | 2820 | gi\|606080 | ORF_o290; Geneplot suggests frameshift linking to o267, not found [Escherichia coli] | 59 | 38 | 579 |
| 190 | 3 | 3120 | 1711 | gi\|1613768 | histidine protein kinase [Streptococcus pneumoniae] | 59 | 32 | 1410 |
| 194 | 2 | 1621 | 1019 | gnl\|PID\|d100579 | unknown [Bacillus subtilis] | 59 | 40 | 603 |
| 198 | 7 | 5205 | 4306 | gnl\|PID\|e313073 | hypothetical protein [Bacillus subtilis] | 59 | 38 | 900 |
| 220 | 5 | 4362 | 3958 | gnl\|PID\|d101322 | YqhL [Bacillus subtilis] | 59 | 46 | 405 |
| 242 | 3 | 1573 | 2367 | gi\|1787045 | (AE000184) f308; This 308 aa orf is 35 pct identical (35 gaps) to 305 residues of an approx. 296 aa protein PFLC_ECOLI SW: P32675 [Escherichia coli] | 59 | 42 | 795 |
| 247 | 2 | 1154 | 1480 | gi\|40073 | ORF107 [Bacillus subtilis] | 59 | 39 | 327 |
| 256 | 1 | 868 | 2 | gnl\|PID\|d101924 | hemolysin [Synechocystis sp.] | 59 | 39 | 867 |
| 258 | 1 | 65 | 820 | gi\|2246532 | ORF 73, contains large complex repeat CR 73 (Kaposi's sarcoma-associated herpesvirus] | 59 | 20 | 756 |
| 270 | 1 | 386 | 1126 | gnl\|PID\|d102092 | YfnB [Bacillus subtilis] | 59 | 40 | 741 |
| 281 | 1 | 552 | 166 | gi\|666062 | putative [Lactococcus lactis] | 59 | 31 | 387 |
| 309 | 1 | 3 | 479 | gi\|405879 | yeiH [Escherichia coli] | 59 | 38 | 477 |
| 363 | 1 | 2 | 1894 | gi\|915208 | gastric mucin [Sus scrofa] | 59 | 31 | 1893 |
| 387 | 2 | 425 | 84 | gi\|160671 | S antigen precursor [Plasmodium falciparum] | 59 | 44 | 342 |
| 5 | 5 | 11223 | 10465 | gnl\|PID\|d101812 | LumQ [Synechocystis sp.] | 58 | 29 | 759 |
| 29 | 4 | 2098 | 3513 | gnl\|PID\|d100479 | Na+ -ATPase subunit J [Enterococcus hirae] | 58 | 39 | 1416 |
| 30 | 5 | 4058 | 3651 | gi\|39478 | ATP binding protein of transport ATPases [Bacillus firmus] | 58 | 34 | 408 |
| 33 | 6 | 2983 | 2210 | gnl\|PID\|d101164 | unknown [Bacillus subtilis] | 58 | 45 | 774 |
| 36 | 8 | 5316 | 6179 | gi\|1518679 | orf [Bacillus subtilis] | 58 | 32 | 864 |
| 43 | 5 | 5926 | 3971 | gi\|1788150 | (AE000278) protease II [Escherichia coli] | 58 | 37 | 1956 |
| 46 | 5 | 3704 | 5221 | gnl\|PID\|e267329 | Unknown [Bacillus subtilis] | 58 | 42 | 1518 |
| 48 | 14 | 11722 | 11066 | gnl\|PID\|d101771 | thiamin biosynthetic bifunctional enzyme [Synechocystis sp.] | 58 | 34 | 657 |
| 52 | 1 | 1229 | 3 | gnl\|PID\|d101291 | reductase [Pseudomonas aeruginosa] | 58 | 35 | 1227 |
| 53 | 2 | 702 | 412 | gi\|2313357 | (AE000545) cytochrome c biogenesis protein (ccdA) [Helicobacter pylori] | 58 | 25 | 291 |
| 58 | 4 | 6586 | 5498 | gi\|147329 | transport protein [Escherichia coli] | 58 | 41 | 1089 |
| 69 | 5 | 4934 | 3807 | gnl\|PID\|e311492 | unknown [Bacillus subtilis] | 58 | 41 | 1128 |
| 71 | 27 | 31357 | 32277 | gi\|2408014 | hypothetical protein [Schizosaccharomyces pombe] | 58 | 33 | 921 |
| 72 | 4 | 3586 | 2882 | gi\|18694 | nodulin-21 (AA 1–201) [Glycine max] | 58 | 34 | 705 |
| 74 | 3 | 4937 | 4230 | gi\|2293252 | (AF008220) YtmO [Bacillus subtilis] | 58 | 33 | 708 |
| 79 | 4 | 4594 | 3422 | gi\|1217989 | ORF3 [Streptococcus pneumoniae] | 58 | 44 | 1173 |
| 82 | 8 | 10585 | 8171 | gi\|882711 | exonuclease V alpha-subunit [Escherichia coli] | 58 | 38 | 2415 |
| 86 | 17 | 16017 | 15337 | gi\|47642 | 5-dehydroquinate hydrolyase (3-dehydroquinase) [Salmonella typhi] | 58 | 32 | 681 |
| 97 | 2 | 931 | 560 | gi\|153794 | rgg [Streptococcus gordonii] | 58 | 32 | 372 |
| 108 | 2 | 358 | 2724 | gi\|537020 | vacB gene product [Escherichia coli] | 58 | 37 | 2367 |
| 111 | 5 | 4593 | 5240 | gi\|1592142 | ABC transporter, probable ATP-binding subunit [Methanococcus jannaschii] | 58 | 36 | 648 |
| 120 | 3 | 4421 | 5110 | gnl\|PID\|d101320 | YqgX [Bacillus subtilis] | 58 | 47 | 690 |
| 128 | 16 | 13131 | 12673 | gi\|662919 | ORF U [Enterococcus hirae] | 58 | 42 | 459 |
| 132 | 3 | 6174 | 4939 | gi\|1800301 | macrolide-efflux determinant [Streptococcus pneumoniae] | 58 | 35 | 1236 |
| 133 | 1 | 111 | 890 | gnl\|PID\|e269488 | Unknown [Bacillus subtilis] | 58 | 36 | 780 |
| 160 | 11 | 8615 | 9865 | gi\|473901 | ORF1 [Lactococcus lactis] | 58 | 39 | 1251 |
| 161 | 6 | 6268 | 6849 | gnl\|PID\|d101024 | DJ-1 protein [Homo sapiens] | 58 | 32 | 582 |
| 169 | 1 | 214 | 2 | gnl\|PID\|d100447 | translation elongation factor-3 [Chlorella virus] | 58 | 31 | 213 |

TABLE 2-continued

*S. pneumoniae* - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 187 | 1 | 487 | 2 | gi\|475114 | regulatory protein [*Pediococcus pentosaceus*] | 58 | 38 | 486 |
| 187 | 6 | 4384 | 4620 | gi\|167475 | dessication-related protein [*Craterostigma plantagineum*] | 58 | 55 | 237 |
| 190 | 2 | 1464 | 1640 | gnl\|PID\|e246727 | competence pheromone [*Streptococcus gordonii*] | 58 | 38 | 177 |
| 192 | 2 | 2012 | 1344 | gnl\|PID\|d100556 | rat GCP360 [*Rattus rattus*] | 58 | 44 | 669 |
| 206 | 1 | 1292 | 696 | gnl\|PID\|e202579 | product similar to WrbA [*Lactobacillus sake*] | 58 | 35 | 597 |
| 216 | 2 | 2333 | 555 | gnl\|PID\|e325036 | hypothetical protein [*Bacillus subtilis*] | 58 | 33 | 1779 |
| 217 | 5 | 5250 | 4321 | gi\|466474 | cellobiose phosphotransferase enzyme II" [*Bacillus stearothermophilus*] | 58 | 38 | 930 |
| 217 | 7 | 5636 | 5106 | gnl\|PID\|d102048 | B. subtilis cellobiose phosphotransferase system celB; P46317 (998) transmembrane [*Bacillus subtilis*] | 58 | 44 | 531 |
| 232 | 1 | 2 | 811 | gi\|1573777 | cell division ATP-binding protein (ftsE) [*Haemophilus influenzae*] | 58 | 39 | 810 |
| 264 | 1 | 2 | 715 | gi\|973330 | NatA [*Bacillus subtilis*] | 58 | 32 | 714 |
| 280 | 1 | 33 | 767 | gi\|1786187 | (AE000111) hypothetical 29.6 kD protein in thrC-talB intergenic region [*Escherichia coli*] | 58 | 31 | 735 |
| 306 | 1 | 845 | 3 | gnl\|PID\|e334780 | YlbL protein [*Bacillus subtilis*] | 58 | 47 | 843 |
| 360 | 3 | 1556 | 1092 | sp\|P46351\|YZGD_ | HYPOTHETICAL 45.4 KD PROTEIN IN THIAMINASE I 5'REGION | 58 | 32 | 465 |
| 363 | 5 | 2160 | 1867 | gi\|160671 | S antigen precursor [*Plasmodium falciparum*] | 58 | 51 | 294 |
| 372 | 1 | 806 | 3 | gi\|393394 | Tb-291 membrane associated protein [*Trypanosoma brucei* subgroup] | 58 | 37 | 804 |
| 382 | 2 | 749 | 519 | pir\|JC1151\|JC11 | hypothetical 20.3K protein (insertion sequence IS1131) - *Agrobacterium tumefaciens* (strain PO22) plasmid Ti | 58 | 41 | 231 |
| 3 | 0 | 8409 | 7471 | gi\|1499745 | M. jannaschii predicted coding region MJ0912 [*Methanococcus jannaschii*] | 57 | 38 | 939 |
| 10 | 10 | 7674 | 7507 | gi\|1737169 | homologue to SKP1 [*Arabidopsis thaliana*] | 57 | 30 | 168 |
| 11 | 1 | 2 | 412 | gnl\|PID\|d100139 | ORF [*Acetobacter pasteurianus*] | 57 | 42 | 411 |
| 31 | 4 | 2032 | 1388 | gi\|2293213 | (AF008220) YtpR [*Bacillus subtilis*] | 57 | 37 | 645 |
| 33 | 11 | 6931 | 6449 | gnl\|PID\|e324949 | hypothetical protein [*Bacillus subtilis*] | 57 | 36 | 483 |
| 45 | 5 | 5446 | 5060 | gi\|1592204 | phosphoserine phosphatase [*Methanococcus jannaschii*] | 57 | 44 | 387 |
| 49 | 7 | 6523 | 7632 | gi\|155369 | PTS enzyme-II fructose [*Xanthomonas campestris*] | 57 | 35 | 1110 |
| 52 | 5 | 4520 | 6850 | gi\|1574144 | single-stranded-DNA-specific exonuclease (recJ) [*Haemophilus influenzae*] | 57 | 35 | 2331 |
| 53 | 5 | 2079 | 1795 | gi\|1843580 | replicase-associated polyprotein [oat blue dwarf virus] | 57 | 46 | 285 |
| 63 | 6 | 5312 | 4995 | gi\|2182608 | (AE000094) Yr4J [*Rhizobium sp.* NGR234] | 57 | 39 | 318 |
| 72 | 15 | 13883 | 13059 | gnl\|PID\|d100892 | homologous to SwissPrto:YIDA_ECOLI hypothetical protein [*Bacillus subtilis*] | 57 | 40 | 825 |
| 79 | 2 | 2561 | 1815 | gnl\|PID\|d100965 | homologue of NADPH-flavin oxidoreductase Frp of *V. harveyi* [*Bacillus subtilis*] | 57 | 44 | 747 |
| 82 | 9 | 9596 | 9763 | gi\|1206045 | short region of similarity to glycerophosphoryl diester phosphodiesterases [*Caenorhabditis elegans*] | 57 | 35 | 168 |
| 86 | 16 | 15371 | 14493 | gi\|1787983 | (AE000264) o288; 92 pct identical (1 gaps) to 222 residues of fragment YDIB_ECOLI SW: P28244 (223 aa) [*Escherichia coli*] | 57 | 34 | 879 |
| 93 | 3 | 1695 | 1177 | gi\|1500003 | mutator mutT protein [*Methanococcus jannaschii*] | 57 | 33 | 519 |
| 96 | 6 | 3026 | 4519 | gi\|559882 | threonine synthase [*Arabidopsis thaliana*] | 57 | 43 | 1494 |
| 99 | 14 | 17211 | 18212 | gi\|773349 | BirA protein [*Bacillus subtilis*] | 57 | 44 | 1002 |
| 112 | 8 | 7448 | 7903 | gi\|1591393 | M. jannaschii predicted coding region MJ0678 [*Methanococcus jannaschii*] | 57 | 30 | 456 |
| 113 | 16 | 18627 | 18328 | pir\|A45605\|A456 | mature-parasite-infected erythrocyte surface antigen MESA - *Plasmodium falciparum* | 57 | 22 | 300 |
| 123 | 2 | 343 | 1110 | pir\|F64149\|F641 | hypothetical protein HI0335 - *Haemophilus influenzae* (strain Rd KW20) | 57 | 38 | 768 |
| 123 | 4 | 2108 | 2884 | gnl\|PID\|d102148 | (AB001684) sulfate transport system permease protein [*Chlorella vulgaris*] | 57 | 39 | 777 |
| 127 | 10 | 6477 | 5587 | gi\|1573082 | nitrogenase C (nifC) [*Haemophilus influenzae*] | 57 | 35 | 891 |
| 128 | 13 | 9251 | 9790 | gi\|153692 | pneumolysin [*Streptococcus pneumoniae*] | 57 | 38 | 540 |
| 131 | 4 | 2139 | 1363 | gi\|42081 | nagD gene product (AA 1–250) [*Escherichia coli*] | 57 | 36 | 777 |
| 136 | 1 | 214 | 1221 | bbs\|148453 | SpA = endocarditis immunodominant antigen [*Streptococcus sorbinus*, MUCOB 263, Peptide, 1566 aa) [*Streptococcus sobrinus*] | 57 | 44 | 1008 |
| 140 | 25 | 28701 | 26851 | gi\|505576 | beta-glucoside permease [*Bacillus subtilis*] | 57 | 38 | 1851 |
| 141 | 6 | 6395 | 7438 | gi\|995560 | unknown [*Schizosaccharomyces pombe*] | 57 | 41 | 1044 |
| 144 | 3 | 3231 | 2785 | gnl\|PID\|d100139 | ORF [*Acetobacter pasteurianus*] | 57 | 42 | 447 |
| 155 | 4 | 5454 | 4564 | gi\|600431 | glycosyl transerase [*Erwinia amylovora*] | 57 | 34 | 891 |
| 159 | 9 | 4877 | 5854 | gi\|290509 | o307 [*Escherichia coli*] | 57 | 35 | 978 |
| 167 | 11 | 9710 | 9429 | gnl\|PID\|d100139 | ORF [*Acetobacter pasteurianus*] | 57 | 42 | 462 |
| 171 | 6 | 4023 | 4436 | gi\|147402 | mannose permease subunit III-Man [*Escherichia coli*] | 57 | 29 | 414 |
| 178 | 4 | 2170 | 1076 | gnl\|PID\|d102004 | (AB001488) ATP-DEPENDENT RNA HELICASE DEAD HOMOLOG. [*Bacillus subtilis*] | 57 | 39 | 1095 |
| 190 | 1 | 145 | 1455 | gi\|149420 | export/processing protein [*Lactococcus lactis*] | 57 | 30 | 1311 |
| 198 | 1 | 298 | 95 | gi\|522268 | unidentified ORF22 [Bacteriophage bIL67] | 57 | 36 | 204 |
| 203 | 2 | 3195 | 2110 | gnl\|PID\|e283915 | orf c01003 [*Sulfolobus solfataricus*] | 57 | 41 | 1086 |
| 205 | 1 | 40 | 507 | gi\|1439527 | EIIA-man [*Lactobacillus curvatus*] | 57 | 28 | 468 |
| 214 | 7 | 4243 | 3797 | gnl\|PID\|d102049 | H. influenzae, ribosomal protein alanine acetyltransferase; P44305 (189) [*Bacillus subtilis*] | 57 | 48 | 447 |
| 268 | 3 | 1767 | 1276 | gi\|43979 | L. curvatus small cryptic plasmid gene for rep protein [*Lactobacillus curvatus*] | 57 | 36 | 492 |

TABLE 2-continued

S. pneumoniae - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 351 | 1 | 324 | 34 | gnl\|PID\|e275871 | T03F6.b [Caenorhabditis elegans] | 57 | 31 | 291 |
| 386 | 1 | 226 | 2 | gi\|160671 | S antigen precursor [Plasmodium falciparum] | 57 | 45 | 225 |
| 5 | 5 | 10486 | 8777 | gi\|405857 | yehU [Escherichia coli] | 56 | 33 | 1710 |
| 8 | 5 | 3674 | 3910 | gi\|467199 | pksC; L518__F1__2 [Mycobacterium laprae] | 56 | 39 | 237 |
| 10 | 3 | 3442 | 1874 | gnl\|PID\|d101907 | sodium-coupled permease [Synechocystis sp.] | 56 | 36 | 1569 |
| 21 | 1 | 1880 | 333 | gi\|2313949 | (AE000593) osmoprotection protein (proWX) [Helicobacter pylori] | 56 | 33 | 1548 |
| 22 | 29 | 21968 | 22456 | gnl\|PID\|d102001 | (AB001488) PROBABLE ACETYLTRANSFERASE. [Bacillus subtilis] | 56 | 37 | 489 |
| 27 | 1 | 1361 | 3 | gi\|215132 | ea59 (525) [Bacteriophage lambda] | 56 | 30 | 1359 |
| 28 | 9 | 4667 | 4278 | gi\|1592090 | DNA repair protein RAD2 [Methanococcus jannaschii] | 56 | 29 | 390 |
| 33 | 1 | 3 | 386 | gnl\|PID\|d100139 | ORF [Acetobacter pasteurianus] | 56 | 41 | 384 |
| 36 | 7 | 5122 | 5397 | pir\|PQ0053\|PQ00 | hypothetical protein (proC 3' region) - Pseudomonas aeruginosa (strain PAO) (fragment) | 56 | 28 | 276 |
| 40 | 4 | 3137 | 4318 | gi\|1800301 | macrolide-efflux determinate [Streptococcus pneumoniae] | 56 | 27 | 1182 |
| 40 | 16 | 12511 | 13191 | gnl\|PID\|e217602 | PlnU [Lactobacillus plantarum] | 56 | 38 | 681 |
| 48 | 17 | 13775 | 13023 | gi\|143729 | transcription activator [Bacillus subtilis] | 56 | 35 | 753 |
| 75 | 4 | 1674 | 2594 | gnl\|PID\|d102036 | membrane protein [Bacillus stearothermophilus] | 56 | 25 | 921 |
| 85 | 3 | 1842 | 1459 | gnl\|PID\|d100139 | ORF [Acetobacter pasteurianus] | 56 | 41 | 384 |
| 89 | 7 | 5815 | 4940 | gi\|853777 | product similar to E. coli PRFA2 protein [Bacillus subtilis] | 56 | 42 | 876 |
| 105 | 2 | 1360 | 2718 | gnl\|PID\|d101913 | hypothetical protein [Synechocystis sp.] | 56 | 37 | 1359 |
| 112 | 3 | 2151 | 3194 | gi\|537201 | ORF_o345 [Escherichia coli] | 56 | 31 | 1044 |
| 113 | 4 | 2754 | 2963 | gnl\|PID\|d100340 | ORF [Plum pox virus] | 56 | 28 | 210 |
| 122 | 3 | 1203 | 2054 | gi\|1649035 | high-affinity periplasmic glutamine binding protein [Salmonella typhimurium] | 56 | 30 | 852 |
| 124 | 8 | 3939 | 3694 | gnl\|PID\|e248893 | unknown [Mycobacterium tuberculosis] | 56 | 27 | 246 |
| 125 | 4 | 4403 | 4107 | gnl\|PID\|d100247 | human non-muscle myosin heavy chain [Homo sapiens] | 56 | 32 | 297 |
| 127 | 11 | 6608 | 6405 | gi\|2182397 | (AE000073) Y4fN [Rhizobium sp. NGR234] | 56 | 35 | 204 |
| 134 | 5 | 4769 | 3849 | gnl\|PID\|d101870 | hypothetical protein [Synechocystis sp.] | 56 | 39 | 921 |
| 137 | 10 | 6814 | 7245 | gi\|1592011 | sulfate permease (cysA) [Methanococcus jannaschii] | 56 | 34 | 432 |
| 142 | 8 | 5019 | 4582 | pir\|A47071\|A470 | orf1 immediately 5' of nifS - Bacillus subtilis | 56 | 29 | 438 |
| 146 | 8 | 4676 | 3660 | gnl\|PID\|d101911 | hypothetical protein [Synechocystis sp.] | 56 | 32 | 1017 |
| 148 | 3 | 1906 | 2739 | gnl\|PID\|d101099 | phosphate transport system permease protein PstA [Synechocystis sp.] | 56 | 36 | 834 |
| 150 | 4 | 4449 | 2743 | gnl\|PID\|e304628 | probably site-specific recombinase of the resolvase family enzyme [Bacteriophage TP21] | 56 | 27 | 1707 |
| 172 | 1 | 2 | 208 | gi\|1787791 | (AE000249) f317; This 317 aa orf is 27 pct identical (16 gaps) to 301 residues of an approx. 320 as protein YXXC__BACSU SW: P39140 [Escherichia coli] | 56 | 34 | 207 |
| 172 | 7 | 4979 | 5668 | gi\|396293 | similar to Bacillus subtilis hypoth. 20 kDa protein, in tsr 3' region [Escherichia coli] | 56 | 40 | 690 |
| 186 | 7 | 3732 | 3367 | gi\|1732200 | PTS permease for mannose subunit IIPMan [Vibrio furnissii] | 56 | 36 | 366 |
| 187 | 2 | 2402 | 819 | pir\|S5790451 S579 | virR49 protein - Streptococcus pyogenes (strain CS101, serotype M49) | 56 | 35 | 1584 |
| 204 | 3 | 2772 | 2239 | gi\|606376 | ORF_o162 [Escherichia coli] | 56 | 35 | 534 |
| 206 | 2 | 3342 | 1633 | gi\|559861 | clyM [Plasmid pAD1] | 56 | 38 | 1710 |
| 219 | 3 | 1689 | 1096 | gi\|1146197 | putative [Bacillus subtilis] | 56 | 27 | 594 |
| 230 | 2 | 409 | 1485 | pir\|C60328\|C603 | hypothetical protein 2 (sr 5' region) - Streptococcus mutans (strain OMZ175, serotype f) | 56 | 40 | 1077 |
| 233 | 4 | 2930 | 3268 | gi\|1041785 | rhoptry protein [Plasmodium yoelii] | 56 | 24 | 339 |
| 273 | 2 | 1543 | 2724 | gi\|143089 | iep protein [Bacillus subtilis] | 56 | 32 | 1182 |
| 353 | 1 | 1 | 516 | gnl\|PID\|e325000 | hypothetical protein [Bacillus subtilis] | 56 | 41 | 516 |
| 359 | 1 | 87 | 641 | gi\|1786952 | (AE000176) o877; 100 pct identical to the first 86 residues of the 100 aa hypothetical protein fragment YBGB_ECOLI SW: P54746 [Escherichia coli] | 56 | 35 | 555 |
| 363 | 7 | 4482 | 4198 | gi\|1573353 | outer membrane integrity protein (tolA) [Haemophilus influenzae] | 56 | 38 | 285 |
| 376 | 1 | 2 | 508 | gnl\|PID\|e325031 | hypothetical protein [Bacillus subtilis] | 56 | 33 | 507 |
| 18 | 1 | 836 | 177 | gnl\|PID\|d100872 | a negative regulator of pho regulon [Pseudomonas aeruginosa] | 55 | 31 | 660 |
| 28 | 4 | 1824 | 1618 | gnl\|PID\|e316518 | STAT protein [Dicytostelium discoideum] | 55 | 40 | 207 |
| 29 | 6 | 4496 | 5041 | gi\|1088261 | unknown protein [Anabaena sp.] | 55 | 31 | 546 |
| 38 | 16 | 9695 | 10702 | gi\|580905 | B. subtilis genes rpmH, rnpA, 50kd, gidA and gibB [Bacillus subtilis] | 55 | 31 | 1008 |
| 49 | 5 | 5727 | 6182 | gi\|1786951 | (AE000176) heat-responsive regulatory protein [Escherichia coli] | 55 | 29 | 456 |
| 51 | 4 | 2381 | 3241 | gnl\|PID\|d101293 | YbbA [Bacillus subtilis] | 55 | 42 | 861 |
| 52 | 9 | 9640 | 10866 | gi\|153016 | ORF 419 protein [Staphylococcus aureus] | 55 | 23 | 1227 |
| 53 | 4 | 1813 | 1349 | gi\|896042 | OspF [Borrelia burgdorferi] | 55 | 30 | 465 |
| 60 | 5 | 4794 | 5756 | gi\|1499876 | magnesium and cobalt transport protein [Methanococcus jannaschii] | 55 | 38 | 963 |
| 71 | 9 | 14176 | 15408 | gi\|1857120 | glycosyl transferase [Neisseria meningitidis] | 55 | 41 | 1233 |
| 75 | 5 | 3189 | 4229 | gnl\|PID\|e108780 | NAD alcohol dehydrogenase [Bacillus subtilis] | 55 | 44 | 1041 |
| 108 | 10 | 10488 | 9820 | gnl\|PID\|e324997 | hypothetical protein [Bacillus subtilis] | 55 | 36 | 669 |
| 113 | 12 | 12273 | 13037 | gnl\|PID\|e311496 | unknown [Bacillus subtilis] | 55 | 34 | 765 |
| 113 | 13 | 13007 | 13945 | gi\|1573423 | 1-phosphofructokinase (fruK) [Haemophilus influenzae] | 55 | 39 | 939 |
| 126 | 5 | 6764 | 5907 | gi\|1790131 | (AE000446) hypothetical 29.7 kD protein in ibpA-gyrB intergenic region [Escherichia coli] | 55 | 37 | 858 |
| 129 | 3 | 2719 | 902 | gnl\|PID\|d101425 | Pz-peptidase [Bacillus licheniformis] | 55 | 35 | 1818 |
| 138 | 3 | 2593 | 1610 | gi\|142833 | ORF2 [Bacillus subtilis] | 55 | 37 | 984 |

TABLE 2-continued

_S. pneumoniae_ - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 140 | 6 | 6916 | 5633 | gnl\|PID\|d100964 | homologue of hypothetical protein in a rapamycin synthesis gene cluster of Streptomyces hygroscopicus [Bacillus subtilis] | 55 | 26 | 1284 |
| 147 | 3 | 3854 | 2136 | gi\|472330 | dihydrolipoamide dehydrogenase [Clostridium magnum] | 55 | 39 | 1719 |
| 147 | 10 | 10204 | 8921 | gnl\|PID\|e73078 | dihydroorotase [Lactobacillus leichmannii] | 55 | 38 | 1284 |
| 148 | 5 | 3430 | 4119 | gi\|290572 | peripheral membrane protein U [Escherichia coli] | 55 | 29 | 690 |
| 148 | 6 | 4171 | 4650 | gi\|695769 | transposase [Xanthobacter autotrophicus] | 55 | 37 | 480 |
| 149 | 14 | 12564 | 11650 | gnl\|PID\|d101329 | YqjG [Bacillus subtilis] | 55 | 32 | 915 |
| 156 | 3 | 1113 | 550 | gi\|2314496 | (AE000634) conserved hypothetical integral membrane protein [Helicobacter pylori] | 55 | 34 | 564 |
| 159 | 10 | 6625 | 5897 | gi\|290533 | similar to E. coli ORF adjacent to suc operon; similar to gntH class of regulatory proteins [Escherichia coli] | 55 | 29 | 729 |
| 164 | 3 | 1784 | 2332 | gnl\|PID\|e255118 | hypothetical protein [Bacillus subtilis] | 55 | 37 | 549 |
| 164 | 5 | 2772 | 3521 | gi\|40348 | put. resolvase Tnp I (AA 1–284) [Bacillus thuringiensis] | 55 | 35 | 750 |
| 164 | 11 | 7428 | 7216 | gnl\|PID\|e249407 | unknown [Mycobacterium tuberculosis] | 55 | 38 | 213 |
| 167 | 5 | 3860 | 3345 | gi\|535052 | involved in protein secretion [Bacillus subtilis] | 55 | 28 | 516 |
| 186 | 5 | 2880 | 2563 | gi\|606080 | ORF_o290; Geneplot suggests frameshift linking to o267, not found [Escherichia coli] | 55 | 35 | 318 |
| 189 | 8 | 4311 | 5396 | gnl\|PID\|e183450 | hypothetical EcsB protein [Bacillus subtilis] | 55 | 32 | 1086 |
| 192 | 5 | 3270 | 3079 | gi\|1196504 | vitellogenin convertase [Aedes aegypti] | 55 | 38 | 192 |
| 195 | 2 | 2454 | 1384 | gi\|1574693 | transferase, peptidoglycan synthesis (murG) [Haemophilus influenzae] | 55 | 33 | 1071 |
| 198 | 4 | 3013 | 2471 | gnl\|PID\|e313074 | hypothetical protein [Bacillus subtilis] | 55 | 29 | 543 |
| 214 | 1 | 373 | 744 | gnl\|PID\|d101741 | transposase [Synechocystis sp.] | 55 | 33 | 372 |
| 219 | 2 | 1115 | 456 | gi\|288301 | ORF2 gene product [Bacillus megaterium] | 55 | 30 | 660 |
| 263 | 7 | 3742 | 3443 | gi\|18137 | cgcr-4 product [Chlamydomonas reinhardtii] | 55 | 48 | 300 |
| 285 | 1 | 2 | 829 | gnl\|PID\|d100974 | unknown [Bacillus subtilis] | 55 | 40 | 828 |
| 286 | 1 | 650 | 249 | gi\|396844 | ORF (18 kDa) [Vibrio cholerae] | 55 | 31 | 402 |
| 297 | 2 | 1229 | 1696 | gi\|150848 | prtc [Porphyromonas gingivalis] | 55 | 39 | 468 |
| 309 | 2 | 218 | 982 | gi\|1574491 | hypothetical [Haemophilus influenzae] | 55 | 35 | 765 |
| 328 | 2 | 646 | 224 | gi\|571500 | prohibition [Saccharomyces cerevisiae] | 55 | 27 | 423 |
| 330 | 1 | 1340 | 474 | gi\|396397 | soxS [Escherichia coli] | 55 | 29 | 867 |
| 364 | 3 | 2538 | 1546 | gi\|393394 | Tb-291 membrane associated protein [Trypanosoma brucei subgroup] | 55 | 36 | 993 |
| 368 | 3 | 941 | 105 | gi\|160671 | S antigen precursor [Plasmodium falciparum] | 55 | 40 | 837 |
| 3 | 5 | 4604 | 3624 | gi\|2293176 | (AF008220) signal transduction protein kinase [Bacillus subtilis] | 54 | 26 | 981 |
| 9 | 11 | 7746 | 7246 | gi\|1146245 | putative [Bacillus subtilis] | 54 | 38 | 501 |
| 38 | 24 | 16213 | 17937 | gi\|1480429 | putative transcriptional regulator [Bacillus stearothermophilus] | 54 | 27 | 1725 |
| 40 | 8 | 5076 | 4882 | gi\|39989 | methionyl-tRNA synthetase [Bacillus stearothermophilus] | 5 | 35 | 195 |
| 43 | 4 | 3980 | 2367 | gnl\|PID\|e148611 | ABC transporter [Lactobacillus helveticus] | 54 | 25 | 1614 |
| 52 | 10 | 10844 | 12103 | gi\|1762962 | FemA [Staphylococcus simulans] | 54 | 29 | 1260 |
| 57 | 1 | 3 | 512 | gi\|558177 | endo-1,4-beta-xylanase [Cellulomonas fimi] | 54 | 36 | 510 |
| 58 | 3 | 4749 | 4246 | gnl\|PID\|d101237 | hypothetical [Bacillus subtilis] | 54 | 29 | 504 |
| 71 | 7 | 10684 | 11703 | gi\|510255 | orf3 [Escherichia coli] | 54 | 31 | 1020 |
| 71 | 20 | 27546 | 27737 | gi\|202543 | serotonin receptor [Rattus novegicus] | 54 | 31 | 192 |
| 72 | 2 | 844 | 1098 | gi\|148613 | arnB gene product [Plasmid F] | 54 | 37 | 255 |
| 72 | 7 | 7438 | 6695 | gi\|1196496 | recombinase [Moraxella bovis] | 54 | 38 | 744 |
| 74 | 10 | 14043 | 13465 | gi\|1200342 | ORF 3 gene product [Bradyrhizobium japonicum] | 54 | 32 | 579 |
| 74 | 12 | 16483 | 15995 | gi\|2317798 | maturase-related protein [Pseudomonas alcaligenes] | 54 | 30 | 489 |
| 86 | 3 | 2877 | 2155 | gi\|46988 | orf9.6 possibly encodes the O unit polymerase [Salmonella enterica] | 54 | 34 | 723 |
| 89 | 5 | 4433 | 3921 | gi\|147211 | phnO protein [Escherichia coli] | 54 | 41 | 513 |
| 90 | 1 | 3 | 464 | gi\|2317798 | maturase-related protein [Pseudomonas alcaligenes] | 54 | 30 | 462 |
| 96 | 10 | 8058 | 8510 | gnl\|PID\|d102015 | (AB001488) SIMILAR TO SALMONELLA TYPHIMURIUM SLYY GENE REQUIRED FOR SURVIVAL IN MACROPHAGE. [Bacillus subtilis] | 54 | 32 | 453 |
| 97 | 6 | 4662 | 3604 | gi\|1591394 | transketolase" [Methanococcus jannaschii] | 54 | 30 | 1059 |
| 106 | 11 | 10406 | 12010 | gi\|1606286 | ORD_o637 [Escherichia coli] | 54 | 32 | 1605 |
| 147 | 8 | 8663 | 7404 | gnl\|PID\|d101615 | ORF_ID:o319#7; similar to (SwissProt Accession Number P37340) [Escherichia coli] | 54 | 35 | 1260 |
| 171 | 4 | 2477 | 3223 | gi\|1439528 | EIIC-man [Lactobacillus curvatus] | 54 | 36 | 747 |
| 174 | 2 | 2068 | 1787 | gnl\|PID\|d100518 | motor protein [Homo sapiens] | 54 | 35 | 282 |
| 188 | 1 | 526 | 1188 | gnl\|PID\|e250352 | unknown [Mycobacterium tuberculosis] | 54 | 31 | 663 |
| 198 | 5 | 3582 | 2884 | gnl\|PID\|e313074 | hypothetical protein [Bacillus subtilis] | 54 | 33 | 699 |
| 207 | 1 | 1 | 1641 | gnl\|PID\|d101813 | hypothetical protein [Synechocystis sp.] | 54 | 24 | 1641 |
| 210 | 1 | 2 | 655 | gi\|2293206 | (AF008220) YtmP [Bacillus subtilis] | 54 | 29 | 654 |
| 225 | 2 | 966 | 2357 | gnl\|PID\|e330194 | R11H6.1 [Caenorhabditis elegans] | 54 | 39 | 1392 |
| 241 | 1 | 1681 | 347 | gnl\|PID\|d101813 | hypothetical protein [Synechocystis sp.] | 54 | 26 | 1335 |
| 263 | 2 | 907 | 1395 | gnl\|PID\|d101886 | transposase [Synechocystis sp.] | 54 | 30 | 489 |
| 263 | 6 | 3450 | 2977 | gi\|160671 | S antigen precursor [Plasmodium falciparum] | 54 | 47 | 474 |
| 277 | 3 | 2517 | 1363 | gi\|1196926 | unknown protein [Streptococcus mutans] | 54 | 30 | 1155 |
| 307 | 1 | 828 | 4 | gi\|2293198 | (AF008220) YtgP [Bacillus subtilis] | 54 | 28 | 825 |
| 325 | 1 | 19 | 768 | gi\|2182507 | (AE000083) Y41H (Rhizobium sp. NGR234) | 54 | 37 | 750 |
| 332 | 2 | 898 | 590 | gi\|1591815 | ADP-ribosylglycohydrolase (draG) [Methanococcus jannaschii] | 54 | 32 | 309 |
| 385 | 4 | 240 | 479 | gi\|530878 | amino acid feature: N-glycosylation sites, aa 41 . . . 43, 46 . . . 48, 51 . . . 53, 72 . . . 74, 107 . . . 109, 128 . . . 130, 132 . . . 143, | 54 | 49 | 240 |

TABLE 2-continued

*S. pneumoniae* - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 7 | 25 | 19702 | 19493 | gnl\|PID\|e255111 | 158 . . . 160, 153 . . . 165, amino acid feature: Rod protein domain, aa 169 . . . 340; amino acid feature: globular protein domai hyptothetical protein [*Bacillus subtilis*] | 53 | 32 | 210 |
| 23 | 3 | 2497 | 2033 | gnl\|PID\|d102015 | (AB001488) SIMILAR TO *SALMONELLA TYPHIMURIUM* SLYY GENE REQUIRED FOR SURVIVAL IN MACROPHAGE. [*Bacillus subtilis*] | 53 | 25 | 465 |
| 29 | 11 | 9042 | 10121 | gi\|143331 | alkaline phosphatase regulatory protein [*Bacillus subtilis*] | 53 | 31 | 1080 |
| 33 | 3 | 1479 | 1009 | pir\|S10655\|S106 | hypothetical protein X - *Pyrococcus woesei* (fragment) | 53 | 33 | 471 |
| 36 | 6 | 4583 | 5134 | gnl\|PID\|e316029 | unknown [*Mycobacterium tuberculosis*] | 53 | 30 | 552 |
| 38 | 14 | 8521 | 8898 | gi\|580904 | homologous to E. coli rnpA [*Bacillus subtilis*] | 53 | 30 | 378 |
| 52 | 7 | 7007 | 8686 | gi\|1377831 | unknown [*Bacillus subtilis*] | 53 | 29 | 1680 |
| 54 | 17 | 17555 | 19564 | gi\|666069 | orf2 gene product [*Lactobacillus leichmannii*] | 53 | 36 | 2010 |
| 56 | 1 | 1 | 681 | gi\|1592266 | restriction modification system S subunit [*Methanococcus jannaschii*] | 53 | 32 | 681 |
| 57 | 10 | 9431 | 8487 | gi\|1788543 | (AE000310) f351; Residues 1–121 are 100 pct identical to YOJL_ECOLI SW; P33944 (122 aa) and aa 152–351 are 100 pct identical to YOJK_ECOLI SW; P33943 [*Escherichia coli*] | 53 | 31 | 945 |
| 61 | 1 | 429 | 4 | gnl\|PID\|e236467 | B0024.13 [*Caenorhabditis elegans*] | 53 | 33 | 426 |
| 71 | 1 | 5772 | 4 | gi\|393394 | Tb-291 membrane associated protein [*Trypanosoma brucei* subgroup] | 53 | 33 | 5769 |
| 72 | 3 | 894 | 2840 | gi\|2293178 | (AF008220) YtsD [*Bacillus subtilis*] | 53 | 27 | 1947 |
| 73 | 14 | 9793 | 9212 | gi\|1778556 | putative cobalamin synthesis protein [*Escherichia coli*] | 53 | 32 | 582 |
| 88 | 7 | 5217 | 4342 | gi\|2098719 | putative fimbrial-associated protein [*Actinomyces naeslundii*] | 53 | 38 | 876 |
| 93 | 5 | 2395 | 1688 | gi\|563366 | gluconate oxidoreductase [*Gluconobacter oxydans*] | 53 | 33 | 708 |
| 96 | 9 | 6632 | 7762 | gi\|517204 | ORF1, putative 42 kDa protein [*Streptococcus pyogenes*] | 53 | 42 | 1131 |
| 108 | 8 | 7629 | 8600 | gi\|149581 | maturation protein [*Lactobacillus paracasei*] | 53 | 32 | 972 |
| 128 | 9 | 6412 | 6972 | gnl\|PID\|e317237 | unknown [*Mycobacterium tuberculosis*] | 53 | 36 | 561 |
| 128 | 12 | 8429 | 9253 | gi\|311070 | pentraxin fusion protein [*Xenopus laevis*] | 53 | 31 | 825 |
| 14 | 1 | 3 | 950 | pir\|A61607\|A616 | probable hemolysin precursor - *Streptococcus agalactiae* (strain 74–360) | 53 | 36 | 948 |
| 163 | 2 | 2162 | 3022 | gi\|1755150 | nocturnin [*Xenopus laevis*] | 53 | 30 | 861 |
| 171 | 3 | 2304 | 2624 | gi\|1732200 | PTS permease for mannose subunit IIPMan [*Vibrio furnissii*] | 53 | 32 | 321 |
| 182 | 5 | 3785 | 3051 | gnl\|PID\|d100572 | unknown [*Bacillus subtilis*] | 53 | 35 | 735 |
| 209 | 3 | 2948 | 1935 | gi\|1778505 | ferric enterobactin transport protein [*Escherichia coli*] | 53 | 28 | 1014 |
| 218 | 5 | 3884 | 2406 | gi\|140162 | murE gene product [*Bacillus subtilis*] | 53 | 34 | 1479 |
| 250 | 3 | 473 | 790 | gnl\|PID\|e334776 | YlbH protein [*Bacillus subtilis*] | 53 | 30 | 318 |
| 275 | 1 | 1 | 1611 | gnl\|PID\|d101314 | YqeW [*Bacillus subtilis*] | 53 | 35 | 1611 |
| 332 | 1 | 544 | 2 | gi\|409286 | bmrU [*Bacillus subtilis*] | 53 | 31 | 543 |
| 2 | 2 | 2543 | 3445 | gnl\|PID\|e233879 | hypothetical protein [*Bacillus subtilis*] | 52 | 39 | 903 |
| 3 | 22 | 22402 | 23376 | gi\|38969 | lacF gene product [*Agrobacterium radiobacter*] | 52 | 36 | 975 |
| 5 | 3 | 8094 | 2356 | gnl\|PID\|e324915 | IgA1 protease [*Streptococcus sanguis*] | 52 | 32 | 5739 |
| 22 | 26 | 19961 | 20212 | gi\|152901 | ORF 3 [*Spirochaeta aurantia*] | 52 | 35 | 252 |
| 22 | 31 | 23140 | 24666 | gi\|289262 | comE ORF3 [*Bacillus subtilis*] | 52 | 32 | 1527 |
| 27 | 6 | 5397 | 4801 | gi\|39573 | P20 (AA 1–178) [*Bacillus licheniformis*] | 52 | 35 | 597 |
| 35 | 10 | 8604 | 7357 | gi\|508241 | putative O-antigen transporter [*Escherichia coli*] | 52 | 27 | 1248 |
| 45 | 4 | 4801 | 3662 | gnl\|PID\|d102243 | (AB005554) homologs are found in E. coli and H. influenzae; see SWISS_PROT ACC#: P42100 [*Bacillus subtilis*] | 52 | 36 | 1140 |
| 48 | 18 | 14385 | 13726 | gnl\|PID\|e205174 | orf2 [*Lactobacillus helveticus*] | 52 | 25 | 660 |
| 49 | 4 | 5321 | 5755 | gi\|2317740 | (AF013987) nitrogen regulatory IIA protein [*Vibrio cholerae*] | 52 | 19 | 435 |
| 54 | 4 | 2773 | 4668 | gi\|1500472 | *M. jannaschii* predicted coding region MJ1577 [*Methanococcus jannaschii*] | 52 | 36 | 1896 |
| 54 | 6 | 5250 | 4969 | gi\|2182453 | (AE000079) Y4iO [*Rhizobium* sp. NGR234] | 52 | 40 | 282 |
| 66 | 6 | 8400 | 6955 | gi\|43140 | TrkG protein [*Escherichia coli*] | 52 | 30 | 1446 |
| 71 | 26 | 30659 | 31312 | gnl\|PID\|e314993 | unknown [*Mycobacterium tuberculosis*] | 52 | 23 | 654 |
| 75 | 2 | 1673 | 1035 | gnl\|PID\|d102271 | (AB001683) FarA [*Streptomyces* sp.] | 52 | 27 | 639 |
| 81 | 3 | 1439 | 2893 | gnl\|PID\|e311458 | rhamnulose kinase [*Bacillus subtilis*] | 52 | 32 | 1455 |
| 81 | 8 | 4987 | 5781 | gi\|147403 | mannose permease subunit II-P-Man [*Escherichia coli*] | 52 | 37 | 795 |
| 83 | 21 | 20687 | 21853 | gi\|143365 | phosphoribosyl aminoimidazole carboxylase II (PUR-K; ttg start codon) [*Bacillus subtilis*] | 52 | 37 | 1167 |
| 86 | 6 | 5785 | 4592 | gi\|1276879 | EpsF [*Streptococcus thermophilus*] | 52 | 26 | 1194 |
| 86 | 20 | 19390 | 17861 | gi\|454844 | ORF 3 [*Schistosoma mansoni*] | 52 | 26 | 1530 |
| 96 | 13 | 10540 | 9659 | gi\|288299 | ORF1 gene product [*Bacillus megaterium*] | 52 | 33 | 882 |
| 111 | 1 | 2 | 2026 | gi\|148309 | cytolysin B transport protein [*Enterococcus faecalis*] | 52 | 27 | 2025 |
| 112 | 2 | 1457 | 2167 | gi\|471234 | orf1 [*Haemophilus influenzae*] | 52 | 33 | 711 |
| 118 | 3 | 2931 | 2365 | bbs\|151233 | Mip = 24 kda macrophage infectivity potentiator protein [*Legionella pneumophila*, Philadelphia-1, Peptide, 184 aa] [*Legionella pneumophila*] | 52 | 33 | 567 |
| 122 | 9 | 5646 | 5951 | gi\|8214 | myosin heavy chain [*Drosophila melanogaster*] | 52 | 36 | 306 |
| 122 | 11 | 6159 | 6374 | gi\|434025 | dihydrolipoamide acetyltransferase [*Pelobacter carinolicus*] | 52 | 52 | 216 |
| 134 | 6 | 4880 | 6313 | gi\|153733 | M protein trans-acting positive regulator [*Streptococcus pyogenes*] | 52 | 43 | 1434 |
| 135 | 3 | 1238 | 2716 | gnl\|PID\|e245024 | unknown [*Mycobacterium tuberculosis*] | 52 | 35 | 1479 |
| 141 | 3 | 1681 | 2319 | gnl\|PID\|d100573 | unknown [*Bacillus subtilis*] | 52 | 32 | 639 |
| 161 | 4 | 2562 | 5024 | gi\|1146243 | 22.4% identity with *Escherichia coli* DNA-damage inducible protein . . . ; putative [*Bacillus subtilis*] | 52 | 36 | 2463 |
| 173 | 2 | 968 | 183 | gi\|1215693 | putative orf; GT9_orf434 [*Mycoplasma pneumoniae*] | 52 | 30 | 786 |
| 198 | 6 | 4400 | 3567 | gnl\|PID\|e313010 | hypothetical protein [*Bacillus subtilis*] | 52 | 26 | 834 |

TABLE 2-continued

*S. pneumoniae* - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 210 | 12 | 8844 | 9107 | gi\|497647 | DNA gyrase subunit B [*Mycoplasma genitalium*] | 52 | 38 | 264 |
| 214 | 10 | 5264 | 5431 | gi\|550697 | envelope protein [Human immunodeficiency virus type 1] | 52 | 36 | 168 |
| 225 | 1 | 15 | 884 | gi\|1552773 | hypothetical [*Escherichia coli*] | 52 | 34 | 870 |
| 230 | 1 | 39 | 362 | gnl\|PID\|d100582 | unknown [*Bacillus subtilis*] | 52 | 28 | 324 |
| 287 | 1 | 871 | 2 | gnl\|PID\|e335028 | protease/peptidase [*Mycobacterium leprae*] | 52 | 29 | 870 |
| 363 | 2 | 1305 | 4 | gi\|393394 | Tb-291 membrane associated protein [*Trypanosoma brucei* subgroup] | 52 | 32 | 1302 |
| 23 | 2 | 2048 | 1173 | gnl\|PID\|e254943 | unknown [*Mycobacterium tuberculosis*] | 51 | 30 | 876 |
| 29 | 3 | 742 | 1521 | gi\|929900 | 5'-methylthioadenosine phosphorylase [*Sulfolobus solfataricus*] | 51 | 31 | 780 |
| 45 | 1 | 410 | 1597 | gi\|1877429 | integrase [*Streptococcus pyogenes* phage T12] | 51 | 32 | 1188 |
| 48 | 26 | 19227 | 18946 | gi\|2314455 | (AE000633) transcriptional regulator (tenA) [*Helicobacter pylori*] | 51 | 33 | 282 |
| 73 | 5 | 4276 | 4016 | gi\|474177 | alpha-D-1,4-glucosidase [*Staphylococcus xylosus*] | 51 | 31 | 261 |
| 81 | 11 | 8935 | 12057 | gi\|311070 | pentraxin fusion protein [*Xenopus laevis*] | 51 | 31 | 2123 |
| 83 | 5 | 1195 | 1986 | gnl\|PID\|d101316 | yqfI [*Bacillus subtilis*] | 51 | 33 | 792 |
| 98 | 10 | 7531 | 8538 | gi\|41500 | ORF 3 (AA 1–352); 38 kD (put. ftsX) [*Escherichia coli*] | 51 | 28 | 1008 |
| 113 | 6 | 3908 | 5173 | gi\|466882 | pps1; B1496_C2_189 [*Mycobacterium leprae*] | 51 | 27 | 1266 |
| 124 | 1 | 326 | 57 | gi\|2191168 | (AF007270) contains similarity to myosin heavy chain [*Arabidopsis thaliana*] | 51 | 32 | 270 |
| 129 | 10 | 7286 | 6816 | gi\|1046241 | orf14 [Bacteriophage HP1] | 51 | 30 | 471 |
| 143 | 3 | 4963 | 3983 | gi\|1354935 | probable copper-transporting atpase [*Escherichia coli*] | 51 | 26 | 981 |
| 148 | 15 | 11359 | 10226 | gi\|2293256 | (AF008220) putative hippurate hydrolase [*Bacillus subtilis*] | 51 | 36 | 1134 |
| 149 | 8 | 6003 | 7313 | gi\|1633572 | Herpesvirus saimiri ORF73 homolog [Kaposi's sarcoma-associated herpes-like virus] | 51 | 21 | 1311 |
| 151 | 9 | 12092 | 11550 | gnl\|PID\|e281580 | hypothetical 40.7 kd protein [*Bacillus subtilis*] | 51 | 34 | 543 |
| 159 | 6 | 2555 | 3208 | gi\|146944 | CMP-N-acetylneuraminic acid synthetase [*Escherichia coli*] | 51 | 36 | 654 |
| 174 | 1 | 1797 | 4 | gi\|1773166 | probable copper-transporting atpase [*Escherichia coli*] | 51 | 28 | 1794 |
| 265 | 4 | 2231 | 1773 | gnl\|PID\|e256400 | anti-*P. falciparum* antigenic polypeptide [*Saimiri sciureus*] | 51 | 18 | 459 |
| 277 | 2 | 643 | 1311 | pir\|S32915\|S329 | pilD protein - *Neisseria gonorrhoeae* | 51 | 33 | 669 |
| 350 | 1 | 890 | 3 | gi\|290509 | o307 [*Escherichia coli*] | 51 | 30 | 888 |
| 363 | 4 | 1228 | 4485 | gi\|1707247 | partial CDS [*Caenorhabditis elegans*] | 51 | 23 | 3258 |
| 367 | 1 | 1701 | 4 | gi\|393394 | Tb-291 membrane associated protein [*Tyrpanosoma brucei* subgroup] | 51 | 32 | 1698 |
| 15 | 5 | 5174 | 4497 | gnl\|PID\|e58151 | F3 [*Bacillus subtilis*] | 50 | 38 | 678 |
| 16 | 4 | 2220 | 2582 | gnl\|PID\|e325010 | hypothetical protein [*Bacillus subtilis*] | 50 | 29 | 363 |
| 19 | 5 | 2591 | 4159 | gi\|1552733 | similar to voltage-gated chloride channel protein [*Escherichia coli*] | 50 | 30 | 1569 |
| 25 | 4 | 2701 | 1997 | gi\|887849 | ORF_f219 [*Escherichia coli*] | 50 | 27 | 705 |
| 35 | 1 | 211 | 417 | gnl\|PID\|e236697 | unknown [*Saccharomyces cerevisiae*] | 50 | 33 | 207 |
| 39 | 4 | 3416 | 5152 | gnl\|PID\|d100974 | unknown [*Bacillus subtilis*] | 50 | 27 | 1737 |
| 51 | 7 | 4000 | 5181 | gi\|1592027 | carbamoyl-phosphate synthase, pyrimidine-specific, large subunit [*Methanococcus jannaschii*] | 50 | 27 | 1182 |
| 51 | 9 | 7179 | 8303 | gi\|1591847 | type I restriction-modification enzyme, S subunit [*Methanococcus jannaschii*] | 50 | 28 | 1125 |
| 52 | 8 | 8740 | 9534 | gi\|144297 | acetyl esterase (XynC) [*Caldocellum saccharolyticum*] | 50 | 34 | 795 |
| 52 | 16 | 16951 | 15770 | gi\|2108229 | basic surface protein [*Lactobacillus fermentum*] | 50 | 34 | 822 |
| 57 | 7 | 6031 | 6336 | gi\|2275264 | 60S ribosomal protein L7B [*Schizosaccharomyces pombe*] | 50 | 40 | 306 |
| 71 | 23 | 29348 | 28383 | gnl\|PID\|d101328 | YqjA [*Bacillus subtilis*] | 50 | 30 | 966 |
| 86 | 12 | 11155 | 10769 | gnl\|PID\|e324964 | hypothetical protein [*Bacillus subtilis*] | 50 | 24 | 387 |
| 93 | 2 | 1205 | 330 | gi\|1066016 | similar to *Escherichia coli* pyruvate, water dikinse, Swiss-Prot Accession Number P23538 [*Pyrococcus furiosus*] | 50 | 24 | 876 |
| 96 | 5 | 1673 | 2959 | gnl\|PID\|e322433 | gamma-glutamylcysteine synthetase [*Brassica juncea*] | 50 | 29 | 1287 |
| 98 | 2 | 218 | 1171 | gi\|151110 | leucine-, isoleucine-, and valine-binding protein [*Pseduomonas aeruginosa*] | 50 | 30 | 954 |
| 103 | 4 | 3303 | 2785 | gi\|154330 | O-antigen ligase [*Salmonella typhimurium*] | 50 | 31 | 519 |
| 115 | 5 | 6480 | 5980 | gi\|895747 | putative cel operon regulatro [*Bacillus subtilis*] | 50 | 26 | 501 |
| 129 | 11 | 7559 | 7305 | gi\|1216475 | skeletal muscle ryanodine receptor [*Homo sapiens*] | 50 | 32 | 255 |
| 129 | 13 | 8192 | 7965 | gi\|152271 | 319-kDA protein [*Rhizobium meliloti*] | 50 | 30 | 228 |
| 151 | 5 | 7634 | 6819 | gi\|40348 | put. resolvase Tnp I (AA 1–284) [*Bacillus thuringiensis*] | 50 | 35 | 816 |
| 153 | 1 | 1 | 597 | gnl\|PID\|d102015 | (AB001488) SIMILAR TO NITROREDUCTASE. [*Bacillus subtilis*] | 50 | 29 | 597 |
| 155 | 5 | 5986 | 5432 | gi\|1276880 | EspsG [*Streptococcus thermophilus*] | 50 | 28 | 555 |
| 160 | 9 | 7390 | 6323 | gi\|1786983 | (AE000179) o331; 92 pct identical to the 333 as hypothetical protein YBHE_ECOLI SW: P52697; 26 pct identical (7 gaps) to 167 residues of the 373 as protein MLE_TRICU SW: P46057; SW: P52697 [*Escherichia coli*] | 50 | 30 | 1068 |
| 163 | 6 | 7396 | 8091 | gnl\|PID\|d101313 | YqeN [*Bacillus subtilis*] | 50 | 22 | 696 |
| 167 | 6 | 5232 | 3940 | gi\|413926 | ipa-2r gene product [*Bacillus subtilis*] | 50 | 27 | 1293 |
| 169 | 2 | 807 | 130 | gnl\|PID\|e304540 | endolysin [*Bacertiophage Bastille*] | 50 | 35 | 678 |
| 171 | 5 | 3158 | 4025 | gi\|606080 | ORF_o290; Geneplot suggests frameshift linking to o267, not found [*Escherichia coli*] | 50 | 27 | 858 |
| 210 | 13 | 8151 | 8414 | gi\|330038 | HRV 2 polyprotein [Human rhinovirus] | 50 | 25 | 264 |
| 364 | 1 | 1538 | 135 | gi\|393396 | Tb-292 membrane associated protein [*Trypanosoma brucei* subgroup] | 50 | 31 | 1404 |
| 10 | 7 | 5911 | 5090 | gi\|144859 | ORF B [*Clostridium perfringens*] | 49 | 24 | 822 |
| 26 | 5 | 10754 | 9768 | gi\|142440 | ATP-dependent nuclease [*Bacillus subtilis*] | 49 | 31 | 987 |
| 66 | 7 | 9777 | 8398 | gi\|414170 | trkA gene product [*Methanosarcina mazeii*] | 49 | 26 | 1380 |
| 77 | 6 | 5364 | 4648 | gnl\|PID\|e285322 | RecX protein [*Mycobacterium smegmatis*] | 49 | 28 | 717 |
| 82 | 13 | 12689 | 13249 | gnl\|PID\|e255091 | hypothetical protein [*Bacillus subtilis*] | 49 | 20 | 561 |
| 93 | 9 | 4866 | 4531 | gi\|40067 | X gene product [*Bacillus sphaericus*] | 49 | 26 | 336 |

TABLE 2-continued

_S. pneumoniae_ - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 112 | 5 | 4019 | 4948 | gi|1574380 | lic-1 operon protein (licB) [*Haemophilus influenzae*] | 49 | 27 | 930 |
| 129 | 7 | 6058 | 4949 | gnl|PID|e267587 | Unknown [*Bacillus subtilis*] | 49 | 35 | 1110 |
| 135 | 5 | 3875 | 4438 | gi|39573 | P20 (AA 1–178) [*Bacillus licheniformis*] | 49 | 25 | 564 |
| 154 | 2 | 1423 | 1953 | gnl|PID|d101102 | regulatory components of sensory transduction system [*Synechocystis* sp.] | 49 | 29 | 531 |
| 156 | 5 | 2878 | 1637 | gnl|PID|d101732 | hypothetical protein [*Synechocystis* sp.] | 49 | 25 | 1242 |
| 173 | 5 | 3500 | 2940 | gi|490324 | LORF X gene product [unidentified] | 49 | 30 | 561 |
| 182 | 1 | 1057 | 2 | gi|331002 | first methionine codon in the ECLF1 ORF [*Saimirine herpesvirus* 2] | 49 | 25 | 1056 |
| 192 | 6 | 5352 | 3667 | gi|2394472 | (AF024499) contains similarity to homeobox domains [*Caenorhabditis elegans*] | 49 | 23 | 1686 |
| 253 | 4 | 1129 | 1350 | gi|531116 | SIR4 protein [*Saccharomyces cerevisiae*] | 49 | 23 | 222 |
| 277 | 1 | 600 | 136 | gi|396844 | ORF (18 kDa) [*Vibrio cholerae*] | 49 | 32 | 465 |
| 327 | 3 | 1435 | 887 | gi|733524 | phosphatidylinositol-4,5-diphosphate 3-kinase [*Dictyostelium discoideum*] | 49 | 24 | 549 |
| 365 | 3 | 1436 | 132 | gi|393394 | Tb-291 membrane associated protein [*Trypanosoma brucei* subgroup] | 49 | 31 | 1305 |
| 33 | 7 | 4461 | 3277 | gi|145644 | codes for a protein of unknown function [*Escherichia coli*] | 48 | 26 | 1185 |
| 40 | 2 | 652 | 1776 | gnl|PID|e290649 | ornithine decarboxylase [*Nicotiana tabacum*] | 48 | 29 | 1125 |
| 67 | 4 | 1377 | 2384 | gi|1772652 | 2-keto-3-deoxygluconate kinase [*Haloferax alicantei*] | 48 | 30 | 1008 |
| 74 | 2 | 4269 | 3871 | gi|12182678 | (AE000101) Y4vJ [*Rhizobium* sp. NGR234] | 48 | 27 | 399 |
| 81 | 2 | 1326 | 541 | gi|153672 | lactose repressor [*Streptococcus mutans*] | 48 | 33 | 786 |
| 81 | 4 | 2981 | 3646 | gi|146042 | fuculose-1-phosphate aldolase (fucA) [*Escherichia coli*] | 48 | 30 | 666 |
| 97 | 1 | 602 | 51 | gi|153794 | rgg [*Streptococcus gordonii*] | 48 | 29 | 552 |
| 110 | 1 | 1 | 3132 | gi|1381114 | prtB gene product [*Lactobacillus delbrueckii*] | 48 | 23 | 3132 |
| 131 | 5 | 2914 | 2147 | gnl|PID|e183811 | Acyl-ACP thioesterase [*Brassica napus*] | 48 | 27 | 768 |
| 133 | 4 | 3494 | 2628 | gnl|PID|e261988 | putative ORF [*Bacillus subtilis*] | 48 | 27 | 867 |
| 139 | 6 | 4231 | 4599 | gi|1098388 | 2K470.1 gene product [*Caenorhabditis elegans*] | 48 | 23 | 369 |
| 139 | 8 | 5036 | 5665 | gi|1022725 | unknown [*Staphylococcus haemolyticus*] | 48 | 29 | 630 |
| 140 | 12 | 11936 | 11007 | gnl|PID|d102049 | H. influenzae, ribosomal protein alanine acetyltransferase; P44305 (189) [*Bacillus subtilis*] | 48 | 27 | 930 |
| 146 | 9 | 5670 | 4654 | gi|1591731 | melvalonate kinase [*Methanococcus jannaschii*] | 48 | 24 | 1017 |
| 161 | 3 | 1280 | 2374 | gnl|PID|e101578 | Collagenase precursor (EC 3.4.—.—), [*Escherichia coli*] | 48 | 24 | 1095 |
| 172 | 11 | 10581 | 11048 | gnl|PID|d101132 | hypothetical protein [*Synechocystis* sp.] | 48 | 27 | 468 |
| 182 | 4 | 2930 | 2586 | gi|40067 | X gene product [*Bacillus sphaericus*] | 48 | 37 | 345 |
| 210 | 15 | 10786 | 11196 | sp|P13940|LE29_ | LATE EMBRYOGENESIS ABUNDANT PROTEIN D029 (LEA D-29) | 48 | 30 | 411 |
| 214 | 12 | 6231 | 6482 | gi|40389 | non-toxic components [*Clostridium botulinum*] | 48 | 26 | 252 |
| 221 | 1 | 704 | 3 | gi|11573364 | H. influenzae predicted coding region HI0392 [*Haemophilus influenzae*] | 48 | 27 | 702 |
| 227 | 2 | 647 | 3928 | gi|1673693 | (AE000005) *Mycoplasma pneumoniae*, C09_orf718 Protein [*Mycoplasma pneumoniae*] | 48 | 30 | 3282 |
| 253 | 2 | 480 | 758 | gnl|PID|e236697 | unknown [*Saccharomyces cerevisiae*] | 48 | 31 | 279 |
| 363 | 3 | 1874 | 1122 | gi|18137 | cgcr-4 product [*Chlamydomonas reinhardtii*] | 48 | 40 | 753 |
| 389 | 1 | 505 | 2 | gi|18137 | cgcr-4 product [*Chlamydomonas reinhardtii*] | 48 | 38 | 504 |
| 3 | 21 | 20879 | 22258 | gnl|PID|e264778 | putative maltose-binding protein [*Streptomyces coelicolor*] | 47 | 33 | 1380 |
| 6 | 4 | 4089 | 4658 | gi|39573 | P20 (AA 1–178) [*Bacillus licheniformis*] | 47 | 23 | 570 |
| 15 | 3 | 3736 | 1760 | gnl|PID|d100572 | unknown [*Bacillus subtilis*] | 47 | 25 | 1977 |
| 35 | 15 | 14516 | 13263 | gi|17773351 | Cap5L [*Staphylococcus aureus*] | 47 | 20 | 1254 |
| 51 | 6 | 3547 | 4002 | pir|A37024|A370 | 32K antigen precursor - *Mycobacterium tuberculosis* | 47 | 38 | 456 |
| 55 | 8 | 10154 | 9273 | gi|39848 | U3 [*Bacillus subtilis*] | 47 | 26 | 882 |
| 92 | 4 | 1753 | 3276 | gnl|PID|e280611 | PCPC [*Streptococcus pneumoniae*] | 47 | 35 | 1524 |
| 127 | 9 | 5589 | 5386 | gi|1786458 | (AE000134) f120; This 120 aa orf is 76 pct identical (0 gaps) to 42 residues of an approx. 48 aa protein Y127_HAEIN SW: P43949 [*Escherichia coli*] | 47 | 32 | 204 |
| 130 | 2 | 1232 | 1759 | gnl|PID|e266555 | unknown [*Mycobacterium tuberculosis*] | 47 | 23 | 528 |
| 140 | 4 | 4951 | 3542 | gnl|PID|d100964 | homologue of hypothetical protein in a rapamycin synthesis gene cluster of *Streptomyces hygroscopicus* [*Bacillus subtilis*] | 47 | 24 | 1410 |
| 151 | 4 | 6814 | 6200 | gi|1522674 | M. jannaschii predicted coding region MJ3CL41 [*Methanococcus jannaschii*] | 47 | 27 | 615 |
| 157 | 3 | 803 | 1174 | gnl|PID|d101320 | YqgZ [*Bacillus subtilis*] | 47 | 25 | 372 |
| 178 | 5 | 3267 | 2155 | gi|2367190 | (AE000390) o334; sequence change joins ORFs ygjR & ygjS from earlier version (YGJR_ECOLI SW: P42599 and YGJS_ECOLI SW: P42600) [*Escherichia coli*] | 47 | 30 | 1113 |
| 273 | 1 | 2 | 1549 | gnl|PID|e254973 | autolysin sensor kinase [*Bacillus subtilis*] | 47 | 32 | 1548 |
| 300 | 2 | 880 | 644 | gi|1835755 | zinc finger protein Png-1 [*Mus muculus*] | 47 | 22 | 237 |
| 54 | 14 | 14182 | 12638 | pir|S43609|S436 | rofA protein - *Streptococcus pyogenes* | 46 | 24 | 1545 |
| 88 | 1 | 2 | 1018 | gnl|PID|e223891 | xylose repressor [*Anaerocellum thermophilum*] | 46 | 27 | 1017 |
| 96 | 7 | 4553 | 5860 | gnl|PID|d101652 | ORF_ID:0347#5; similar to (SwissProt Accession Number P45272) [*Escherichia coli*] | 46 | 23 | 1308 |
| 112 | 1 | 1127 | 3 | gi|2209215 | (AF004325) putative oligosaccharide repeat unit transporter [*Streptococcus pneumoniae*] | 46 | 24 | 1125 |
| 122 | 13 | 7308 | 7982 | gi|1054776 | hr44 gene product [*Homo sapiens*] | 46 | 34 | 675 |
| 127 | 14 | 9198 | 8125 | gi|1469286 | afuA gene product [*Actinobacillus pleuropneumoniae*] | 46 | 28 | 1074 |
| 132 | 4 | 7093 | 6197 | gi|153794 | rgg [*Streptococcus gordonii*] | 46 | 26 | 897 |
| 140 | 8 | 8220 | 7723 | gi|1235795 | pullulanase [*Thermoanaerobacterium thermosulfurigenes*] | 46 | 21 | 498 |

TABLE 2-continued

S. pneumoniae - Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 140 | 9 | 9205 | 8315 | gi\|407878 | leucine rich protein [Streptococcus equisimilis] | 46 | 27 | 891 |
| 162 | 1 | 1 | 1125 | gi\|1143209 | ORF7; Method: conceptual translation supplied by author [Shigella sonnei] | 46 | 25 | 1125 |
| 199 | 1 | 1 | 585 | gi\|1947171 | (AF000299) No definition line found [Caenorhabditis elegans] | 46 | 28 | 585 |
| 223 | 3 | 1971 | 1477 | sp\|P02562\|MYSS_ | MYOSIN HEAVY CHAIN, SKELETAL MUSCLE (FRAGMENTS) | 46 | 27 | 495 |
| 232 | 2 | 760 | 1608 | gi\|1016112 | ycf38 gene product [Cyanophora paradoxa] | 46 | 28 | 849 |
| 292 | 1 | 687 | 220 | gi\|1673744 | (AE000011) Mycoplasma pneumoniae, cytidine deaminase; similar to GenBank Accession Number C53312, from M. pirum [Mycoplasma pneumoniae] | 46 | 29 | 468 |
| 30 | 8 | 5843 | 6472 | gi\|1788049 | (AE000270) o235; This 235 aa orf is 29 pct identical (10 gaps) to 198 residues of an approx. 216 as protein YTXB_BACSU SW: P06568 [Escherichia coli] | 45 | 24 | 630 |
| 48 | 6 | 3461 | 3868 | gi\|722339 | unknown [Acetobacter xylinum] | 45 | 29 | 408 |
| 60 | 1 | 307 | 2 | gi\|1699079 | coded for by C. elegans cDNA yk41h4.3; coded for by C. elegans cDNA yk148g10.5; coded for by C. elegans cDNA yk152g5.5; coded for by C. elegans cDNA yk59a10.5; coded for by C. elegans cDNA yk41h4.5; coded for by C. elegans cDNA cm20g10; coded | 45 | 36 | 306 |
| 72 | 16 | 14371 | 14874 | gi\|1321900 | NADH dehydrogenase (ubiquinone) [Artemia franciscana] | 45 | 25 | 504 |
| 99 | 7 | 9158 | 7941 | gi\|152192 | mutation causes a succinoglucan-minus phenotype; ExoQ is a transmembrane protein; third gene of the exoYFQ operon;; putative [Rhizobium meliloti] | 45 | 28 | 1218 |
| 127 | 12 | 7046 | 6606 | bbs\|153689 | HitB = iron utilization protein [Haemophilus influenzae, type b, DL42, NTHI TN106, Peptide, 506 aa] [Haemophilus influenzae] | 45 | 24 | 441 |
| 137 | 5 | 1561 | 2619 | gi\|472921 | v-type Na-ATPase [Enterococcus hirae] | 45 | 33 | 1059 |
| 209 | 1 | 774 | 364 | gi\|304141 | restriction endonuclease beta [Bacillus coagulans] | 45 | 28 | 411 |
| 314 | 1 | 604 | 2 | gi\|1480457 | latex allergen [Hevea brasiliensis] | 45 | 31 | 603 |
| 20 | 18 | 19782 | 20288 | gi\|433942 | ORF [Lactococcus lactis] | 44 | 26 | 507 |
| 87 | 8 | 7030 | 6452 | gi\|537207 | ORF_f277 [Escherichia coli] | 44 | 26 | 579 |
| 166 | 5 | 4909 | 4037 | gnl\|PID\|e308082 | membrane transport protein [Bacillus subtilis] | 44 | 25 | 873 |
| 247 | 1 | 818 | 75 | gnl\|PID\|d100718 | ORF1 [Bacillus sp.] | 44 | 20 | 744 |
| 32 | 3 | 1885 | 3876 | gi\|2351768 | PspA [Streptococcus pneumoniae] | 43 | 24 | 1992 |
| 36 | 17 | 15467 | 18256 | gi\|1045739 | M. genitalium predicted coding region MG064 [Mycoplasma genitalium] | 43 | 26 | 2790 |
| 54 | 15 | 14656 | 17343 | gi\|520541 | penicillin-binding proteins 1A and 1B [Bacillus subtilis] | 43 | 27 | 2688 |
| 67 | 2 | 696 | 1352 | gi\|536934 | yjcA gene product [Escherichia coli] | 43 | 29 | 657 |
| 139 | 2 | 2416 | 338 | gi\|396400 | similar to eukaryotic Na+/H+ exchangers [Escherichia coli] | 43 | 24 | 2079 |
| 298 | 1 | 3 | 809 | gi\|413972 | ipa-48r gene product [Bacillus subtilis] | 43 | 24 | 807 |
| 387 | 1 | 47 | 427 | gi\|2315652 | (AF016669) No definition line found [Caenorhbditis elegans] | 43 | 30 | 381 |
| 185 | 4 | 4221 | 3127 | gi\|2182399 | (AE000073) Y4fP [Rhizobium sp. NGR234] | 41 | 25 | 1095 |
| 340 | 1 | 582 | 70 | gnl\|PID\|e218681 | CDP-diacylglycerol synthetase [Arabidopsis thaliana] | 41 | 20 | 513 |
| 363 | 6 | 4205 | 1914 | gi\|1256742 | R27-2 protein [Trypanosoma cruzi] | 41 | 27 | 2292 |
| 368 | 2 | 2 | 943 | gi\|21783 | LMW glutenin (AA 1–356) [Triticum aestivum] | 41 | 34 | 942 |
| 155 | 3 | 4489 | 2861 | gi\|42023 | member of ATP-dependent transport family, very similar to mdr proteins and hemolysin B, export protein [Escherichia coli] | 40 | 18 | 1629 |
| 365 | 2 | 95 | 1438 | gi\|1633572 | Herpesvirus saimiri ORF73 homolog [Kaposi's sarcoma-associated herpes-like virus] | 40 | 21 | 1344 |
| 1 | 3 | 2979 | 3860 | gnl\|PID\|d101908 | hypothetical protein [Synechocystis sp.] | 39 | 26 | 882 |
| 1 | 5 | 3814 | 4647 | gnl\|PID\|d101961 | hypothetical protein [Synechocystis sp.] | 39 | 19 | 834 |
| 26 | 6 | 14035 | 10724 | gi\|142439 | ATP-dependent nuclease [Bacillus subtilis] | 38 | 20 | 3312 |
| 47 | 1 | 3 | 4916 | gi\|632549 | NF-180 [Petromyzon marinus] | 36 | 23 | 4914 |

TABLE 3

S. pneumoniae - Putative coding regions of novel proteins not similar to known proteins

| Contig ID | ORF ID | Start (nt) | Stop (nt) |
|---|---|---|---|
| 1 | 4 | 3428 | 3009 |
| 2 | 6 | 4611 | 4964 |
| 3 | 2 | 818 | 994 |
| 3 | 3 | 1182 | 1574 |
| 3 | 7 | 5382 | 6497 |
| 3 | 25 | 25046 | 25396 |
| 3 | 26 | 25625 | 26317 |
| 6 | 2 | 1519 | 1689 |
| 6 | 14 | 12875 | 12618 |
| 6 | 15 | 13215 | 12841 |
| 6 | 18 | 15977 | 15390 |
| 7 | 12 | 9955 | 9419 |
| 7 | 13 | 10161 | 9910 |
| 8 | 6 | 3915 | 4280 |
| 9 | 9 | 6024 | 5704 |
| 10 | 8 | 6909 | 6298 |
| 10 | 9 | 7136 | 6888 |
| 10 | 11 | 7968 | 7672 |
| 12 | 1 | 1140 | 4 |
| 12 | 3 | 1779 | 1456 |

TABLE 3-continued

*S. pneumoniae* - Putative coding regions of novel proteins not similar to known proteins

| Contig ID | ORF ID | Start (nt) | Stop (nt) |
|---|---|---|---|
| 14 | 2 | 1913 | 1434 |
| 16 | 1 | 1 | 243 |
| 16 | 5 | 5675 | 3087 |
| 17 | 1 | 324 | 34 |
| 17 | 3 | 1451 | 1050 |
| 17 | 9 | 4890 | 4465 |
| 20 | 14 | 14544 | 15893 |
| 21 | 3 | 3359 | 2589 |
| 21 | 5 | 4802 | 4482 |
| 22 | 21 | 17099 | 17362 |
| 22 | 25 | 19467 | 19982 |
| 22 | 33 | 25540 | 25764 |
| 22 | 35 | 26388 | 26218 |
| 22 | 36 | 26382 | 27572 |
| 23 | 7 | 6655 | 6032 |
| 23 | 8 | 7132 | 6653 |
| 24 | 1 | 36 | 518 |
| 25 | 5 | 3009 | 2641 |
| 27 | 4 | 4819 | 4223 |
| 27 | 5 | 4789 | 4956 |
| 28 | 5 | 3017 | 1797 |
| 28 | 8 | 4272 | 3850 |
| 28 | 10 | 5028 | 4597 |
| 28 | 11 | 5746 | 5072 |
| 29 | 7 | 5596 | 4919 |
| 29 | 8 | 5039 | 5518 |
| 29 | 9 | 5595 | 8207 |
| 30 | 9 | 6511 | 6263 |
| 31 | 6 | 2664 | 2344 |
| 32 | 5 | 5203 | 5538 |
| 33 | 8 | 5327 | 4668 |
| 34 | 10 | 8024 | 7740 |
| 34 | 12 | 9360 | 8641 |
| 34 | 13 | 9667 | 9377 |
| 34 | 18 | 13104 | 11902 |
| 35 | 11 | 9688 | 8588 |
| 35 | 12 | 11073 | 9670 |
| 36 | 2 | 334 | 1041 |
| 36 | 12 | 11120 | 10893 |
| 36 | 13 | 10993 | 11388 |
| 36 | 15 | 12172 | 14595 |
| 38 | 7 | 4269 | 4577 |
| 38 | 8 | 4480 | 5001 |
| 38 | 10 | 5517 | 5711 |
| 38 | 17 | 10732 | 11376 |
| 40 | 3 | 1728 | 3143 |
| 43 | 1 | 172 | 5 |
| 43 | 7 | 8884 | 8732 |
| 43 | 8 | 9568 | 9071 |
| 44 | 4 | 4831 | 6831 |
| 45 | 3 | 3204 | 3665 |
| 46 | 4 | 3875 | 3468 |
| 46 | 7 | 6074 | 7081 |
| 48 | 5 | 3196 | 3582 |
| 48 | 8 | 4579 | 4229 |
| 48 | 11 | 9323 | 8922 |
| 48 | 16 | 13042 | 12494 |
| 48 | 20 | 16342 | 15764 |
| 48 | 24 | 17971 | 18351 |
| 48 | 30 | 21979 | 21776 |
| 49 | 1 | 209 | 3 |
| 50 | 4 | 3307 | 2672 |
| 51 | 5 | 3239 | 3598 |
| 52 | 11 | 12146 | 12883 |
| 54 | 7 | 5588 | 5187 |
| 54 | 8 | 6013 | 5459 |
| 54 | 9 | 6004 | 6210 |
| 54 | 16 | 17685 | 17506 |
| 55 | 9 | 10515 | 10123 |
| 55 | 12 | 11947 | 12141 |
| 56 | 3 | 935 | 1387 |
| 56 | 4 | 1496 | 1939 |
| 57 | 3 | 1624 | 2130 |
| 57 | 4 | 2100 | 2501 |
| 58 | 6 | 7541 | 7335 |
| 59 | 1 | 2 | 430 |
| 59 | 4 | 2416 | 2736 |
| 59 | 5 | 2734 | 3063 |
| 59 | 8 | 4743 | 5549 |
| 59 | 9 | 5459 | 5929 |
| 60 | 6 | 5741 | 6451 |
| 61 | 3 | 2395 | 1772 |
| 61 | 5 | 3316 | 3176 |
| 64 | 1 | 2722 | 2 |
| 66 | 2 | 1180 | 3147 |
| 66 | 8 | 9082 | 9495 |
| 67 | 3 | 1343 | 1182 |
| 69 | 2 | 1165 | 980 |
| 70 | 5 | 4059 | 3922 |
| 70 | 6 | 4215 | 4057 |
| 70 | 9 | 5268 | 5504 |
| 71 | 15 | 20351 | 21901 |
| 71 | 16 | 21859 | 22338 |
| 71 | 19 | 26204 | 27556 |
| 72 | 9 | 8458 | 8081 |
| 73 | 4 | 3815 | 4216 |
| 73 | 6 | 4214 | 4582 |
| 73 | 7 | 4369 | 4773 |
| 73 | 10 | 7183 | 6428 |
| 73 | 15 | 9462 | 9668 |
| 76 | 1 | 524 | 195 |
| 76 | 2 | 867 | 535 |
| 76 | 11 | 8602 | 9210 |
| 80 | 6 | 7924 | 8109 |
| 81 | 1 | 244 | 2 |
| 81 | 10 | 6631 | 8931 |
| 83 | 4 | 1872 | 1150 |
| 83 | 17 | 16810 | 16460 |
| 84 | 3 | 4464 | 2929 |
| 86 | 2 | 2147 | 1092 |
| 86 | 4 | 3606 | 2875 |
| 86 | 19 | 16767 | 17114 |
| 87 | 5 | 5326 | 5000 |
| 87 | 7 | 6459 | 6001 |
| 87 | 9 | 7224 | 7006 |
| 87 | 18 | 17930 | 17670 |
| 87 | 19 | 18275 | 17928 |
| 88 | 2 | 1619 | 1840 |
| 88 | 4 | 2711 | 2878 |
| 88 | 9 | 6252 | 6016 |
| 89 | 3 | 2634 | 1621 |
| 89 | 9 | 7371 | 6868 |
| 90 | 2 | 899 | 2395 |
| 90 | 3 | 1143 | 952 |
| 91 | 3 | 2959 | 3141 |
| 91 | 4 | 3170 | 3691 |
| 91 | 6 | 4253 | 4573 |
| 93 | 1 | 391 | 2 |
| 93 | 6 | 2648 | 2379 |
| 93 | 8 | 4533 | 3712 |
| 96 | 1 | 3 | 182 |
| 96 | 2 | 904 | 632 |
| 96 | 3 | 1407 | 1147 |
| 96 | 4 | 1250 | 1420 |
| 97 | 9 | 7043 | 6753 |
| 99 | 15 | 18522 | 18692 |
| 99 | 17 | 19717 | 19541 |
| 100 | 2 | 4094 | 1980 |
| 103 | 1 | 48 | 299 |
| 103 | 6 | 4924 | 4373 |
| 104 | 5 | 6142 | 6735 |
| 105 | 7 | 6098 | 6517 |
| 106 | 1 | 1 | 363 |
| 106 | 10 | 9832 | 10212 |
| 108 | 1 | 2 | 268 |
| 111 | 3 | 3417 | 3788 |

TABLE 3-continued

S. pneumoniae - Putative coding regions of novel proteins not similar to known proteins

| Contig ID | ORF ID | Start (nt) | Stop (nt) |
|---|---|---|---|
| 111 | 4 | 3809 | 4606 |
| 115 | 10 | 10854 | 10438 |
| 116 | 3 | 2873 | 2121 |
| 118 | 2 | 2274 | 1357 |
| 122 | 4 | 2698 | 2333 |
| 122 | 10 | 5858 | 6199 |
| 122 | 12 | 6301 | 7416 |
| 124 | 2 | 346 | 690 |
| 128 | 4 | 2544 | 3368 |
| 129 | 1 | 689 | 102 |
| 129 | 2 | 1011 | 724 |
| 129 | 8 | 6454 | 6056 |
| 129 | 9 | 6540 | 6277 |
| 129 | 12 | 7809 | 7621 |
| 131 | 3 | 1433 | 756 |
| 131 | 10 | 5972 | 5673 |
| 134 | 11 | 11838 | 11209 |
| 135 | 2 | 625 | 1140 |
| 136 | 4 | 2913 | 3830 |
| 137 | 2 | 325 | 134 |
| 139 | 12 | 14027 | 14521 |
| 139 | 13 | 14840 | 14532 |
| 139 | 14 | 15363 | 14875 |
| 140 | 20 | 19822 | 20838 |
| 142 | 1 | 1 | 285 |
| 146 | 3 | 760 | 479 |
| 146 | 4 | 1149 | 778 |
| 146 | 7 | 3604 | 2885 |
| 146 | 13 | 8223 | 9401 |
| 146 | 14 | 9399 | 10676 |
| 146 | 15 | 10052 | 9750 |
| 147 | 7 | 7488 | 7276 |
| 147 | 9 | 8913 | 8647 |
| 148 | 7 | 5298 | 4765 |
| 149 | 1 | 2 | 1936 |
| 149 | 3 | 2557 | 2880 |
| 149 | 9 | 6258 | 6070 |
| 150 | 2 | 1355 | 579 |
| 150 | 3 | 2556 | 1909 |
| 153 | 3 | 2061 | 2642 |
| 154 | 3 | 1953 | 1741 |
| 155 | 2 | 2181 | 1411 |
| 156 | 8 | 4550 | 4311 |
| 157 | 1 | 37 | 294 |
| 159 | 2 | 631 | 780 |
| 159 | 4 | 1384 | 1722 |
| 159 | 7 | 3271 | 4017 |
| 161 | 2 | 1332 | 1018 |
| 165 | 3 | 5535 | 4945 |
| 166 | 6 | 5406 | 4972 |
| 167 | 9 | 6075 | 6395 |
| 169 | 5 | 2828 | 3205 |
| 170 | 7 | 6485 | 6243 |
| 170 | 8 | 6964 | 6362 |
| 170 | 9 | 7303 | 6962 |
| 170 | 11 | 8790 | 7906 |
| 171 | 9 | 7150 | 7476 |
| 172 | 5 | 2298 | 1948 |
| 173 | 4 | 2913 | 2677 |
| 175 | 2 | 659 | 835 |
| 175 | 3 | 893 | 1789 |
| 176 | 2 | 1487 | 546 |
| 176 | 3 | 2200 | 1466 |
| 177 | 9 | 4686 | 4925 |
| 177 | 10 | 4923 | 5177 |
| 177 | 11 | 5111 | 5347 |
| 177 | 13 | 7396 | 8703 |
| 178 | 6 | 3452 | 3724 |
| 181 | 5 | 1853 | 2473 |
| 182 | 2 | 2112 | 1102 |
| 182 | 3 | 2617 | 2006 |
| 183 | 2 | 2126 | 2320 |
| 185 | 5 | 4683 | 4219 |
| 185 | 6 | 4846 | 4634 |
| 187 | 4 | 2940 | 3557 |
| 188 | 4 | 3686 | 4363 |
| 188 | 5 | 4183 | 4821 |
| 188 | 6 | 5882 | 6493 |
| 189 | 5 | 3143 | 2844 |
| 189 | 9 | 5956 | 5564 |
| 191 | 1 | 618 | 4 |
| 191 | 11 | 10357 | 10001 |
| 192 | 3 | 2861 | 2268 |
| 192 | 4 | 3081 | 2878 |
| 192 | 7 | 6800 | 5331 |
| 193 | 3 | 997 | 839 |
| 194 | 4 | 2315 | 2127 |
| 195 | 5 | 6249 | 4543 |
| 195 | 6 | 6620 | 6231 |
| 196 | 2 | 1553 | 1849 |
| 197 | 1 | 1 | 861 |
| 198 | 9 | 6844 | 6644 |
| 200 | 5 | 5329 | 5769 |
| 200 | 6 | 5993 | 6595 |
| 204 | 5 | 3914 | 3276 |
| 205 | 2 | 447 | 1709 |
| 209 | 4 | 2038 | 2460 |
| 209 | 5 | 2458 | 2682 |
| 210 | 10 | 7370 | 8230 |
| 210 | 13 | 9029 | 10441 |
| 210 | 14 | 10439 | 10705 |
| 214 | 5 | 2581 | 2330 |
| 214 | 9 | 5065 | 5277 |
| 214 | 11 | 5996 | 5754 |
| 217 | 2 | 541 | 194 |
| 218 | 2 | 914 | 1432 |
| 218 | 3 | 1430 | 1972 |
| 218 | 6 | 3639 | 3821 |
| 219 | 1 | 458 | 39 |
| 220 | 1 | 869 | 600 |
| 223 | 4 | 2617 | 1964 |
| 227 | 1 | 1 | 510 |
| 234 | 4 | 1539 | 1312 |
| 234 | 6 | 2116 | 1838 |
| 235 | 1 | 52 | 312 |
| 235 | 2 | 310 | 687 |
| 238 | 1 | 660 | 64 |
| 246 | 1 | 1 | 270 |
| 248 | 1 | 3 | 362 |
| 248 | 2 | 443 | 1222 |
| 254 | 3 | 2789 | 792 |
| 258 | 2 | 1179 | 1616 |
| 260 | 3 | 1770 | 2123 |
| 263 | 1 | 653 | 177 |
| 263 | 4 | 2244 | 1900 |
| 263 | 5 | 3569 | 2973 |
| 266 | 1 | 1 | 342 |
| 266 | 2 | 177 | 1022 |
| 270 | 2 | 1124 | 1681 |
| 272 | 1 | 857 | 186 |
| 275 | 2 | 1684 | 2295 |
| 278 | 1 | 2 | 406 |
| 282 | 1 | 714 | 391 |
| 282 | 4 | 1463 | 1134 |
| 287 | 2 | 1119 | 826 |
| 288 | 1 | 540 | 4 |
| 289 | 1 | 684 | 4 |
| 291 | 5 | 1589 | 1858 |
| 293 | 2 | 2539 | 2925 |
| 294 | 1 | 21 | 608 |
| 296 | 2 | 494 | 700 |
| 296 | 3 | 670 | 843 |
| 302 | 1 | 261 | 530 |
| 309 | 3 | 559 | 350 |
| 310 | 2 | 249 | 1889 |
| 316 | 2 | 2087 | 1818 |

TABLE 3-continued

S. pneumoniae - Putative coding regions of novel proteins not similar to known proteins

| Contig ID | ORF ID | Start (nt) | Stop (nt) |
|---|---|---|---|
| 317 | 2 | 1048 | 584 |
| 318 | 2 | 313 | 777 |
| 319 | 3 | 477 | 133 |
| 327 | 2 | 912 | 607 |
| 331 | 1 | 1 | 549 |
| 333 | 1 | 2 | 535 |
| 333 | 2 | 465 | 82 |
| 333 | 3 | 127 | 342 |
| 341 | 1 | 1 | 705 |
| 345 | 2 | 895 | 701 |
| 346 | 2 | 750 | 199 |
| 349 | 1 | 1 | 198 |
| 350 | 2 | 81 | 413 |
| 355 | 1 | 44 | 973 |
| 358 | 2 | 636 | 448 |
| 360 | 2 | 948 | 628 |
| 364 | 2 | 1639 | 1265 |
| 378 | 1 | 345 | 1004 |
| 379 | 2 | 683 | 510 |
| 381 | 1 | 109 | 693 |
| 385 | 1 | 150 | 4 |
| 385 | 2 | 269 | 30 |

SEQUENCE LISTING (391 sequences)

SEQ ID NO: 1 - DNA, 5625 bp; double-stranded, linear
ccaagcaaaaccagctacagctaaaggaacttacgtaacaaacttgactatcacaactactcaaggtgttggtatcaaagttgacgtaaactcactttaatcagtagttaaagtaatgtaaaaaagttgaagacgctatgtctcaactttttttgatgtacgacgggcatgttgtatagtagatgtgtactattctagtttcaatctactatagtagctcagaagtcggtacttaaacgtgctatatcaaaaccagtccttgaaaaacgtggactggtttcgtgtttggattattaccttgaacgacatgcgttaaaagttagttgaaccgccgtatgccgaacggacgtacggtggtgtgagaggggctagagattatcccctactcgatttcgaaatctagtggaatgaatctggaatagtccatcgagctttctaatactcttcgaaaatctcttcaaaccacgtcaacgtcgccttgccgtgcgtatggttactgacttcgtcagttctatccacaacctcaaaacagtgttttgagctgactacgtcagttccatctacaacctcaaaacagtgttttgagcaacctgcggctagtttcctagtttgctctttggttttcattgagtataacacattgttagaagttggtttaaatttcctaatcagtttgttcacatttaccttcgatatattatatcccatagttaaggttggtcatacagatgattatagtcatggagccgtaaaacttagtgtttctttagttgacaaagatgccatgaaaaaaatatttgtaactgtaataggatattttgaaataaatatagatgaaaatatcaccgatattctatacgtaaatggtactgctattctttatctttatttacgttcaattgtttcaatagtttcggcaattgatagcagtgaagcaatgttgctacctatcattaatgttttagagttactagataaatctcaaccttttgaagaagaataatttattagctcactaaattgagggtaaggaaaagtaaaagcagtaagaaaaatgtcttgcattatacagcaaccttttgggaatgagtggatggattgaataaaatttgattaagagtggatgatttatctgtagattattattggacagttagtcttgaagtagtctaagaattaggttataatcagtagaagccttgctaataatgaggaggttagtttatgtatagtagactgaatctaaaatagtacgaaacaattgctaaaacatttatagaaattaattttactttcccaatcgatttgttctcatcttatttcaatccgctatatattatggtatcgaatcttcatcagaatgataaaattaatcaattgatatctgattacaaacagaatatgaaagctttttatatcactattgaaaaatttatacgagatgatgaaagccttaagtgttattttataaaggttatttcaagtcgttccaaggtaacaagtctagatcagattgaagctgataaaacgatacaaagaaaatattcaagtgagctaaaaaaatttattggattttataatgagattatttgtgaggaaaatagtttcctacatgtacgaaagaggtggtcgagttggtttaggtagtcgatgcgtgagttgataattctcagggtatggacttctttttcatgaatgaggtaaaagagcaggtattgtttagagacaatcattctgagcatattttctggatagagggagtatccgattttatgatcaaagttaataccgccctctggtgagaagatgagtaggttggtaatttaaactattaaacagaatttttgattaaaagtattatttcatgagagaaatcctaatttcacaatccataggcaaacgcttgcatttcgttttttattggactataataggttggtataaagccttctgtagtaataaaatgtagaaggtgtagaaagtaaggatttagaatatttgtagttaaaaacacaatgttgctattccttacgatagggagatagatatggcaatgatagaagtggaacatcttcagaaaaattttgtgaagactgttaaggaaccgggcttgaagggggctttgcgctcctttattcatcctgaaaagcagacctttgaagcggtcaaggatttgacctttgaggttccaaaagggcagattttaggatttatcggggcaaatggtgctgggaagtcgacaaccattaaaatgctgacaggaattttgaaaccaacatctggtttttgtcggattaacggcaagattccccaggacaatcggcaagattatgtcaaagatattggcgtagtctttggacaacgcacccagctatggtgggatttggctctgcaagagacctacactgtcttaaaagagatttatgatgtgccagactcgctctttcataagcgtatggactttttgaatgaagtcttggatttgaaggactttatcaaggatcccgtgcggactctttcactgggacaacggatgcgggcggatattgcggcctccttgctccacaatcccaaggttctttttttagatgagccgaccattggtttggacgtttcggttaaggataatattcgtcgggcaattactcagatcaatcaagaggaagaaactaccattcttttgaccactcacgatttgagtgatattgagcaactttgtgatcggattttcatgattgacaaggggcaagagatttttgatggaacggtgagccaactcaaggagacctttggtaagatgaagactctctcttttgaactgctaccaggtcaaagtcatctcgtctctcactatgacggtctgtctgatatgaccattgatagacaaggaaacagcctcaacattgaatttgatagttctcgctaccagtcagctgacattatcaagcaaaccctgtctgattttgaaatccgcgatttgaagatggtggatacggatattgaggatattatccgtcgcttctaccgaaaggagctctaggatgatcaaattgtggagacgttataaaccctttatcaatgcaggggttcaggagttgattacttaccgagtcaactttattctctatcggattggcgatgtcatgggggcttttgtggccttttatctctggaaggctgtctttgattcttcgcaagagtctttgattcagggcttcagtatggcggatatcaccctctacatcatcatgagttttgtgaccaatcttctgactagatccgattcgtcctttatgattggggaggaggtcaaggatggctccattatcatgcgtttgttgcgaccagtgcattttgcggcctcctatcttttcaccgagcttggttccaagtggttgatttttatcagcgttggccttccatttttaagtgtcattgtcttgatgaaaatcatatcgggtcaaggtattgtagaggtgctaggattaactgtcatttatctttttagcttaacgctcgcctatctgattaactttttctttaatatttgctttggattttcagcctttgtgtttaaaaatctttggggttccaacctacttaagacttccatagtggcttttatgtcggggagtttgattcccttggcattttttccaaaggttgtttcagatattctctcctttttgcctttttcatccttgatttatactccagttatgatcattgttggaaaatacgatgccagtcagattcttcaggcactccttttgcagttcttctggctcttagtgatggtgggattgtctcagttaatttggaaacgggtccagtcctttatcaccattcaaggaggttagtatgaaaaaatatcaacgaatgcatctgatttttatcagacaatacatcaaacaaatcatggaatataaggtagattttgtggttggtgtcttgggagtctttctgactcaaggcttgaatctcttgtttctcaatgtcatctttcaacatattccattcctagaaggctggacctttcaagagatagctttcatttatggattttccttgattcccaagggaatggaccatctcttttttgacaatctctgggcactagggcaacgcctagtccgaaaaggggagtttgacaagtatctgactcgtcccatcaatcctctctttcacatcctagttgaaacctttcagattgatgccttgggtgaactcttagtcggtggtattttattgggaacaacagtgaccagcattgtttggactcttccaaaattcctgcttttcctagtttgtattccttttgcgaccttgatttatacttctcttaaaatcgcaacagccagtatcgccttttggactaagcagtcaggcgccatgatttacatcttctatatgttcaatgactttgctaagtatccgatttctatttacaattctcttcttcgttggttgattagctttatcgtgcctttcgcctttacagcctactatccagctagctatttcttacaggaaaaggatgtgttctttaacgtaggaggtttgatgttgatttctctggttttctttgttatttcccttaaactttgggataagggcttagattcctacgaaagtgcgggttcgtaaaagctaaagtaagactaaaatcaagaaagaaacttatgatgtttgtaattgaagaagtcaaggatgaaaatcaaaaaaaggcagttgtcgctgaggttttgaaggatttgccagaatggtttggaatcccagaaagcacacaagcctatatagaaggaaccacgacactgcaagtttggaccgcctatcaggagagtgatttgactagatttgtaagcttatcctattcgagtgaagattgtgcagagattgattgtctcggcgtaaaaaagcttatcaaggtagaaaaattgggagccaattgcttgctactttagagagtgaagctcgtaaaaaagttggttatctgcaggtcaaaacagtggcagaaggttctaataaagattatgatcgaacaaatgacttttatcgaggtcttggctttaaaaagttagagatttttcctcaactatggaatccgcaaaatccttgtcagattttgattaaaaagcttgaataatattacttgacatctattctcagagtgctatactgtaagtgtaatcgccgatttagcttagttggtagagcaaggcactcgtaaagcctaggttataggtagataaacgactgaggatttgaaaaaatagataggtagaagataaccgttaagccttactcttagcggttatttatattgtttaatagcgctaatattttatcaattatgcctgttttcgtgtttctggtagttgttcaagtttattgctactatttttgatggtatgaatgtgcttataatgtatcccggttaacgaaagttttggacttatactcttcgaaaatctcttcaaaccacgtcaacgtcgccttgccgtgcgtatggttatgacttcgtcagttctatccacaacctcaaaacagtgttttgagtgactacgtcagttccatctacaacctcaaaacactgttttgcccaatctgcggctagtttcctag

SEQ ID NO: 2 - DNA, 7571 bp; double-stranded, linear
ctctccagctttccttgcgagttggccatgttgtgtctttaagaagtctaaaaatatctccaataaaacgcatcgctctctcctatctcgtttctctgtgtgtagtgtacttgccacaatgcttacaaaatttatttacttctagtcgtgtaggcttgaggtttccgctgatcttgattgaatagtttctcgaaccacaaaccgcacaagctaggcttgctttttttagtgccataacgcctccatcttatccattataacaagaaagctaggctttgacaagcatcttagcgaaatagattgactatcgaatcccatattgtttgagccttttccttaatcttcgcatctgagatagcccggctagcctcatctactagactttgcgcacgccctcgaatatcagacaaattatcatctgtctggctattatcattggtttgtacttgtctttttgtattggctggtgcaattccattttgcttataagcattttcaaccgtaaaggtacttcctggcgtataaggtaaaatggtattggcaatgtttctaaagacatgagctgcaccgtttgaagtagagccagctagatagtggttttcatcagtggtcggaaagccaagccagtggctaatcactacatccggagtataaccaattacccactggtcacttgtgtactccggattgaaaactgcttcagttgttccagttttccctgccatgacatagtctgcaggcgatgaactaataccggtaccgttggtgaaagtccccaacatcatactggtcatcttgtcagctacagacttatcaatcacccgtttttgtgaatttttatgactcgcaataacttgtccactagcattttcaattctactaataaaatgagcttcaggcattaaaccttcatttgcaaaggcggcgtatgcttgagccatttgaagagggttggtttcaacaccgcttcccaaggcgacaccaagaacacggtcgaccttttccatgttgagtccgaatttttcgcctgcctcaaaagccttgtcgacacccaaatcattaacagtggcaacagcaggtagattaagcgattctgccaaggcttgatacataggaacttctcgactcgttttgatccctgcatagttatcaaccttatagctgtcatactgcatggtatggttatccaactgcttattcaaagcccagcttgcttcaactgctggcgtataaacaactaaaggcttaattgtagaaccaggactacgctttgattgggttgcatagttgaaattccggaatccagttttatcattgtcagcaacttgaccgacaactccacgaactccccctgttttcggttcgagggctacacttcctgattgagcaaacgttccatcctctgccctcggaaatagcgatgtgttttcataaacaatctgcatatttgcttggtagttttggtccagctctgtgtaaatgcggtagccattattgacaatctcttcctctgttagattatacttggaaacagcttcattaaccaccgcatcaaaataagaggggtaacggtaatctgagatttttccttcatacttatcgtgcaattgcgaagtcatatcaacttcagcagctttggtttcttggtttttatcaatatatcctgctgcaaccatattctgcaagacagtatcgcgccgattagtagaatcttctacggaattcaagggattatacagttccggccccttgagcatccctgccagagtcgcagcttgatccagactcacttctgatgcagaaactccaaagtatttcttactcgcatcttctacaccccacacaccatttccaaaataagcgttgttaaggtacatggttagaatttgctccttactatattttttgcttaattctaaggcaaggaaaaattctttcgcttttctctcaacagtttgatcctgcgataaataggcgtttttagccagctgttgggtaatggtagagccaccacctgaacgtccagcagtgacaatagccaagaaaaaacggccatagttaatcccgtcatttttatagaaagaacggtcttctgtcgcaataacagcattctgcaagtttttactgatgtcagtcagctcaacataggttcccttttgaccagacaaggcaccagcctctttttcttcacggtcaaaaataagagtccgagttttcaaggcattttgcaaatcattgacattggtcgacttggctacagcaaacaaatagattccaactagcaagcctgcactcaaacctagtataaggataatctttgttagatgataacgacgccagaattttcgaatcggacctacttgggctaatttttttcgatcactacgagagcgacgtaagatagtagaatcagagtcctctagttcacttgtttcttttttaaaaagagaaagaaatttctcaaataatttatctaatttcatgcgtttattttatcatcttcatcataggaagacaagaatttagctatttcctatccaaatagggctttttttgttacaatatctgtatgcaattcacatttacattacccgcctctctacctcaaatgacagtaaagcaattacttgaggaacaactcctcatccctagaaaaatccgtcattttttgagaatcaagaaacatattttgataaatcaagaagaagtccactggaaggaaatcgtaaatcctggagatgtttgccagttgacttttgacgaggaagattattcccaaaagacgatcccttggggcaacccagacttagtgcaggaagtttatcaagatcaacacttgattattgtaaacaaaccagaggggatgaaaacgcatggtaatcaaccaaacgaaattgcccttcttaaccatgtcagtacctatgttggccaaacctgctatgtcgttcatcgtctggacatggaaaccagtggcttagttctctttgccaaaaatccttttatcctgcccattctcaatcgcttattggagaaaaaagagatttctagagaatattgggctctagttgatggaaatatcaacagaaaagaacttgttttcagagacaaaattggacgtgatcgccatgatcgtagaaaaagaatagttgatgcaaaaaatgggcaatatgctgaaacgcatgtaagcagattaaagcaattctcaaacaagacttccttggctcattgcaagctaaagacagggcgaacccatcagattcgtgtgcacctttcgcatcataatcttcctatcctgggagaccctctctataatagtaaatcaaagacaagccggcttatgcttcatgccttccgactttcctttacccacccacttactttagagaagctaactttcactaccctttcaaatacatttgaaaaagaattaaaaaagaatggatgatcgtgtcatccatttttccatataaaaaagcaagaccacaaagccttgctttctatcaactcaagaattatttagcaatttttgcgaagtattcaagagtacgaacaagttgtgcagtgtatgacatttcgttgtcgtaccatgatacaactttaaccaattgtttaccgtcaacgtcaagaactttagtttgagttgcgtcaaacaatgaaccgtaagacatacctacgatatctgaagatacgattggatcttctgtgtaaccgtatgattcgtttgaagctgctttcatagctgcgttcacttcatcaacagtaacgttcttttcaagaactgctaccaattcagtaactgatccagttggagttggaacgcgttgtgcagatccgtcaagtttaccattcaattctgggattacaagaccgatagcttttgcagcaccagttgagttaggaacgatgtttgcagcaccagcgcgagcacggcgaaggtcaccaccacggtgtggtccgtcaaggatcatttggtcaccagtgtaagcgtggatagtagtcatcaatccttcaacaacaccaaagttgtcttgaagagctttagccattggagccaagcagtttgtagtacatgaagcacctgagataactgtttcagtaccgtcaagaacgtcgtggttagtgttgaatacaactgttttaacgtcgtttccaccaggagcagtgataacaacttttttagctccacctttaaggtgtttttcagctgcttctttcttagcaaagaaaccagtagcttcaagaacgatttctacaccgtcagtagcccagtcgatttgttctggatcacgttcagcagaaactttgatgaatttaccgttaacttcaaatccaccttctttaacttcaacagtaccgtcgaaacgaccttgagttgtgtcgtatttcaacaagtgtgcaagcataactggatctgtaaggtcgttgatgcgtgtaacttcaacaccttctacgttttggatacgacggaaagcaagacgaccgatacgtccgaaaccgttaataccaactttaactaccattagtgatttcctccttatgaaaatcatgaaatttttattgtgaaaagagtaacttgaatcactacaaatcacctttcaacaaacctattatacaactatttgagttgaattgcaagtatggccattgtttttctatgttagtttctttttaagactgtaaaccaaggaatcccttactattcatagcataacgattctataggatccattttactaatcttacgcgccgggaagtaggctgagacataaccaagtaatagagcgaaaactagagttcctaaaacagataaaagatttaatttaaaaaccttagtgatggatgggtaaaagtgacttacaatcgcattcgccaaacttcccaccccttgtgcaaccaaaaatgccagcagcaaggcgatgcctacaatccagatagcctcgtaaataaaaattcctttgacatcacgattctgataaccaactgctttcatgacacctatttccttggaacgttgcatgatattgatgtaaataatgataccaatcataaccgctgctaccacaatagcttgtgatgaaagcacaatcaataatccctgaataacacgaataaaggtaatcacaatatcaagaactctctgttgagaaagcacagtatacttcttatttttctgtaattcttctgttactacttttgtctgtgatggatctttgagttccaagataaaataagatacagctttcgtaaatccagcctctttcaaaatcgtttccatttgatgagacagcatgaaactgttgctgtcctccatgtcatcttcatcattgattacacgtacaatcttcgtttgaaattgagcaatcttactagtttcggcagcactttctacaatgctggctgagactgatttgccaataagatcattagctgtcaaattttttcctgtctgttcattccaattttttagtaaactgcttggaatcgttaatccctgttcatttgtatcagtatagagggatccagccaacactttgtccgtctcattattactaacagagatacttgtatcatcataaagactcactacttgagcataagaaggcatcgtttgactcagatccatttcttgcccatctatagtaatatttgacatgttcatcccaaaaggactctccaaatatttaatagcttctttcccaactgtatccgtgatatatagtcaattgaaacaagagcaggataaaaaagcctcgtaaaaggtattgcaacttggtaatacctttttgaggtgctttttgatatgagcccatgttttctcaataggattgtactcaggcgagtagggaggaagaggtaaaagtttatgcccaaactcttcgcataaaagttctagcttccccattctatggaatcttacattatccataataataaccgatggtgtgtttaatgttggtaagagaaaattctgaaaccaagcttcaaaaaagtcgctcgtcatcgtctcttcgtaagtcattggagcgattaattcaccatttgttagacctgcaaccaaagaaatcctctgatatcttcttccagatactttgcctcttattaattgaccttttaatgagcgaccatattctcgataaaaataagtatcgaatcctgtttcgtcaatctaaacaggtgctaggtgctttaaactattaaaattcttaagaaataaggctactttttctgggtcttgttcatagtaggtgtggttcttttttcgagtgtagcccatagctttgagcgtatagtggatggtagttggatgacagccaaattcagaagctatttcagtcaaataagcgtctggattgtcagtaagatagtttttaagtctatctctatcaacctttcttggttttattccttttacttggtggtttagctctcctgttttctcttttagctttaaccagccataaatggtattacgtgagatttggaaaacgtgtgatgcttctgttatactacctgttcgctcacaataagagagaacttttttacgaaaatctattgaatatgccataaaaagattataccacattgtgtactatttttggttcattttactatatttgaagaggcgtttaaactatctgacataaaactcgttctagaggaaagacatcctttaaaaagttagtttattttacaacttagacatcaaggtaggttaaccccttcatggaaaaatcaagactcttagcactatgggttaaactaccactggagacgtaatcaatcgctaaaccacgaaaacggctaatagtggtcatatcaatatttccagaacattcaatccgagaacgtcctgcaattagggtaatggcctgttcaatctgttccaatgacatattatccaacatgataatatcagcacccgccgccgcagcttcttcggcagcagcaaggctttccacttccacctcgaccattttcacaaaaggggcataggcacgcgcttgagcaattgccttttgaacactacctactgccgcaatgtgattgtcttttagcaggatagcatctgataaattaaagcgatgattatagccaccgccaactctcacggcatatttctcaaaaagacgtaaattaggagtagtttttcgagtatcaaataccttaatgcaatcatcgcctaaggcttctacataagcagctgtcatcgaagcaatccctgataaatgttgtaaaaaattcaaggcaacgcgttcacatgttaagagacttctcaccgagcctatgatttctaaaaccaaatcgccactagtcaaacgatccccatccttaaattgatgaggattctggaaggtcacctcggcatcaaatagggtaaaaaccctttgaaaaacggttagccccgctaaaacaccagcttccttggcaaaaagcgacaccttggcttggccatgatgatcaaaaatggcattggtactgtaatcttcggaatgaacatcttctcgcaaggctgctttcaatgtatcatctatttgaaaaggggttaaatcagttgaaatgattgacatcac

SEQ ID NO: 3 - DNA, 26385 bp; double-stranded, linear
tttgctagtggcttaaattcttcaggaaaatcaggcgtatctaaaagtcgtgtcgtttttgtttcatctatataaagacttcctgctccccctacaactagaaaacgtgtctgtgttccagcaagaagctgattaaatagttcgattgatttgctgtggagcggtagcgtatctggtgtataagcaccaaacgctgaaataacagcatcaaatccagtaagatcatcttttgtcaactcaaataaatcttttttaataatagactcagcttgacttttgttttcagaacgaacaatagccgttacttcatgtcctcgtttgactgcttcttcaacaattgctttccccgcttgtccatttgctgcaataactgctagtttcattttttatacctctcttgttgtaattattttagttacagaaattgtgacactcttaataatcaatgtcaatagtcttgcttaattattatcaaaatatttctaccaagaaaactaaccatgattctagtgaaaaaaaatcttctttgtcaacaaatttactttcttgttttaaacatgctataataatcatagcaagagatctaagttgtctgtttttttaaaacgaggtgattatcatgcgtagattctattcccatctcccctactatctggtcatattattcttttattggccactttatgagttgttcttactagttgtttctgacccccttacactcaagggactctatataaacaatcttctcttctttacacctctggtaatcttgattgtatcgttactctatagctaccgtttccgtttctcactttgatggttagttggtaacggactgctcttttactttactatcataacctttggtgagtttatactaatttacttgctaatctatgaaacagttgctctggtcggcatggattctggtattagcatcaagcatattctacaaaaaatgaaaaacaaaaaactttcacaaaatccttgaaaaatctcacaatcatgctataataatccatagagacaagtcacttagtccctttctactagagagtgcgtggttgctggaaacgcataggaagtctaaactgatactactcttgagttttttatgaaaacataaaacggtggccacgttagagccgatcagaggtgtccctctcttttgaggtacataaatgaaggtggaaccacgttgcgacgtcctttcgaggatgtcgcatttttttattaggatactaattatggagttgcaagaattagtggagcgcagttgggcaatccgacaagcttatcacgaactggaagttaagcatcatgattccaagtggacggtagaagaagacctcttggctttatctaatgatattggaaatttccaacgactggtgatgacaaagcaaggacgctactatgatgaaacaccctacacactggaacaaaaactttcagaaaatatctggtggctattagaactttctcaacgtttggatatagacattctgacggaaatggaaaacttcctctctgataaagaaaagcaattgaacgttaggacttggaagtagtctgctgataaaaaatcaatgcttagaaactatgaaataataaaaaaggagaacatcatgattaacattactttcccagatggcgctgttcgtgaattcgaatctggcgtaacaacttttgaaattgcccaatctatcagcaattccctagctaaaaaagccttggctggtaaattcaacggcaaactcatcgacactactcgcgctatcactgaagatggaagcatcgaaattgtgacacctgatcacgaagatgcccttccaatcttgcgtcactcagcagctcacttgttcgcccaagcagctcgtcgtcttttcccagacattcacttgggagttggtccagccatcgaagatggtttctactacgatactgacaacacagctggtcaaatctctaacgaagaccttcctcgtatcgaagaagaaatgcaaaaaatcgtcaaagaaaacttcccatctattcgtgaagaagtgactaaagacgaggcacgtgaaatcttcaaaaatgacccttacaagttggaattgattgaagaacactcagaagacgaaggcggtttgactatctatcgtcagggtgaatatgtagacctctgccgtggacctcacgttccatcaacaggtcgtatccaaatcttccaccttctccatgtagctggtgcgtactggcgtggaaacagcgacaacgctatgatgcaacgtatctacggtacagcttggtttgacaagaaagacttgaaaaactaccttcaaatgcgtgaagaagctaaggaacgtgaccaccgtaaacttggtaaagagcttgacctctttatgatttcacaagaagtgggacaaggtttgccattctggttgccaaatggtgcgactatccgtcgtgaattggaacgctacatcgtaaacaaagagttggtttctggctaccaacacgtctacactccaccacttgcttctgttgagctttacaagacttctggtcactgggatcattaccaagaagacatgttcccaaccatggacatgggtgacggggaagaatttgtccttcgtccaatgaactgtccgcaccacatccaagttttcaaacaccatgttcactcttaccgtgaattgccaatccgtatcgctgaaatcggtatgatgcaccgttacgaaaaatctggtgccctcactggccttcaacgtgtacgtgaaatgtcactcaacgacggtcacctattcgttactccagaacaaatccaagaagaattccaacgtgcccttcagttgattatcgatgtttatgaagacttcaacttgactgactaccgcttccgcctctctcttcgtgaccctcaagatactcataagtactttgataacgatgagatgtgggaaaatgcccaaaccatgcttcgtgcagctcttgatgaaatgggcgtggactactttgaagccgaaggtgaagcagccttctacggaccaaaattggatatccagattaaaactgcccttggaaaagaagaaaccctttctactatccaacttgatttcttgttgccagaacgcttcgacctcaaatacatcggagctgatggcgaagatcaccgtccagtcatgatccaccgtggggttatctcaactatggaacgcttcacagctatcttgattgagaactacaagggggccttcccaacatggctggcaccacaccaagtaaccctcatcccagtatctaacgaaaaacacgtggactacgcttgggaagtggccaagaaactccgtgaccgcggtgtccgtgcagacgtagatgagcgcaatgaaaaaatgcagttcaagatccgtgcttcacaaaccagcaagattccttaccaattaattgttggagacaaagaaatggaagacgaaacagtcaacgttcgtcgctacggccaaaaagaaacacaaactgtctcagttgataattttgttcaagctatcctagctgatatcgccaacaaatcacgcgttgagaaataagagtctagcataaaagcctccaatctggaggctttttctcatctatttttactcaaggactaagttcacttgagcaaactgaatccgcactgtcgttccttttccgacctcagactcgatacgaatctggtgccccagttcttcagaaattttcttagatagataaaggccaagtccagaggactgctgggtcaaacggccattgtatcctgaaaagccacgttcaaatactcggaggacatcactgttttttatcccgattcccgtatctttgatacaaagctcttggtcatccatataaatctccagaccaccttccttggtgtacttgagactgtttgagatgatttgctcaataaccactagcagccactttttatccgtcacgatttctttatcaaggtcatgtagattgacatttaagcctttttgaataaagaaaagagcatatttacgaattatttccttgaccaagtcctcaatttgaacctgctttaagaccaaatcatcatggaaactttctaaacgcaggtactgtaaaactaggttggtataggagtcgattttgaaaatttcctgttctagctgctgcttcagttggcggtcgaccacttctgcaactaagagttgactggctgcaatgggggtctttatctgatggacccacaaggtatagtaatccagcaaatccgtcagttttctttctgcttttgacctctgctgatagagttccatctcacgcgcttctaatttttctgctaaagctatttccaaaggagacttggcttccctctctccatagagaagttcctggcgatagacctgcgtttccaccaatatgtcccaagtgaaaaataatatggttacaaagcaacacaagaagaaaaagtagaggaagtaaattcctagactggcaaataaaaactgaaagagtaagacaagaaatgccaaagaaagcagatagataaaaagacgactacgggagcgcagataggctagaaaaaattgtttccaatcaagcatgcttcaatccgtaccctattcctttcttggtctcgataaatcctaccaatccctgctcctccaactttttacgcaaacgagccacattgacagagagggtattatcatcaatgaaaaagtcactgttccaaagttcccgcatcaggtcgtcacgtgctacgatgttgcctgcatgctcaaataacacgcgtaaaatctggaattcattcttggtcaaattcaagacttgcccttgataatgtaaatccatggatttggtattgaggataacaccagcatattccagcaaactctcatcacgcccaaactcataggaacgacgcaacaagccctgaaccttagctaaaagaacctgctggtcaaaaggcttggtcacaaagtcatccgcccccatattgattgccatgacaatatccatagcctggtctctcgaagaaagaaacatgataggtaccttggaaatcttgcggatttcctgacaccagtgataaccattaaacaagggcaaaccaatatccatgaggaccagatgaggttccgactgaacaaatagactcaaaacttccataaagtcttctaccaggaccacttcaaatccccattcagagagcattttcccaatctgttgacgaatgacctgatcatcttctattaataaaatcttgtgcatgcgcttctccttttccattattataacagatttttccatgctagatggtctgaaactgaatttgaaatagcctgtttttagccagtacaaacaggctatgctactagctaatttgagggaaatttgctaagataaataaaaagaaaggagctcttatggccaatatttttgactatctgaaagatgtcgcatatgattcttattacgaccttcccttgaatgagttagacattctaaccttaatagaaatcacctacctctcctttgataatctggtctccacacttcctcaacgtcttttagatctagcacctcaggttccaagagatcccaccatgcttactagcaaaaatcgccttcaattattagatgaattggctcaacacaagcgcttcaaaaattgcaaactctcccattttatcaacgacatcgaccctgaactgcaaaagcaatttgcggctatgacttatcgtgtcagcctcgatacctatctgattgtctttcgtgggacagatgacagtatcattggctggaaggaagatttccacctgacctatatgaaggaaattcctgctcaaaagcacgcccttcgctatttaaagaacttttttgcccatcatcctaagcaaaaggttattctagctgggcattccaagggaggaaatctcgctatctatgctgctagccaaattgagcaaagtttgcaaaatcagatcacagcagtttatacatttgatgcacctggtctccatcaagaattgacacagactgcgggttatcaaaggataatggatagaagcaagatattcattccacaaggttccattatcggtatgatgctggaaattcctgctcaccaaatcatcgttcagagtactgccctgggtggcatcgcccagcacgatacctttagttggcagattgaggacaagcacttcgtccaactggataagaccaacagtgatagccagcaagtagacacaacctttaaagaatgggtggccacagtccctgacgaagaacttcagctctacttcgacctcttctttggcactattcttgatgctggtattagctctatcaatgacttggcttccttaaaggcgcttgaatacattcatcatctctttgtccaagctcaatccctcactccagaagaaagagaaaccttgggtcgccttacccagttattgattgatactcgttaccaggcatggaaaaatagataatactcttgaaaattaaatgtatacaaaacaaaagacctagaatacatactttcatgtgcattctaagtctttttaaatagaatctaatagtcaataaaaatcaaagagcattgagagataatggggcttggaacgtccctctcgcttcaacaaaatgaccccattatagattaaaaagatgccacttagaaaaagcaaaaaaggaagtaagacaaaggcaaatatataaaaagctaactgaacattctcgtatccatttttataaaaaaggtaggatagataaaaataacttgaaatgagggataataaaaataatactggattccacaaacttctattatccttccaaaatgacactataaaggctaatacaattcctataacgagatacatttcttactcctttaatagctacattttatcataattatccaaagaaaaaagagggcatttatccctcttaatccttcatctgactctctgcatcggccacgactttttctagactggtttgaccaagttctgcctccatagtcaactgaattctctccaatttttgatccaaaacatcatgaatatgagctcctacagggcaatttggattcggattgtcatggaaactgaagagttgacctgtcttaccaagacattcgaccgcctgataaacatctaaaagactaatatccttaaggtccttgacaatctctgttccgcccgttccacgcgctactgaaatcagctctgccttcttcaactgggacaagatctttctgataatgacaggattgaccccgacactagcagccagaaaatcactggtcaccttgctttccttcccctcgagggcaatgattatcagcatatgagtcgcaatggtaaatctacttggaatttgcatcctcttctcctttttacgaggctaccctgcctctactcttctttttctattattataccctttttagttgtaatgtcaatcgttaccacttttcaaccagtcgtctaactcccgatcgcagccctctttctgagccaattctctcaaaaattcctgatgatgagtatggtggatcccattgaccagactttcatagtaaacctcaaaatagggaagtctcaggtctttagccagctgcaattcagctgctacatcgtagtctacccgtcggaagtccatatctaccaggcctttgtcatcaaactccaaaatcatatactgggcccgcaagtccttccgtagctgagcgtccaaaaagaaaggttggccaatcgaacccggattgacaatcaattgcccaccagtcccgtaacgaagcaactgctggtgaatatgtccataaacagcaatatcacagggaggatgagtcaccaagcggtcaaactcctcttgtttgccagtatgaatcaactctcgcccccagttcttatcaggcagatgatggctaattcccaccgtcaaatccccaaactgacgatgaatttgaagaggttgattgtggagcacttcaatttcttctagggaaatttcctctaaaacatactggcactggcgcaagagatagcgttgactggggcgagtactgtccaattccttacggacaccatgccaaagactgtcttcccagtttcccaaaactctagccgtaatcggtagttgatccaacaagtccaaaatccttctacgccctgtccctggcatgagaatatctcccaaaagccagtattcatccactcctatctgccgagcatctgccaaaacagcctccaaggcggtggtatttccatgaatatctgaaagaagagctattttcgtcatatccatctcctcgttttttctcttgcaataagtataacataaaaagtcacagctagagaaatctagctttttttgatatactagataaagatattagacaagaggaaacgaatgaccccaaacaaagaagactatctaaaatgtatttatgaaattggcatagacctgcataagattaccaacaaggaaattgcggctcgcatgcaagtctctccccctgccgtaactgaaatgatcaaacgaatgaaaagtgaaaatctcatcctaaaggacaaggaatgtggctatctactgactgacctcggtctcaaactggtctctgagctctatcgtaagcaccgcttgattgaagtttttctagttcatcatttagactatacaagtgaccagattcacgaggaagctgaggtcttggaacacactgtctctgacctgttcgtggaaagactagataaactgctaggtttccctaaaacctgcccccacgggggaactattcctgccaagggagaactactcgttgaaatcaataacctcccactagctgatatcaaggaagctggcgcctaccgcctgactcgggtgcacgatagttttgacattctccattatctggacaagcactcacttcacatcggtgaccagctccaagtcaagcagtttgatggcttcagcaataccttcactatcctcagtaacgacgaggatttacaagtgaatatggacattgcaaaacaactctatgtcgagaaaatcaactaatttctcaagtcccctaccaaccctgaaagttttattttggctctttgtcaactgtagtgggttgaagtcagctaagctcgagaaaggacaaattttgtcctttcttttttgatattcagagcgataaaaatccgttttttgaagttttcaaagttccgaaaaccaaaggcattgcgcttgataagtttgatgagattattggtcgcttccagtttggcattagaatagtgtagttgaagggcgttgacaatcttttctttatctttgaggaaggttttaaagacagtctgaaaaataggatgaacctgctttagattgtcctcaatgagtccgaaaaatttctccggtttcttattctgaaagtgaaacagcaagagttgatagagctgatagtggtgtttcaagtcttgtgaatagctcaaaagcttgtctaaaatctctttattggttaagtgcatacgaaaagtaggacgataaaatcgcttatcactcagtttacggctatcctgttgtatgagcttccagtagcgcttgatagccttgtattcatgggattttcgatccaattggttcataatttgaacacgcacacgactcatagcacggctaagatgttgtacaatgtgaaagcgatccaacacgattttagcattcgggagtgaaacagtctgggagactgtttcagcctgagcctagaaatttgaaagcgaagctgtttagccaagtcatagtaaggactaaacatatccatcgtaatgattttcacttgacaacgaacggctctatcgtagcgaagaaagtgatttcggatgacagcttgtgttctgccttcaagaacagtgataatattaagattatcaaaatcttgcgcaatgaaactcatctttcccttagtgaaggcatactcatcccaagacataatctttggaagccgagaaaaatcatgctcaaagtgaaagtcattgagcttgcgaatgacagttgaagttgaaatggccagctgatgggcaatatcagtcatagaaattttttcaattaacttttgagcaatyttttggttgatgatacgagggatttggtgatttttctttaccaggggagtctcagcaaccatcatttttgaacagtgatagcacttgaaacgacgctttctaaggagaattctagaaggcataccagtcgtttcaagataaggaattttagaaggtttttgaaagtcatatttcttcaattggtttccgcactcagggcaagatggggcgtcgtagtccagtttggcgatgatttccttgtgtgtatccttattgatgatgtctaaaatctggatattagggtctttaatgtctagtaattttgtgataaaatgtaattgttccatatgattctttctaatgagttgttttgtcgcttttcattataggtcatatgggactttttttctacaataaaataggctccataatatctatagtggatttacccactacaaatattatagaaccgtaaaaatagaaggagatagcaggttttcaagcctgctatctttttttgatgacattcaggctgatacgaaatcataagaggtctgaaactactttcagagtagtctgttctataaaatatagtagattgaaataagatgtgaacaactctatcaggaaagtcaaattaatttatagaattattttagcagtcaaggtgtactgttatagattcaatatattatatgactattaaccttgtcttctcctaaaattgactttcttgttttcttatcttgtccactcgaaacaagtattgtaagaatttgattatttttgaaagtacttttaatatacttgatatagttaaaaaagatttgaaactaaattccaaattagaaaaagacttgaaatactaaaaaaaaaaaagtatactctaattgaaaacggtaacaaaactaatttagagaatgaaatatagagtatttctctcttaaaagtttttggtgaaacgagatgtagaaaggagatttagccaaagagtctattagtgctagaataatagattagaattattttagaaaaacgaagtgagcagcttataaattcaagtccccaaatagattcatactagtatcttttgcaaaaaataaagggcgacttccttcatgaatatcaatttcatctataaggaaggtagctaattgaactaacttatttattctgtttgtcgctagaaaaatcagacctccttgtgaagattgaggagatacttaatgaaaatcaaagaagaaactagcaagctagtagcagattgcccaaaacaccgctttgaggttgtagataagactgacctatataatccaaggtgaagcgactgtggtttgaagagattttcaaagagtataggctagagagtagtgtttttatgtccttctagtagaaaatgctagacagaagaatggggaacttggataggaaaaatagattgagaaaggaggttagaagagatgattattacaaaaattagccgtttaggaacttatgtgggagtaaatccacattttgcaacattaatagattttctagaaaaaacaggactagaaaatttaacagaaggttcgattgctatcgatggtaatcgattgtttgggaattgctttacttatctagcagatggtcaagcaggggctttctttgaaacccaccaaaaatatttggatattcatttagttttggaaaacgaagaagccatggctgttacatcgccggaaaatgtaagcgttacccaagaatatgatgaagagaaagatattgaattatacacagggaaagtggaacagttggttcatttgagagctggcgaatgcctcatcacttttccagaagatttacatcaacccaaggttcgtataaatgatgaacctgtgaaaaaagttgtctttaaagttgcgatttcttaatgtagaaagagaagaacgatgaaaaaaatgagaaagtttttatgtctagctggaattgcgctagcggctgttgccttggtagcttgttcaggaaaaaaagaagctacaactagtactgaaccaccaacagaattatctggtgagattacaatgtggcactcctttactcaaggaccccgtttagaaagtattcaaaaatcagcagatgctttcatgcaaaagcatccaaaaacgaaaatcaagattgaaacattttcttggaatgacttctatactaaatggactacaggtttagcaaatggaaatgtgccagatatcagtacagctcttcctaaccaagtaatggaaatggtcaactcagatgctttggttccgctaaatgattctatcaagcgtattggacaagataaatttaacgaaactgccttaaatgaagcaaaaatcggagatgattactactctgttcctctttattcacatgcacaagtcatgtgggttagaacagatttgttaaaagaacataatattgaggttcctaaaacttgggatcaactctatgaagcttctaaaaaattgaaagaagctggagtttatggcttgtctgttccgtttggaacaaatgacttaatggcaacacgtttcttgaacttctacgtacgtartggtggaggaagcctcttaacaaaagatcttaaagcagacttgacaagccaacttgctcaagatggtattaaatactgggttaaattgtataaagaaatctcacctcaagattctttgaactttaatgtccttcaacaagctaccttgttctatcaaggaaaaacagcatttgactttaactctggcttccatatcggaggaattaatgccaacagtcctcaattgattgattcgattgatgcttatcctattccaaaaatcaaagagtctgataaagaccaaggaattgaaacctcaaacattccaatggttgtttggaaaaattcaaaacatccagaagttgctaaagcattcttagaagcactttataatgaagaagactacgttaaattccttgattcaactccagtaggtatgttgccaactattaaggggattagcgattctgcagcctataaagaaaatgaaactcgtaagaaatttaaacatgctgaagaagtaattactgaagctgttaaaaaaggtactgctattggttatgaaaatgggccaagtgtacaagctggtatgttgactaaccaacacattattgaacaaatgttccaagatatcattacaaatggaacagatcctatgaaagcagcaaaagaagcagaaaaacaattaaatgatttatttgaggctgttcagtagatgtaaaagactagaaaataggtgggatagtgagctgaaaagctctagcccaatcttgtaaaagaagggagaaggagaatggttaaagaacgtaatttaactcgctggatatttgttttgccagctatgattatcgtaggattactctttgtttatccgtttttctcgagtattttttatagctttaccaataagcatttgattatgcctaattataaatttgttggtttggctaactataaagctgtgctatcagatcccaacttctttaatgcgttctttaattcaattaagtggaccgttttctcattagttggtcaagttttagtagggtttgtattggctttagctcttcacagagtacgccacttcaagaaattatataggacattattgattgttccttgggcatttcctaccatcgttattgccttctcttggcagtggattctaaacggggtttatggctacttacctaatctaatcgtaaaattaggtttaatggaacatacacctgcatttttgacagatagtacatgggcattcctatgtttggtgtttatcaacatttggtttggagcaccaatgattatggttaatgtgctttcagctttgcaaacagtaccagaagaacaatttgaggctgctaagatagatggtgcttcaagttggcaggtgttcaagtttatcgtctttccacatattaaagtggttgtaggacttctagttgttttgagaactgtatggatctttaataactttgacattatctacctcattactggtggtggaccagccaatgctacaacgacgcttccaatttttgcttacaacctgggctggggaactaaattgttgggtcgtgcttcagcagttacagtactgctctttatcttcttggtggcgatttgctttatctactttgctatcatcagtaagtgggaaaaggagggtagaaaataatgaagaagaaatccagtatttatttagatattctctcacatgtacttttagttggtgcgaccatcgttgcagttttcccattggtatggattatcatatcttctgtcaaagggaaaggggaattaactcagtatccaacacgattttggcctgaacagtttacattagattatttcactcatgttatcaacgatttgcacttcattgataacattcgaaacagtttaatcattgccttggctacaacccttattgcgattattatttctgctatggcagcctatggtattgttcgattctttcctaaattgggagcaatcatgtcgagactactcgtcattacctacattttcccaccaattttgttagcaattccctattcaattgccattgctaaagttgggttaacaaatagtttatttggcttgatgatggtttatctatcttttagtgttccatatgcagtttggctcttagttggatttttccaaacagttccaattggaattgaagaagcggctagaattgatggtgcaaataaatttgttacgttttataaagttgtgctaccgattgtagcaccaggtattgtagcaacagctatttatacatttatcaatgcttggaatgaattcctgtatgccttgattttgattaacaatacaggaaagatgacagtagcagtagcccttcgttcacttaatggttcagaaatactagactggggagatatgatggcagcgtctgttattgtagttcttccatcaattattttcttctctatcatccaaaataagattgcaagtggattatcagaaggatctgtgaagtagacgaaagaaggaaaaaaatgaataaaagaggtctttattcaaaactaggaatttccgttgtaggcattagtcttttaatgggagtccccactttgattcatgcgaatgaattaaactatggtcaactgtccatatctcctatttttcaaggaggttcatatcaactgaacaataagagtatagatatcagctctttgttattagataaattgtctggagagagtcagacagtagtaatgaaatttaaagcagataaaccaaactctcttcaagctttgtttggcctatctaatagtaaagcaggctttaaaaataattacttttcaattttcatgagagattctggtgagataggtgtagaaataagagacgcccaaaagggaataaattatttattttccagaccagcttcattatggggaaaacataaaggacaggcagttgaaaatacactagtatttgtatctgattctaaagataaaacatacacaatgtatgttaatggaatagaagtgttctctgaaacagttgatacatttttgccaatttcaaatataaatggtatagataaggcaacactaggagctgttaatcgtgaaggtaaggaacattacctcgcaaaaggaagtattgatgaaatcagtctatttaacaaagcaattagtgatcaggaagtttcaactattcccttgtcaaatccatttcagttaattttccaatcaggagattctactcaagctaactattttagaataccgacactatatacattaagtagtggaagagttctatcaagtattgatgcacgttatggtgggactcatgattctaaaagtaagattaatattgccacttcttatagtgatgataatgggaaaacgtggagtgagccaatttttgctatgaagtttaatgactatgaggagcagttagtttactggccacgagataataaattaaagaatagtcaaattagtggaagtgcttcattcatagattcatccattgttgaagataaaaaatctgggaaaacgatattactagctgatgttatgcctgcgggtattggaaataataatgcaaataaagccgactcaggttttaaagaaataaatggtcattattatttaaaactaaagaagaatggagataacgatttccgttatacagttagagaaaatggtgtcgtttataatgaaacaactaataaacctacaaattatactataaatgataagtatgaagttttggagggaggaaagtctttaacagtcgaacaatattcggttgattttgatagtggctctttaagagaaaggcataatggaaaacaggttcctatgaatgttttctacaaagattcgttatttaaagtgactcctactaattatatagcaatgacaactagtcagaatagaggagagagttgggaacaatttaagttgttgcctccgttcttaggagaaaaacataatggaacttacttatgtcccggacaaggtttagcattaaaatcaagtaacagattgatttttgcaacatatactagtggagaactaacctatctcatttctgatgatagtggtcaaacatggaagaaatcctcagcttcaattccgtttaaaaatgcaacagcagaagcacaaatggttgaactgagagatggtgtgattagaacattctttagaaccactacaggtaagatagcttatatgactagtagagattctggagaaacatggtcgaaagtttcgtatattgatggaatccaacaaacttcatatggcacacaagtatctgcaattaaatactctcaattaattgatggaaaagaagcagtcattttgagtacaccaaattctagaagtggccgcaagggaggccaattagttgtcggtttagtcaataaagaagatgatagtattgattggaaataccactatgatattgatttgccttcgtatggttatgcctattctgcgattacagaattgccaaatcatcacataggtgtactgtttgaaaaatatgattcgtggtcgagaaatgaattgcatttaagcaatgtagttcagtatatagatttggaaattaatgatttaacaaaataaaggagaaaaacatggttaaatacggtgttgttggaacagggtattttggagctgaattggctcgctacatgcaaaagaatgatggagcagagattactcttctctatgatccagataatgcagaggcgattgcagaagaattgggagcaaaagtagcaagttccttagatgagttggtttctagcgatgaagtagattgtgttatcgtcgcaactccaaataatcttcataaggaaccggttattaaggctgcacagcatggtaaaaatgttttctgtgaaaaaccaattgcgctttcttatcaagattgtcgcgagatggtagatgcgtgtaaagaaaacaatgtaacctttatggcaggacatattatgaatttctttaatggtgttcatcatgcaaaagaactcattaatcaaggagttatcggagacgttctatattgtcatacagctcgtaatggttgggaagaacaacaaccgtcagtatcatggaaaaaaattcgtgaaaaatcaggtggtcacttgtatcaccacatccatgaattggattgcgttcaattccttatggggggcatgcctgaaactgtaaccatgacaggtggaaatgtggcccatgaaggtgaacatttcggtgatgaagatgatatgatttttgtcaatatggaattttctaataagcgttttgccttgttagaatggggttcagcttatcgttggggtgaacattatgtcttaatccaaggaagcaaaggtgccatccgcttagacttattcaactgtaaaggaactcttaagctagatgggcaagaaagctatttcttgattcacgaatcgcaagaagaagatgatgatcggactcgtatctatcatagtacagagatggatggagcaattgcttatggtaaaccaggtaaacgtactccattatggctatcatctgtcattgataaagaaatgcgctatctgcatgagattatggaaggagctccagtatcagaagaatttgcaaaacttttgacaggtgaagctgccctagaagcaattgctactgcagatgcttgtacccagtctatgtttgaagatcgcaaagtaaaattgtcagaaattgtaaaataaattttggtattctcctatttataggtcgacttgctcctctgaaagtacttttagaggagctgtttgactttgctagtttttgaaactgaaatctattatactacaaactattgaaagcgttttaattttaaggtataataatctcatagaaataaagaaaaggaggaaagaggatgccacagattagcaaagaagccttgattgagcaaatcaaagatggaatcatcgtttcttgtcaggctcttcctcatgaaccgctttatacagaagcgggaggggtgattcccttgctggtcaaagcggctgagcaaggtggagcagtcggtatccgagcaaacagtgttcgcgatatcaaggaaattaaggaagtcactaaacttccaatcattgggattatcaaacgtgattatccacctcaggaacccttcatcacggctactatgaaagaagttgatgaattggcagaactggacatcgaggtgattgctctggattgtaccaagcgtgaacgctacgatggtttggaaattcaagagttcattcgtcaggttaaggagaaatatcctaatcagcttttgatggctgatactagtatcttcgaagaagggctagcagctgtagaagcaggaattgactttgtcggaacaaccttatcaggctacacatcctacagtccaaaagtagacggtccagattttgaattgattaagaaactctgtgatgctggtgtagatgtcattgcagaaggaaaaattcatacaccagaacaagccaaacaaatccttgaatatggagtgcgaggcatcgttgttggtggcgccattactagaccaaaagagattacagaacgcttcgttgctagtcttaaataagatgtgagggggagttttatgtttaaagttttacaaaaagttggaaaagcttttatgttacctatagctatacttcctgcagcaggtctacttttggggattggtggtgcactttcaaacccaaccacgatagcaacttatccaatactagacaatagtatttttcaatcaatattccaagtaatgagctctgcaggagaggttgtattcagtaatttgtcactacttctctgtgtgggattatgtattggcttagcgaaacgagataaaggaaccgctgcgttagcaggagtaactggttacttagttatgactgcaacgatcaaagctttggtaaaactttttatggcagaaggatctgcaattgatactggagttattggagcattagttgtcggaatagttgccgtatatttgcacaaccgatataacaatattcaattaccttccgctttaggattctttggaggttcacgcttcgttcctattgttacatcgttctcttctatcttgattggctttgtcttctttgttatttggccacctttccaacaacttcttgtttctacaggtggatatatttctcaggcgggtccaattggaacttttctatatggatttttaatgagactttctggagcagtaggcttacatcatataatttaccctatgttttggtatactgaacttggtggtgttgaaactgttgcaggacaaacagtggttggagctcaaaaaatattttttgctcaattagccgatttggcccattctggattatttacagaaggaacaaggttttttgcaggtcgtttctcaacaatgatgttcggtttaccggctgcctgtttagcgatgtaccatagtgttcctaaaaatcgtcgtaaaaaatacgcgggtttgttttttggagttgctttaacatcttttattaccggtattacagaaccaattgaatttatgtttctattcgtcagtccggttctatatgttgttcacgcattccttgatggtgttagcttctttattgcagacgtcttaaatatttcaataggaaacacattttcaggaggtgtaatcgatttcactttatttggaattttgcaggggaacgctaagacgaattgggttcttcagattccatttggacttatttggagtgttttgtattatattatttttagatggttcattactcaattcaacgttctaacgccagggcgaggagaagaagtagattctaaagaaatttctgaatccgcagattcaacttcaaatactgcagattatttaaaacaggatagcctacaaattatcagagccttgggtggatcaaataatatagaagatgtagatgcttgtgtgacacgtttacgtgtagctgtaaaagaagttaatcaagttgataaagcacttttaaaacaaattggtgcagttgatgtcttagaagtgaagggtggcattcaagcaatctatggagcaaaagcaatcttatataaaaatagtattaatgaaattttaggtgtagatgattaagtacttactgacttaataaaaaacagaggagagtgatggatgagtaggatgaaatgaaatcgcatacaagaaataaagaactcattatccaagttggatacgcttattacataggagaatacaaatgaaatttagaaaattagcttgtacagtacttgcgggtgctgcggttcttggtcttgctgcttgtggcaattctggcggaagtaaagatgctgccaaatcaggtggtgacggtgccaaaacagaaatcacttggtgggcattcccagtatttacccaagaaaaaactggtgacggtgttggaacttatgaaaaatcaatcatcgaagcgtttgaaaaagcaaacccagatataaaagtgaaattggaaaccatcgacttcaagtcaggtcctgaaaaaatcacaacagccatcgaagcaggaacagctccagacgtactctttgatgcaccaggacgtatcatccaatacggtaaaaacggtaaattggctgagttgaatgacctcttcacagatgaatttgttaaagatgtcaacaatgaaaacatcgtacaagcaagtaaagctggagacaaggcttatatgtatccgattagttctgccccattctacatggcaatgaacaagaaaatgttagaagatgctggagtagcaaaccttgtaaaagaaggttggacaactgatgattttgaaaaagtattgaaagcacttaaagacaagggttacacaccaggttcattgttcagttctggtcaagggggagaccaaggaacacgtgcctttatctctaacctttatagcggttctgtaacagatgaaaaagttagcaaatatacaactgatgatcctaaattcgtcaaaggtcttgaaaaagcaactagctggattaaagacaatttgatcaataatggttcacaatttgacggtggggcagatatccaaaactttgccaacggtcaaacatcttacacaatcctttgggcaccagctcaaaatggtatccaagctaaacttttagaagcaagtaaggtagaagtggtagaagtaccattcccatcagacgaaggtaagccagctcttgagtaccttgtaaacgggtttgcagtattcaacaataaagacgacaagaaagtcgctgcatctaagaaattcatccagtttatcgcagatgacaaggagtggggacctaaagacgtagttcgtacaggtgctttcccagtccgtacttcatttggaaaactttatgaagacaaacgcatggaaacaatcagcggctggactcaatactactcaccatactacaacactattgatggatttgctgaaatgagaacactttggttcccaatgttgcaatctgtatcaaatggtgacgaaaaaccagcagatgctttgaaagccttcactgaaaaagcgaacgaaacaatcaaaaaagctatgaaacaatagtccttagttattctataaaaagtagttttttaaagaacctaagagtgtatacccccttttccctctacacagatagtgtaagaaaagggggcttttgtttaaaatgtaagaaactgtcacgaaattaaaatgaagttcttacataagcgaatcataaaaaatttcattttgattttaaaacagttcaagaaagtcaaaaaattattctatttgaaagagaggtgccgactgtgaaagtcaataaaatccgtatgcgggaaacagtgatttcctacgctttcctagcaccagtattattcttctttgtcatctttgtgttggctccgatggtgatgggcttcattacaagtttctttaactactcaatgactaaatttgagtttgtaggcttggataactatatccgtatgtttaaagatcctgtctttacaaaatctctgattaacacagttattttggttattggatctgtaccagttgttgttctattctcactctttgtagcatctcagacctatcatcaaaatgtcattgccagatccttctaccgtttcgtcttcttccttcctgttgtaacgggtagtgttgccgtgacagttgtttggaaatggatttatgacccactatcagggattctaaactttgtccttaagtccagccacatcatcagccaaaacatttcttggttgggagataaaaactgggcattgatggcgattatgattattctcttgaccacttcagttggtcagcccatcatcctttatatcgctgccatggggaatattgacaattcactggttgaagcggcgcgtgttgatggtgcaactgagtttcaagttttttggaagattaaatggccaagccttcttccaacaactctttatattgcaatcatcacaacaattaactcattccagtgtttcgccttgattcagcttttgacatctggtggtccaaactactcaacaagtaccttgatgtactacctttacgaaaaagccttccaattgacagaatacggctatgccaacacaattggtgtcttcttggcagtcatgattgctatcgtaagctttgttcaatttaaagtacttggaaacgacgtagaatactaaagaaaggagacagctatgcaatctacagaaaaaaaaccattaacagcctttactgttatttcaacaatcattttgctcttgttgactgtgctgttcatctttccattctactggattttgacaggggcattcaaatcacaacctgatacaattgttattcctcctcagtggttccctaaaatgccaaccatggaaaacttccaacaactcatggtgcagaaccctgccttgcaatggatgtggaactcagtatttatctcattggtaaccatgttcttagtttgtgcaacctcatctctagcaggttatgtattggctaaaaaacgtttctatggtcaacgcattctatttgctatctttatcgctgctatggcgcttccaaaacaagttgtccttgtaccattggtacgtatcgtcaacttcatgggaatccatgatactctctgggcagttatcttgcctttgattggatggccattcggtgtcttcctcatgaaacagttcagtgaaaatatccctacagagttgcttgaatcagctaaaatcgacggttgtggtgagattcgtaccttctggagtgtagccttcccgattgtgaaaccagggtttgcagcccttgcaatctttaccttcatcaatacttggaatgactacttcatgcaattggtaatgttgacttcacgtaacaatttgaccatctcacttggggttgcgaccatgcaggctgaaatggcaaccaactatggtttgattatggcaggagctgcccttgctgctgttccaatcgtcacagtcttcctagtcttccaaaaatccttcacacagggtattactatgggagcggtcaaaggataatactctgcgaaaatctcttcaaactacgtcagcttcaccttgccatacttaagtattgcctgcggttagcttcctagtttgttcttcaattttcattgagtataggaaaatcaatctatcaagatacagaagtatattttatagatttagagaatatagaggttataagtgtctacaaaatggagggtatgcagttactttatgaagttttgtcagacacttataaacttaagaatggttttagttaactatcagaaacgaaggaaagagtatgatttttgacgatttgaaaaacatcaccttttacaaagggattcatcctaatttagacaaggctatcgactatctctaccaacatcgtaaggattctttcgaattaggaaagtatgatattgatggagataaagtctttctagttgttcaggaaaatgtcctcaatcaagctgaaaatgatcaatttgagtatcataagaactatgcagatttgcatttgctggtagaaggacatgaatattcgagctacggttcacgtatcaaagacgaggcagtagcattcgacgaagcgagtgacattggctttgttcattgtcatgaacactacccactcttgttgggttatcacaattttgcgattttcttcccaggtgagccacatcagccaaatggttatgcaggcatggaagaaaaggttcgaaaatatctctttaaaattttgattgattaaaaataggatgaattgtttttttgtaaagctttgataatactctaccatgaaattgatctttgtgaggtagagaaatgagaataaaatatttaaaaattggtatcttctaagtatgctgcaagagctagtttcttagatggacaggggattacagttgatgagatggcttggataattaggggcattgtgaatgcattgattggtagatacataaaattaggtacttatgcggctaagtatggtattagtatggcacgctcgatcttaagtagggtagctgcaactgcagcagcaagagtaggattactgaccaagatttctggatggattttacgagtagctgtgaatgtagctgatgtatatggtaattttgccaacaatattgctgcagcttgggatgcatatgataaaattcctaacaatggtcgtataaacttttaaaatgcgagaatgaaagcactttgtatttttttattgaatatgttagcttggacagtgcttgcaatgataattcgtggagggctagatggatttgataggcatacttggagtactattttaattgcgtcgctgttcggggtatatgattataagcccatagataaaaatagaaaaaagtccaaaagaaaaaatagatttgttcatggtagggacttatgaaagctttactgacaaaaaagaaaacagtttacaaagaaaaatgatggaggagcaaacatggcacaaaaaggagtaagccttatcaaggcagcatttgatacagataactttctcatgcgttttagtgagaaggtcttggacatcgtgacagccaatcttctttttgtcgtctcttgtttacccatcgtgacgattggagtggctaaaatcagcctctacgagaccatgttcgaagttaagaagagcagacgggtgcctgtttttaaaatctatctaagatctttcaagcaaaatctgaaactaggtcttcagctgggtttaatggagttaggaattgtgtttcttaccctttcagatctctatcttttctggggtcaaacagctctgcccttccaattgctgaaagccatttgtttaggtattctgatttttcttactatcgtgatgctggctagttaccctatcgcggcacgttatgacctatcttggaaagaaattcttcaaaaaggattgatgttggctagttttaactttccttggttcttcctcatgttagccattcttgtcctcattgtgatggttctttatctgtccgccttcagtctactcttaggtggctcagtcttcctactttttgggtttggactattggtctttatccagactggattgatggagaaaattttcgcaaaataccaataggagctttatttctgaaactactttcaaaggctccaaacgctattctataagcgagaaactaaaatcgg

SEQ ID NO: 4 - DNA, 2716 bp; double-stranded, linear
cctgcccgcattgccctaggcattaagtaaacatataaaagcatgtgagagactgttggaaaagcgaggaaatttcccctcttttcctctagtctctcctttcttttgctgattttattcaaagaaaatgatataatagtagttatggagaaaaagaaattacgcatcaatatgttgagttcaagtgagaaagtagcaggacagggagtttcaggtgcttaccgtgaattagttcgtcttcttcaccgtgctgccaaggaccaattgattgttacagaaaatcttccaatcgaggcagatgtgactcactttcatacgattgattttccctattatttatcaaccttccaaaagaaacgctcagggagaaagattggctatgtgcatttcttgccagctacacttgagggaagtttgaaaattccatttttcttaaagggaattgtgaaacgctatgtattttctttttacaaccggatggagcacttggttgtggtcaatcctatgtttattgaggatttggtagcagctggtattccacgtgaaaaagtgacctatattcctaactttgtcaacaaggaaaaatggcatcctctaccacaagaagaggtagtcagactgcgcacagatcttggtcttagtgacaatcagtttatcgtagtaggtgctgggcaagttcagaaacgtaaagggattgatgactttatccgtctggctgaggaattgcctcagattacctttatctgggctggtggcttctcttttggtggtatgacagatggttatgaacactataagaaaattatggaaaatccccctaaaaatttgatttttccaggcattgtatcgccagagcggatgcgcgaattgtatgctctagcggatcttttcttgttgcctagttacaatgagctctttcctatgactattttagaagctgcgagttgtgaggctcctattatgttgcgtgatttagatctctataaggtgattttggagggaaattatcgggcgacagcgggtagagaagagatgaaagaggctattttggaatatcaagcaaatcctgctgtcttaaaagatctcaaagaaaaggctaagaatatttccagagagtattctgaagagcatctgttacaaatctggttggacttttatgagaaacaagccgctttagggagaaagtaaaaagtgaggtaatctatgcgaattggtttatttacagatacctattttcctcaggtttctggtgttgcgaccagtattcgaaccttgaaaacagaacttgaaaagcagggacatgctgtttttatctttacgacgacagataaggatgtcaatcgctacgaagattggcaaattatccgcattccaagtgttcctttctttgcttttaaggatcgtcgctttgcctaccgaggttttagcaaggcacttgaaattgctaaacagtatcagctagatattatccatactcagacagaattttctcttggcctgttggggatttggattgcgcgtgaattgaaaattccagtcatccatacctatcacacccagtatgaagactatgtccattatattgctaaggggatgttgatccggccgagtatggtcaagtatctggttagaggtttcctgcatgatgtggatggggttatttgccctagtgagattgtccgtgacttgctatctgattataaggtcaaggttgaaaaacgggtcattcctactgggattgaattagccaagtttgagcgtccggaaatcaagcaggaaaatttgaaagaactgcgtagtaaactagggattcaagatggtgaaaagacgttgcttagtctttcgagaatctcctatgaaaaaaatattcaagcagttttagcagcctttgctgatgttctgaaagaggaagacaaggttaaactggtagtagctggggatggcccttatctgaatgacctcaaagagcaagcccagaacctagagattcaagactcagtcatctttacagggatgattgctcctagtgagacggctctttactataaagcggcggatttcttcatttcggcatcgacaagcgaaacgcaaggtttgacctacttggaaagcttagccagtggaacacctgtcattgctcacggaaatccttatttgaacaacctcatcagtgataaaatgtttggaaccttgtactatggagaacatgatttggctggtgctattttggaagccctgattgcaacaccagacatgaacgagcataccttatcagagaaattgtatgagatttcagctgagaactttgggaaacgagtgcatgagttttatctggatgccattatttcaaataacttccagaaagatttggctaaagatgatacggtcagtcagcgtatctttaagacagttttgtatcttcagcaacaggtggttgctgtacctgtaaaaggatctagacgcatgttgaaggcttcaaaaacacagttgatcagtatgagagactattggaaagaccatgaagaatagaaagaggaacagctatgaaaaaaacaattaatgagaagcggtcgtgataaaaagattgcgggtgtttgtgctggggtggcccattatctggatatggatccgactatcgttcaagtcatttggggtgttcttacttgctgttacggagctggaattgtagcttacattattttatggattatcgcga

SEQ ID NO: 5 - DNA, 13926 bp; double-stranded, linear
ctttggttttgccttattcaagacatgagggccatcaggaatgatctgaaactgcgaatctgttaacagtctatggagagctttcatagaactaagattcggtttatctttgctgccacaaattagtaaggttggataagggtaagttcctgctatatccgttaaatcaagtgtcttcaactcctcagaaactccgaccataagagtcttgtctgctccctgtttttcaaatactcttttgggaagtagtttaaaaatcagcaattgaagataaaataggatattccctgctaatttaagcgggcatcctgacagaatcaaagctcgaagatttggtaaatcgtaactggaaagttctagtgtcagggcagcacctaaggacaatccaatcaaaacaaaaggttctgtctcttgagctaggtgctgataaactcgctctttagcttgttgatagttactaactccagaaggaaataactcgatagcctcagaaggataatctgtcagtagattccgaacttctttccaagactctgctgactgccctaacccatgcaaaaatattaatttcatctagttctcctcaaggcttaattcatacaagcctctcactgcattacagccgtaaatagcttctgcttgggttaaatctgccaaggtcaagactttctcttctacctgtcctgtttctagcaaatgctgacggtaaattcctggcaagattccaagtcggataggcggtgtgtagagttttccagcgattttcagaaccaaatttcctatagaggtttcaagcagttctcctgacttattgtggtaaatcttctcttgttctcctaggctcaaatgcggtcggtgagtggttttaaagtaggtaaaggattgattcaaagcagcttcctgaagacagacttgggcctgacaaaagcttgtactgagaggggttaatacttgacgattgacttctatctctccagatttgctaaggctgattcgcaagcggtaatctcgattagcttcacaatcctgacactcttcctcaatcttgtgtcccaagtcttctgcatcaaaaggaaaagcaaaataacgactagcttttctcagcctttccagatgttgttcttcaaacatcagttgtttttggctgatttttccagttgtaattaattggaagcgagcttgtttacgatagagaactgctgccttttgatgaacctctcggtattcagattcccatgtgctatcccaagtaatccctccgccaactccataaatggcttgacctttgtgaagttgaatggtacgaatggccacattaaaaatccgtcgtccatttggaagcaagagaccaatcgttccacagtagactccacgcggttgaggctccaagtccttgataatctccattgtcgcaattttcggtgcacccgttatggaaccacaaggaaagagtgagcggaagatttcaacaaggtccacatcctctcgcaactgactcttgatggtcgaagtcatctgccaaacagttgaatactgctctacctgacacagacgctccacgtgctcgctcccaacttcagaaatacggttcatatcattgcgcaagaggtccacaatcatcatattttcagagcgatttttgggatcctgttccaaccaactggcctgttcaagatcttcttggtcagttaccccacgctgagtcgtccccttcattggtcgtgttgtcaactcgcgatcattttgctcaaaaaagagctctgggctcatggaaatcactgtcatctcgtcatgttccacataggcattgtagcccgcctcctgctctaccaccatacgattgtagatggcaaaaggattggcatttaacttttgcttaagttggacggtgtagttgacctgataggtatctccctgccgtaaatgatggtgaatttgggcaatggccttttcatagtctgctgcagacgttacttcctgccaatttgagggcaaatcaatatcctcataagtcagaggaataggggaagtttctacgatatcatgaacagtaaagtaaagcaggtactctcccagtaggggatccttgtgaactgctaatttttcctcaaaagcaggtgcagcctcgtagctgacataccccaccacataataaccttgctcttggtagctttccacttgtgccagcaaatctgccacttcttctacatttctcgttttcaactctttaataggctgggtaaaggtatatctctcccccaaagtcctaaaatcaatcactgtttttctatgcataccttaagtatagcataaaataagaaaaccctcatccgcaaagcagatgagagatttcaattatttaaagattgaagttttaaagctatttgtttgttgaagaagtttcttataaacagcttcttttaatttaactgtattattcatagatactgttttattaccgtttgcttcttgtttaagagtttcggcatcttttttaacagcttctttaaacaatgtcagtaaatcatcgtatgatgaaacggaagaaccatttacttcgaatgttgttaatcctttcgttgctttatctttaacttctttgaagtaagcttttttaaattcttcaatagtattaaatgtattgttagatattttcttgataatatattcatcacttagaacagactcaccatctgttttagattgttgtttatatttatttgaagcataacctaagaacccattttcgtatccgtagtaaccccataatctaaaagcattatgtttgaatgaaacagctccaggagcacctttactagtattacctccgtagataccggtcatcattctaacacctacataaggtgattgatcgttatagctaattgcttcgggtttatagataccattacctggattgcgattagtcattaattgttgatcaactaaatcattaacagattgaatatttaattcatttttctcttcttgacttagatttcgaattttatcccattgatttaatttattgttatcacggtattctctatctatttttttgaaccatgcactatttaaatctttattttgttgagaaatcacagattcagcctcaatttcatcaagaagagttaaagtgtcattataacccttcatatatctattaatatcttctcgtgtttttagagtttttggatctgtaatataccactgattcccatcatttttgcgtttaaataccatattaatacctaaagaaccaaactcatcaaatccactaccagtaacaggagtttgtagcataccctgagcatatgcttcagcatcagtaccttcacggtgtccaaagccacctaagtaaatcgcacggtcgttgacgtgtgttgtttcatgtgtgtaaactgaaataccgtattcaccaaccatttctaaatgaacatattttacatcagttctaatatcatcagagttaggatatatagcagcataagctcctgttccattataattataatacttatccataggaccaaagaattctctaagaggagtatatactttgtcggtattatagcggccatatttttcaacccatccaccaggagcgttataaccttcccaaataggaataacagcatctcttagtagtcgttgtttaacgttatcagacgctagacgataccagaaatcataatagtttctataaccatctgcagctttgttaacgatatctttaatatcttctaatgattttttacctaatcgctctgcactaccaaaggcaattgcattataatttgaaattaaataaagatgtgctttatcaatattcagtagtgggagtatagtatttctaaggtgacttcgttttaaattatcgaatgcacgatgtttagaatttttaatttcttcgacctcagaagcgcgttctgcgatgtagacatggtcttctgtagcatcaataaaccaatcgttcatattgtctatatttgtgaacaattgtctattataatttaaaaatgcatctaaattacctgatttagtatatttagccaatacttgaccgaatgcgtcgaatgtacgtgaacctttaatgttgttctctttagaaccgatttcaattaatctgtctaatacgctaactttttcaccatagaaatctggtttgaatagcattaattctttaatattaacatcaccaaatttaactccatagtaacgatttaggtaagttaaacctagtaataaagctgctttgtttttctcgactttatcacgaatcatttgacgagcagctggagaatcatttagttgatgttcttcgttttgaactaattttgtgattaggtttgttaagttttctttaacatctgtgaagctttcttctaaatataaatctttgattgcattaactctatagtcacctaatcgatttagatgctgatacatcgtttgagactgaagctctactgattctaaaatagattttatatcattaacaagagtagtgttatctttttgaacgatattaggtgtatatttaattcctaagtcagttatagtatattcttttacattacttaaaccttcactgctagaagacaagttaaagtaatcttttgtaccgtccgcatagtgaacaataattttattagcttcatctaggtttgtgataaactcattgttgttcatcgcggtaacagaaagaacttctttagtatttagatggtgttctttatttaatttattaccttgatatacaatataatctttattgtagaatggtattaatttttcaagatttttataggcttggttatattcagcgttataatcttgaatactagaataggctttttcttcattaagttttgcaagaggagatagatcactttctaatttatcagcagtaatattgaaagtagtaactttagcatcagcttgttctttagttaatttagtaaatgttttagatttcctaaatgatctattacctgacgaatatccctctaccgcatataaatcttttatatgagcactagcataatcagaatcatcaacgtcgttagagccgaataactcctctccacggataatcttagcatagctgacagaattacttaccgtacctacaggccaagtcttacttgctattgctccaacttctactggatttgaaacatctattttaccttttacaaccgactcagttaggagagcttttgtaccaataagatggtctagagttaatccataatctactttaggaactaacaagctggcgcgtgttttgtttcctgtaatagtagcatcaacatatgcttttctaacaattcctctatagtttgtacctgcaattccccctgtatgagagccatttccacttgtagagtgtagtttgccaaagaaagcaacattttcaatacgagttccatcattcatattatttacaaatccagcaacattattacgacctgaaagtgtgcctgtaattttgacatttgtaataactgaagaacctttcatagtattggctaatgatgcaatattatcttgaccagaacgttctatctctacattttcaaaattcacattatttatcgttgcgtttgttatcacattaaataatggatgttccaattcagtaatagcaaattgttttccttcagaacttaaaagttttcctgtgaattctttagtgatatatgattttccattaggaacaacatttctagcgctcattgattgtcccagacgatattcttttgaaggatcgttttgaatagcttccactaattctttgaaattataatatacattatcttcgtggactttaggtttttcaatatagtgaacgtattcttcttcaaatttattatcagcagttctagagactaaattgtctgcgattgctgtaactttatatacaggtgttccgttaaccgtagtttcttctatatttttaacagctagtaatgtagttttctgattatttgaagttatttttaaataataattgctcttatcatcaggaatagttgttatcagtgattcattagtttcttttccattttcgtatttgattaaatctgtacgtttaatatttttaagctcaacttttttaagatctaattgaatattttgattttctagagtttcagtttcttcaccgttacctctgtcgtaaatcatagttgtagatagggtgtattctttgtagtactctaggttcttaaatgcagcgcttatagtttctgttgttaccttgtcatctgtaaggactacagtattaataacttcttctccttttttcaattcagctgtgattgatttgatttttgttttgttttgattttctagagtatacttagcaacagcttcacgttccaatattttcttatcggtactagtcaatgttaatattggcttttcagataattcaaccaatttttcaatagttgcagttaatttttcaacagcttcgttaacttcactttgtttagcatctgtattagctgcaactttttcagcctttgtaacttcagtttggaggttttgccaacttctatcactgtaatgttcttttacctttgtttttgcatctgcaatcgtattgtttaattcagttttatcaacgtttagagcgtcaatagccgttttaagtttatttgtctcgctatttacctcaggctgttttacaggctctgaagcatagacaccttttgcagtttctaaaacaggtccaagagcattgtaacttgctgtagaataatcagtaggagaaactgaactagctttatcaatttgattatttaactcacttttatcaactggttctttagtaccaataccctttattttatcttctggtttcggtgtttcctctacagccttctcttcttcaggaacttctggttgcttttctggctcaactggtgccgttggtgcctgttcgtcttctcttggcgcgactggttcacctgcttgttcaacttttggttcctctgttggttctgtttgtttttctacagcaggcgtttcaacttttggttgttcaatagattgattaacagtctcctcttttggttctacagtttcttcagccttggtatctggagttgactcttcttgtttcggtgtttcctctacagccttctcttcttcaggagcttctggttgcttttctggctcgactggtgccttttcgtcttctcttggcgcgactggttcacctgcttgttcaacttttgattcctcagctggtttgtctgatggttgactttctggcttaactgctactttttcctctggttttgactcaacttctccacctacttcttcaactggagctggttctgctgaatcttctttcccctcttctactttaggaagggtgtcgtcagtaggttttacctccgattttggttcttcctttggactttcttctgttttaggtgcttcttcttttggagcttcctctgtctctactacttggttttctgtcctagcttgctcctgatttgttattgattgaggagtctcaacttcgaccacagtcacctctccaggttttgctgaggtttcttctaaaacagtgtccaagccaagcgttttgaggatgtcacctgatagataaccaacatagcgatagccctccatttcaacaacaccctctcgactagccagcgctagggtcgcaactgggtctacagcccctgcactaggaagaactaccaatcccatagctccaactagaaagacgctagcaattttctttctcttgtagattaaaagcaagctcccaacagtcagcaaaccaaaagctgtcaaaacagatgcttctgtccctgtttgaggcaactgatctttttgatacaccaaaccatatacaacttcattcctgtcaggctttcctgtctgaattaaatctttagcttcttgtgaaataatctctttatttacatagtgataggtggctgcgtccactacagaaggagccatcaaaaggcttccaagaaatacagagcctacaactcccttaatcttacgaattgaaaaacggtcttttttaaacacttttatctcctttattcattctcaaaacttcctaatagcatcttgcggatagtgcgcacgcgcacctccgattaattttggacgactagccagtgccgttacatgggcatgaccaatctctctcaaaatagggcgaatcggaacctgaacatgcttgacatgcatgccaattgcagtgtctccgatatccaatccagcatgagccttgataaattcaacctcaactggatcctgcataaacttaaaggctgccaactgccccgaacctcctgcatgaagagtaggatggacactgacaatttccagaccaaactgctctgccacctgacgttcaacaacgagagcccgattgacatgctcacaaccttgaactgctaaatggatacctctactacctagaatatccaagatagtctccactatcagctcaccaatctcttgactggattctttcccaatatgaccacctagcacctcactagaagatagacctaaaacaaaaagggccccctgcttcaaattggtcttttctaaaacatcttccactacctgacgtgtttctctttgaatctgtgtctcgttcatctctgttacctctgttgtcactcttctatcataccgttttttcttgtttttagcaagatagacaacctagaaagtttgcccaattacgcataaaactcccagaattgactgggagttagctagtttctattctatttatatatatttcaactttcgtccctttttggggtctagaatcaatcttcatatggtaattggctccaaaatgaagtttgagccgttgatcgacattttgaagaccaactcccccacgtttgagttgactttgactactatcaccagcatcttggaagccaacgccatcatcctcaatacggatgaccaatcccgaatcctgtttctggacagaaagtttaatatggccctgaccttccttttccttaatgccatggtaaagagcattttctacaaggggttgtaggaccagcttgggtaagactaaattatcaaaggcaacattttcattaatttcgtattccagcttatctccatagcgttgtttctggataaagagatactggcggacatgattgatttcgtcagagagacaaatcaagtccttgccttgattgagcgccaagcggaaataggttgccaaggacttggtcacctgcaccactcgctgactatcatgaaattcagccatccagatgatggtgtccaaagtgttatagaggaaatgtggattaatctggctcgaaagggcttgaagttggtactgacgggtcgtttcttcctggctacgaatagctaccatcaactgatcaatctgatccaacatagcattaaattggcgagttacttctctcagttcataggcaccaacttccttggcacgaagattttgagcaccagaagcaatttccaacatggtttctctcaaatccttcaaaggagcaatccagcgtttaagactgaaccacactaagcagagacagacaagaagagatgtgacactggccccaagcaaggtccacaagagctgactccgaacctggtctaacttttccaatgatgacacgccaagcaccgtccaatcagttcctgcaatcttctcttgactgacgtaggatttgtgaccaggagtataaccctgacctgtatcgatgtagggtttcatagcctccattttgctagacgaactataaactgtgtgttgaggatggtagacaaattcatggttttcattgataatgaaggcaaagccctgctgccccaactggagttgattgagataggcttccagagtttcataagaaatatccaaacgaagcacaccaagattggctccctttgcatcaacaagttcttgagtgacagaaatgacccactgactatctgatttacgagctggagtcaaaacaggcatagctccctgatgaatggccttttggtaccaatcctcagccatcatatcagaggaagttttcatctgcacactgtcatctgtagaaatgacctgaccagatttggtcaccagcacaacagttttcaagtccttatctgacttcaagatggtcaaaaacaaatctcggattccctcgaccttgtcttgactgggattctcagcataggccagaacatccgtctgctgggtcaaaccagtcgaggtggtttctagttttttgatataagactgaataaagtggctagtctggctgatggtcgtttggctgttgccctcaatggtggcctcaatggctgaagaacttgattgatagtagaaagttccaaccagagctaggagaatgagaaagaccagaaagatggaaataaccattctaactaaaagagaagaacgcttcatcggtcttctcccttcttaaactgacgaggtgtcacacctgcaatctgcttaaaacgttgggtaaaatagttcatatcttcaaaaccaaccttctctgcgatctcataaatcttcagatctgtagttaaaagcaagagcttggcttgtttaacacgttctctcaccagataatcctgaaaaggcaagcccaactctttcttaatcaaggaactcagataggtcggactaaaacctaagtcactggctaaagactttaaactaaattggctatcagccagatgagactggattttctgggccatgtttccttcaaacctattagtcaataaatcttgtaactgctcttctttctcttccttgtctagtttttgtttgattttccccaacatttcctcaatatcctgacgagaaaagggtttgagcaggtagtcgtccacacctagtttgacagcagacaaggcataatcaaaatcatcgtaacctgttaaaaagaccaaatgaacctgaggataggtttctcgtaccagactggccaactggatgccatttagatgaggcatgttgatatcggttaaaatgatatctggcacctgcttttggatcaattcccaagcctgccttccattttcagcctgaccgatgatttccatatcgtaggctgctacattgaccagtttagtcaaaccttgtcttaccagatattcatcttctacgattaagattgtgtaggtcatgctctgctcctttaccacttactagtatcagtatagcaaaattctcctctaactgcttaggaaagacctcttatactcaataaaaatcaaaaagtaaactaggaagatagccacaggtttctcaaagtaccgctttgaggttgtaaataaaactgacgaagtcgactcaaagtatagctttgaggttgtagataaaactgacgaagtcgataaccctacatacggtaaggcgacgctgacgtggtttgaagagattttcgaagagtattaatcaacataatctagtaaataagcgtacctttttcttccatttggtctttgggaataaagcggatagagaggctattgatacagtaacgtaagccgcccttgtcctgtggaccatccgtaaagacatgcccaaggtgagaatctcctactcggctccgcacttccatacgcgtcatattgtaggacttatcttccttgtaggtgacaacatctggactgatgggttgggtaaaactaggccagccacaaccagactcaaatttgtcttttgatgaaaagagaggttccccagttgctatatccacatagataccggattcaaatttatcccagtaacggtttgagaaagctcgttctgtttgattttcctgggtaactgcatactcctcaggtgacagggtctttttcaattcctcatcacttggttttggatatttgctggcatcaatgacaggataggccgcctgattaacattgatatggcagtagccatttggatttttcttgagatagtcttgatggtaatcctcagccaccacaaaattcttcaagttttccttttcaactgctagaggttgatcgtatttcttagccacctcatcaaagacttggttaatcacttccaaatccttgtcatctgtgtaataaacaccagtacggtactgggtccccacatcatttccttgtttatttttgctggttggattgataatgcggaaatagtgaagcaggatttccttgagagaaatttgcttggcatcataggtgacatggacggtttctgcatgacctgtttggttaatcaattcgtacttggttgtttctcctctaccatttgcatagcctgaaacggcatccgtcaccccgggaacacgtgagaaatattcctccactccccagaaacaacctccagctagataaatttcgtgcaagtctgcgtctttactaatttctgtttttttcactgcttttcctccttggctaactgccgccttttcaatttgcgaggcatctgtctgccctgcatttcgtatcaatagaacatagaaaccggttatggctagaaaaaatactcctagcaacaagaagatttttaacttatcattcataagacgcctcctaggctaattccttcaaagtttgcaaaattgcatctttttccatgaatcctggatgtgttttgaccagcttgccttctttgtctataaaggcttgggttgggtaagaacggacaccataagtttccaaaagtttgcctgatgggtcaactaggactgggagatttttataatccaatcccttataccaattcttaaagtccgcttcagattgctctcccttatgtcctggtgacactactgtcaagaccacatagtcatcaccagcttctttagcaatctcatccgtatctggaagactagccagacagatggaacaccaagaagcccagaatttgagatagactttcttgcccttgtaatcagataaacggtaggtcttgccatctactcccatcaattcaaaatcagccacctctttccctttagctgcgcttgttttactagctgtctgctccgtcttcatttcatctttcgtttggtgttcactagtcacggacttgcctgaacaagccgtcaaacaaaggagcgaacctgctccaagaacacatgtttgccattttttcatattgatattcctttccattttattcaaataattgacttaaaattgaagcatttccaaacagaaccaagaagcccatcacaataatgagaaaaccacccacttttttgaggattccgagatagggatgaagttttcggaaatgtttcaaaacataactagaggtcagagctagaagcaagaatggtagcgccaagcccagcgtatacaccaacatgagaccagctccctgccaagctcctgaaccacctgaagccgccaaggccaaaacagaccccagaaccggccccacgcaaggcgtccaagcaaaactaaaggtcaagcccaataaaaatgcctgactatagcccttaccattttgcccctgtccttgcagttgtagcctcttttccttataaagccccttaaagtgtagaatctccatttggtgcaaaccaagaaggataataattgccccagtaagatattggaaccaagaagcataaagcaaatcgcctaaaaaaccagctccatagcccaacaaaataaatataaaggaaattcctgctataaaggccagagttcgtaataaactagtaactgagattgaaaatttgccgctagaagcctgagcaccatccttatcatctagtaacactcctgtatagaccggtaacaaaggtaagatacaaggagaaaagaaggatagaatccctgccaaaaagacacttagaaaaaagaaaatatgacccataaagttcctcctatcattttattgatagatttattata

SEQ ID NO: 6 - DNA, 20199 bp; double-stranded, linear
cccagcagaaaaatggcatttggagataatggaaatcgtaaaaaaactatgtttgagaaaataaccttgtttatcgtgattatcatgctagtagcaagtttattgggaatttttgcaactgcaattggtgccctcagtaatctataaaatagattcaagaaaatttagtgactgggatttcccagcccttttttaaagtgagaagaaataatgagtatgtttttagatacagctaagattaaggtcaaggctggtaatggtggcgatggtatggttgcctttcgtcgtgaaaaatatgtccctaatggaggcccttggggtggtgatggtggtcgtggaggcaatgtggtcttcgttgtagacgaaggactacgtaccttgatggatttccgctacaatcgtcatttcaaggctgattctggtgaaaaagggatgaccaaagggatgcatggtcgtggtgctgaggaccttagagttcgagtaccacaaggtacgactgttcgtgatgcggagactggcaaggttttaacagatttgattgaacatgggcaagaatttatcgttgcccacggtggtcgtggtggacgtggaaatattcgtttcgcgacaccaaaaaatcctgcaccggaaatctctgaaaatggagaaccaggtcaggaacgtgagttacaattggaactaaaaatcttggcagatgtcggtttagtaggattcccatctgtagggaagtcaacacttttaagtgttattacctcagctaagcctaaaattggtgcctaccactttaccactattgtaccaaatttaggtatggttcgcacccaatcaggtgaatcctttgcagtagccgacttgccaggtttgattgaaggggctagtcaaggtgttggtttgggaactcagttcctccgtcacatcgagcgtacacgtgttatccttcacatcattgatatgtcagctagcgagggccgtgatccatatgaggactacctagctatcaataaagagctggagtcttacaatcttcgcctcatggagcgtccacagattattgtagctaataagatggacatgcctgagagtcaggaaaatcttgaagactttaagaaaaaattggctgaaaattatgatgaatttgaagagttaccagctatcttcccaatttctggattgaccaagcaaggtctggcaacacttttagatgctacagctgaattgttagacaagacaccagaatttttgctctacgacgagtccgatatggaagaagaagcttactatggatttgacgaagaagaaaaagcctttgaaattagtcgtgatgacgatgcgacatgggtactttctggtgaaaaactcatgaaactctttaatatgaccaactttgatcgtgatgaatctgtcatgaaatttgcccgtcagcttcgtggtatgggggttgatgaagcccttcgtgcgcgtggagctaaagatggggatttggtccgcattggtaaatttgagtttgaatttgtagactaggagactggtatgggagataaaccgatatctttccgagatgcggatggtaattttgtttccgccgcagacgtttggaatgaaaagaaattggaagaactatttaatcgtctcaatccaaatcgtgccttgagattggcacgaactaaaaaggaaaatccatctcagtaaagaagctaaaaaatcccgtgcctcatcagacacgggattttgtggtacgacaggcatgtatagcaaactgaatctggaatagcacagcatatcttctaaaatatagtaaaatgaaatgagaacaggacaaatcgatcaggacagtaaaatcgatttctaacaatgttttataagcagagatgtactattctagtttcaatcaactatattgttataaattgatttgaatttcaaaattaaattgtttgattcttatttcaatttgttatagtatatctgatgtcaaagttctcggcgagtcaaatagcgattcccaagcctgactatcgtgaggtagcggattaaaatggtctggggatagaccgttttaagtctgacgctggaaataagaattgtcagaagaagggatagcgaaatcgtggctctacgaacaggaacgtgataataaggcgtatatagcggataagagggcatcaaactctaaagtccaaaaaggtagtcgtaacctatatgcgtaaatcacgagagtaattgaattcgtactaagattttctattttcactgtaaccttttaacgcccttatatcttgtatacacgaggaaagatgtacgacttatcccgtgaggtctatcactataaagagaaaacgacagatagaagtgatcctgagtcacggttatctgtctgataggacggtatgtataaaacgcttctgtgaactgagagaagggggagaagttcttgctaaaatttagttgaacagccgtattccgatacttagataagagatctagtcttagctcctactcagttttaggggataaaaaaggggcaatagcgattcgagaaagattatactcttcgaaaatctcttcaaatcacgtcaatatcgccttgtcgtatgtgtaggatactgactacgtcagttccatctacaacctcaaaacagtgttttgagcaacctgcggctagtttcctagtttgatctttgattttcattgagtattagtaattcagttactaactcgtcaactctgatttatccaataaaattgaaaaggatggaaaaaaggataaatttatgatatactttattttgaagaccttattagaaatcttgaaagagtattgaaaacttagaatgagaaaaattgttatcaatggtggattaccactgcaaggtgaaatcactattagtggtgctaaaaatagtgtcgttgccttaattccagctattatcttggctgatgatgtggtgactttggattgcgttccagatatttcggatgtagccagtcttgtcgaaatcatggaattgatgggagctactgttaagcgttatgacgatgtattggagattgacccaagaggtgttcaaaatattccaatgccttatggtaaaattaacagtcttcgtgcatcttactatttttatgggagcctcttaggccgttttggtgaagcgacagttggtctaccgggaggatgtgatcttggtcctcgtccgattgacttacaccttaaggcgtttgaagctatgggtgccactgctagctacgagggagataacatgaagttatctgctaaagatacaggacttcatggtgcaagtatttacatggatacggttagtgtgggagcaacgattaatacgatgattgctgcggttaaagcaaatggtcgtactattattgaaaatgcagcccgtgaacctgagattattgatgtagctactctcttgaataatatgggtgcccatatccgtggggcaggaactaatatcatcattattgatggtgttgaaagattacatgggacacgtcatcaggtgattccagaccgcattgaagctggaacatatatatctttagctgctgcagttggtaaaggaattcgtataaataatgttctttacgaacacctggaagggtttattgctaagttggaagaaatgggagtgagaatgactgtatctgaagacagcatttttgtcgaggaacagtctaatttgaaagcaatcaatattaagacagctccttacccaggctttgcaactgatttgcaacaaccgcttacccctcttttactaagagcgaatggtcgtggtacaattgtcgatacgatttacgaaaaacgtgtaaatcatgtttttgaactagcaaagatggatgcggatatttcgacaacaaatggtcatattttgtacacgggtggacgtgatttacgtggggccagtgttaaagcgaccgacttaagagctggggctgcactagtcattgctgggcttatggctgaaggtaaaactgaaattaccaatatcgagtttatcttacgtggttattctgatattatcgaaaaattacgtaatttaggagcggatattagacttgttgaggattaaaccgtagaggtgtttatgaatatttggaccaaattagcaatgttttctttttttgaaacggatcgcttgtatttgcgtcctttcttttttagtgatagtcaggacttccgcgagatagcttcaaatccagaaaatcttcaatttattttcccaacgcaggcaagtctggaagaaagtcaatatgcactggccaattactttatgaagtcccctttgggagtgtgggcaatttgtgaccagaaaaatcaacaaatgattggttctattaaatttgagaagttagatgaaatcaaaaaagaagctgagcttggctattttttgagaaaagatgcttggtcgcaaggatttatgacagaggttgttagaaaaatttgtcagctttcttttgaggaatttggcttaaaacaattatttatcattacccaccttgaaaataaagctagccaaagagttgctcttaagtctggatttagtttgttccgtcagtttaagggaagtgatcgttacacaagaaaaatgcgggattatcttgaatttcggtatgtaaaaggagagttcaatgagtaagcatcaggaaattctaagctatttggaggaattaccagtaggtaaaagggtcagtgttcgtagcatttcgaatcatctaggagttagtgatggaacagcctatcgggctattaaagaagctgaaaaccgtggaattgtggagacccgtcctagaagtggaacaattcgtgttaaatcccagaaagttgctatagagagattaacgtttgctgaaattgcagaagtgacttcttctgaggttctggctgggcaagaaggtttagagagagaatttagtaagttttcaattggtgccatgactgaacaaaatatcttgtcttaccttcatgatggggggctcttgattgtcggagaccgaacccgtattcagttgctagccttggaaaatgaaaatgcagttctggttacagggggatttcaggttcatgatgatgtgcttaaactggccaatcaaaaagggattcctgttctaagaagtaagcatgatacctttaccgtcgcgaccatgatcaataaagccttgtcaaatgtccaaatcaagactgatattctgacagttgagaaactttatcgccctagtcatgagtatggttttctgagagagacagatacagttaaagattatttggacttggttcgtaagaatcgtagcagccgtttccctgttatcaatcaacatcaggtcgttgttggtgttgtaaccatgagagacgctggtgataaatcaccaagcacgacaattgataaggttatgtctcgtagtctatttttggttggattatcgacaaatattgccaatgtgagtcaacggatgatcgcagaagactttgaaatggtaccagttgttcgaagcaatcaaactttgcttggcgttgtgacgcgacgagatgtcatggagaagatgagccgttcccaagtttcggctctaccaactttttctgagcagattggacaaaagctctcttatcaccatgatgaagtagtcattacagtggaaccctttatgctagaaaaaaatggagttttggctaatggtgtattggcagaaattctgacccacatgacccgatttagttgttaatagtggtcgcaatctcattatcgagcagatgctgatctactttttgcaggctgttcagatagatgatatattgcgcattcaggcacggattattcatcatacgagacggtcagctataattgattacgatatttatcatggtcaccagattgtttcaaaagcaaatgtgactgttaaaattaattagaaactaggagaaaagatgataacattaaaatcagctcgtgaaatcgaagctatggacaaggctggtgattttctagcaagtattcatataggcttacgtgatttgattaagccaggcgtagatatgtgggaagttgaagaatatgtccgccgtcgttgtaaagaagaaaatttccttccacttcagattggggttgacggtgccatgatggactatccttatgctacctgttgctctcttaacgatgaagtggctcacgctttccctcgtcattatatcttgaaagatggtgatttgctcaaagttgatatggttttgggaggtcccattgctaaatctgacctaaatgtctcaaaattaaacttcaacaatgttgaacaaatgaaaaaatacactcagagctattctggtggtttagcagactcatgttgggcttatgctgttggtacaccgtccgaagaagtcaaaaacttgatggatgtaaccaaagaagctatgtacaagggtattgagcaagctgttgttggaaatcgtatcggtgatatcggtgcggctattcaagaatacgctgaaagtcgtggttacggtgtagtgcgtgatttggttggtcatggtgttggcccaactatgcacgaagaaccaatggttcctaactatggtattgcaggtcgtggactccgtcttcgtgaaggaatggtcttaaccattgaaccaatgatcaatacaggcgattgggaaattgatacagatatgaaaactggttgggcgcataagaccattgacggtggattgtcatgtcagtatgaacaccaatttgtcattacgaaagatggacctgttatcttgactagccaaggtgaagaaggaacttattaataaaaagtgaaaagactactggaagtttattttgataaaaaatccagtagatcttttcataataaaacgcattgtatcaagtgttaggggctgatatcatgcgtttttctgcttttaagattttttccaactctgtttgtaagcgcatcataacaaagggtctaggattcagggctctcctcctatatactattagtaaagtaaaactaagggaggatattttagtgtcgcagtctattgttcctgtagagattccacaatattgtcgttttgattctaaaaagagaaatggaattctgtttaatgttcgtattgccaatcttaaatttacttttttatattatacttcctgcgaaacaaaatatggtatagtagttctatgaatgatgaagcaagtaaacaactaactgatgcacgatttaagcgtcttgttggtgttcagcgtaccacttttgaagagatgttagctgtattaaaaacagcttatcaacttaaacacgcaaaaggtggacgaaaacctaaattaagcctagaagaccttcttatgcccactcttcaatagtgcgagaatatcgaacttatgaagaaattgcggctgattttggtattcacgaaagcaactttatccgtcggagccaatgggttgaaataactcttgttcaaagtggttttacggtttcaagaactcctctcagttctgaggacacggtaatgattgatgcgacggaagtaaaaatcaatcgccctaaaaaaacaattagcgaatgattctggtaaaaagaaatttcacgctatgaaggctcaagcgattgtcacaagtcaagggagaattgtttctttggatatcgctgtgaactatagtcatgatatgaagttgttcaaaatgagtcgtagaaatatcgaacaagctggtaaaatcttggctgacagtggttatcaagggctcatgaagatatatcctcaagcacaaactccacgtaaatccagcaaactcaagccgctaacagctgaagataaagcctataaccatgcgctatctaaggaaagaagcaaggttgagaacatctttgccaaagtaaaaacgtttaaaatattttcaacaacctatcgaaatcatcgtaaacgcttcggattacgaatgaatttgagtgctggtattatcaatcatgaactaggattctagttttgcaggaagtctattgaggtattgagctagtttatgaaaaaattgggtgaaaagtcgagtgttttagaaacccacagtgtagtattctagtttcaatccactatattttgctactccccgtaaagtttctattttccctgatttctgatataatagaaatattgacttcaagagtaaggaagagaagatgaacgcattattaaatggaatgaatgaccgtcaggctgaggcggtgcaaacgacagaaggtcccttgctaatcatggcaggggctggttctggaaagactcgtgttttgacccaccgtatcgcttatttgattgatgaaaagctggtcaatccttggaatatcttggccattacctttaccaacaaggctgcgcgtgagatgaaagagcgtgcttatagcctcaatccagcgactcaggactgtctgattgcgaccttccactccatgtgtgtgcgtattttgcgtcgcgatgcggaccatattggctacaatcgtaattttacaattgtggatcctggtgaacagcgaacgctcatgaaacgtattctcaaacagttgaacttggaccctaaaaaatggaatgaacgaactattttggggaccatttccaatgctaagaatgatttgattgatgatgttgcttatgctgcccaagctggcgatatgtatacgcaaattgtggcccagtgttatacagcctatcaaaaagaacttcgtcagtctgaatccgttgactttgatgatttgattatgctgaccttgcgtctctttgatcaaaatcctgatgttttgacctactaccagcaaaaattccaatacatccacgttgatgagtaccaagataccaaccacgctcagtaccaattggtcaaactcttggcttcccgttttaaaaatatctgtgtggttggggatgcggaccagtctatctacggttggcgtggtgctgatatgcagaatatcttggactttgaaaaggattaccccaaagccaaggttgttttgttggaggaaaattaccgctcaaccaaaaccattctccaagcggccaacgaggttattaaaaataataaaaatcgccgtcctaaaaatctctggactcaaaacgctgatggggagcaaatcgtttactatcgtgccgatgatgagctggatgaggctgtatttgtagccagaaccatcgatgaacttagtcgcagtcaaaacttccttcataaggattttgcagttctctatcggactaatgcccagtcccgtacaattgaggaagccctgctcaagtctaacattccttataccatggttggcggaaccaaattctacagccgtaaggaaattcgcgatattattgcttatctcaaccttattgctaatttgagtgacaatattagttttgagcgtattatcaacgagcctaaacgtggaattggtctaggtacagttgagaaaatccgtgattttgcaaatttgcaaaatatgtctatgctggatgcttctgctaatattatgttgtctggtatcaagggtaaggcagcccaatctatctgggattttgccaatatgatgcttgatttgcgggagcagctagaccacttaagcattacagagttggttgagtccgtcctagaaaaaacaggttatgtcgatattcttaactcccaagcgactctagaaagcaaggcacgggttgaaaatatcgaagagtttctttctgttacgaagaactttgatgacaccacggatgtgacagaagaggaaactggtctggacaaactgagtcgtttcttaaatgacttggctttgattgccgacacagattcaggtagtcaggagacatcagaagtgaccttgatgaccctgcatgctgccaaaggtctcgaatttccagttgtctttttgattgggatggaagaaaatgtctttccacttagtcgtgcgactgaagattcagatgaattagaagaagagcgccgtctagcctatgtaggtatcacgcgtgcagagaaaattctctatctgaccaatgccaactcacgcttgctttttggtcgtaccaattataaccgtccgactcgttttattaacgaaatcagttcagacttgcttgagtatcaaggtctggctcgtcctgcaaatacaagctttaaggcatcatatagcagtggtagtatttcctttggtcaaggtatgagtttggctcaggctcttcaagaccgtaaacgcggtgctgccccaaaatcaatccagtcaagcggtcttccatttggtcaatttacagctggcgcaaaaccagcatctagcgaggcaaattggtccattggtgatattgctctccacaagaaatggggagagggaaccgttctggaagtttcaggtagcggtgctaggcaggaattgaaaatcaatttcccagaagtaggtttgaaaaaacttttagccagtgtggctccaattgagaaaaaaatctaattttccatccttctcacgaataataaagtgaggaggatttttatgtacagtatttcattccaagaagattcactattaccaagagaaaggctggccaaggaaggagttgaagcgcttagtaaccaagagttgctagctattttactcaggacaggaacacgtcaagctagcgtttttgaaattgcccaaaaagtcttgaacaatctttcaagcctaacggatttgaaaaaaatgaccctgcaggaattgcagagtttgtctggtattgggcgtgttaaggccatagaattacaagctatgattgaactggggcatcgtattcacaaacacgagactcttgaaatggaaagtattctcagcagtcaaaagttggccaagaagatgcagcaggaattaggggataaaaaacaagagcacctggtggcactctatctcaatactcaaaatcaaatcatccatcagcagaccatttttatcgggtctgtaactcgtagtatcgctgaaccgcgagagattcttcactatgcaatcaagcatatggcgacttctcttatcttggtccacaatcatccttcaggagcggtagcgcctagccaaaatgatgatcatgtcactaaacttgttaaagaagcctgcgaattgatggggattgttctcttggaccatttgattgtctctcattctaattactttagttatcgtgaaaagacagatttaatctaaagttcattaacgacatagtcaaagagttttttatctttgggacgattttcaaaaagaagttctggatgccattggacaccgagaaaggcgacatcatccgtactcatgacagcctcaatgataccatctttaggatcatgagccacaacttttaaatttggtgctaagtccttgatgctctggtggtggaaggagttgatatgagagatttctccatagatttcttggagaacggtatctggttctgttaccaagcgttgagttgtgtactcaacagaagaatcctgccaatggtcttcgatatcttggtacaaagttccacccatggcaacgttaaagagttgggtaccacggcagacagagaaaatgggctttttctgtttaatagcttccttgatgagggccagttcgaagatatctctttgaaggtgatagtcatcactatcaatggttttgggttcgccataaaattttggatcgacattttgcccacctgtcaagatgagcttgtcaatcaaactgatatagtggcaggccatttcttgatcaccaatcggtaggatgatgggaatccctccagcatctttaacgccttcaacaaagccttttgctgcgtagctcatcatgatgtcatcatctggatgagttttttcgtttcctgtaatcccaataactggttttttcataaaatgattttcgctttctaatcctcttttcgcatgaagtagaggagggtttggagttcacttgtcaaatcgacatactgaacgaccacgtcttttggtaaatgcagatggactggtgaaaaactgagaattcctttcacaccagcatcaaccaagagattagcaacctcttgtgacttgacgctgggaacagttaggatagcagtcttcacatcagcatccttgattttatccttgatctgagaaatcccgtaaatgggaatcccgtcaggagtttgggtaccgacttcaggatggtcgtctaggtcaaaggccatgataatcttcatcttgttacgttcgtggaagcggtagtggagaagggcatggcccatatttccaataccaaccagcatgacattggtaatagagttgtcattgagcaaatcggcaaaaaatgtcattagttttttgacatcatagccaaaaccacgacgaccaagttcaccaaaataggaaaaatcacgacgtacggtcgctgaatcaataccgatagcctctgcaatttgcttagagttggcacgttcaatcttttctgcatgaaatctcttaaaaattcgatagtagagagagagtctttttgctgtagcttttggaatagcaaactgtttatctttcacaaaatcacaacctttctattcttctattttatagaaacattgtgaaaaaatcaacaaaaataagaaaaaactaagaaaaatcttagttttgatgtaaaaaatctgcatgagatagaaaacggtagaggtctccgaccagcccctgataaacttttttgcccctaaaagtcagagaagtcacataaagtgtatctggtaaggttacacatcctgacaaagtcaacatgagagcctcatgatcctcatacttgagagtacgctctacatgatagcagtccttataggtcagttcaaacattttggctctatctttccgattttgtaaagacaccacgttctaccaagctatccatgaggaagtagaatttttcctgatgaatatggtggtcttctgatttgaaaatatcaactagacgaaggccaaacttgtcagtgatattgattttagcccctgtaagttccttgttaatgatgattttgagttggaagccttcaccgctgtttggcactttttccaaaaggcgagtcagttcatagttaccaaccttagtttcaaaaaaggtgttatctttgagggtgaattttttaacagaagggctaagagtgtaatcgtaacgacaattttttaactgaatgattttttcaaatgccatatggctaacctccgataatttcttttaaggtttttgcgagggtttgtaggtcttcaacggtattttgtggcgacaaactgatgcgaagggattccttcaagcgttctgaatttgcgccatacatggcttcaagaacatggctggattggacaacgcctgcagtacaggctgagccagtagagattgaaattccagctaaatctagccgaaggagtaagaggtcatttttctgaccaggaaatccaatattgagaacataagggagatgatgttttcctctattcaggtaatactgaatgccctccagctctgccagaaaggcagtttctagattttgtacatgttgaaaatgttcttcttgtttttctaggtcttcttttagggctgcaaccatgcctacaatggcaggcagattttcagttcctgcacgttttttctgttcctggtctccgccatgtagataggaatcaaagtccatgctagatgcgtagagaaaaccgattcccttaggaccatggaatttgtgggcagaagcagtgagaaaatcaatgcccaattcttctgaatgaattgggattttaccaatagcctgaactgcatcaacatgataggcagcagggtgttgcttgagtatttggccaatttcagcgatgggcagtaggtttcctgtctcattattgacaaacatggtagaaaccaaaatcgtatcgtcacgtaaagccttttgaatttgctgggctgtgatttcttgattttctggctggataatggttgcttcaaacccaaagtgttgaaccaagtaatcaattgtttcaaggacagcatggtgctcgatggcagttgtgatgatatgttttccttgttcttggtgacgaagacagtagccaatgatggtagtattattgccttcagtcccaccagaagtgaaaaagatatgttgaggttttgtccttagtaactgggctagttcctgacgggcttctcgcaagagtttgccagcttgacgaccatgaccatgaatactagaaggatttccgtgggtttcttgcataaccttggtcatagctgaaatagcaactgctgacataggagtcgttgcagcattgtccaaataaatcaaagaatcaccttatttctttttattgtaggcaaagagtgggctgactggttttctttcgtgaatacggacgatagcatcaccaattaactcactagcagtgatgtagcatacatttttaggagttttttcttttgttgctactgaatcagtcacaagaatttctttaatattagtattgtcaagaagctcagcagctccctcgacgaagagaccgtggctagaaacagcataaatttctgtagctccttcacgttcaacgattttagaagcttcagagaaggtacgtcctgtatttaaaatatcatcaatcaagatagctttcttaccttcaacatcaccaataatataaccttcgttacgagttgcatcgtcttgagggtagtcgataatggcgataggagcatcaagatattcagccaggctacgcgcacgtttgacacctgaatttttagggctaacgacaacaacatctgaaccaagcaatcctttatcgcagtaatgttttgcgaataggggaacagtgaaaagattatccactggaatatcaaagaaaccttgaacctgaacggcatgcaaatcaagagtcaggatacgatcaactccagccttaaccagcatattggcaactagttttgctgtaagtggctcacgaggacaagcaatgcggtcttgacgtgcatagccaaaatatggaaggacaacgttgatactgtgggcacttgcacgcacacaagcatcgaccatgattaacaattccattaggtggttgttgacagggaaacttgttgattggatgatgtaaacatcataaccacggacactttcttcgatatttacttggatttctccgtctgaaaattgacgtgatgatagttttccaagtgggacaccaacagcttgggcaattttttgtgcaatctcttggttagagttgagtgcgaaaagtttcatgttttttctatctgacattatagaccgtcctctgtaaactttataaatcctagttatatttaccttacatatatgaactgggatttgtgtatttttatcttttctattttaccaaaaaatggagattatttcagctatttttcatacttttgacaaatcgaaccaattttgaaggagctttttgataggaaatctgatttttctctaaaaattgtcgaaaatcctgtttgccttgctcatgattttccacttcaagctccaattcgtaatctgttatatcaaagtatcggctctgatccagtgccatgagaccaatagctgttttcatttcatagcgaagcgttgttagacaaccaagaacctgccagttcttactttggataccatgtttcgccaattcatccagtactagcccttgaggaagttcttccttactcagatagttctcagcatcttttagttgcaatttttggttgtattccatgtttccaacactctgcgggactttgagtgtcaactcagcccagtcttcaaaggttcgaatgcgcatagcgactttcttttctcgcagttcaaaatcaggcgtgtcgatgtagtaatttgtttgaagaacaggagtgacacctgtgaactggtcttttagacgattgtattcatcttttttcaatagtgttttcaattcaatttctaaatgtttcatttttcttacctttttttatcgttgaaagcggatttatggtataataagcattgtatttattgtatatgaatctggagaaaaaatcaaagatatttttgacggataatatgagaacaagggagaatatatgaccttagaatgggaagaatttctagatccttacattcaagctgttggtgagttaaagattaaacttcgtggtattcgtaagcaatatcgtaagcaaaataagcattctccaattgagtttgtgaccggtcgagtcaagccaattgagagcatcaaagaaaaaatggctcgtcgtggcattacttatgcgaccttggaacacgatttgcaggatattgctggcttacgtgtgatggttcagtttgtagatgacgtcaaggaagtagtggatattttgcacaagcgtcaggatatgcgaatcatacaggagcgagattacattactcatagaaaagcatcaggctatcgttcctatcatgtggtagtagaatatacggttgataccatcaatggagctaagactattttggcagaaattcaaattcgtactttggccatgaatttctgggcaacgatagaacattctctcaactacaagtaccaaggggatttcccagatgagattaagaagcgactggaaattacagctagaatcgcccatcagttggatgaagaaatgggtgaaattcgtgatgatatccaagaagcccaggcactttttgatcctttgagtagaaaattaaatgacggtgtaggaaacagtgacgatacagatgaagaatacaggtaaacgaattgatctgatagccaatagaaaaccgcagagtcaaagggttttgtatgaattgcgagatcgtttgaagagaaatcagtttatactcaatgataccaatccggatattgtcatttccattggcggggatggtatgctcttgtcggcctttcataagtacgaaaatcagcttgacaaggtccgctttatcggtcttcatactggacatttgggcttctatacagattatcgtgattttgagttggacaagctagtgactaatttgcagctagatactggggcaagggtttcttaccctgttctgaatgtgaaggtctttcttgaaaatggtgaagttaagattttcagagcactcaacgaagccagcatccgcaggtctgatcgaaccatggtggcagatattgtaataaatggtgttccctttgaacgttttcgtggagacgggctaacagtttcgacaccgactggtagtactgcctataacaagtctcttggcggtgctgttttacaccctaccattgaagctttgcaattaacggaaattgccagccttaataatcgtgtctatcgaacactgggctcttccattattgtgcctaagaaggataagattgaacttattccaacaagaaacgattatcatactatttcggttgacaatagcgtttattctttccgtaatattgagcgtattgagtatcaaatcgaccatcataagattcactttgtcgcgactcctagccataccagtttctggaaccgtgttaaggacgcctttatcggcgaggtggatgaatgaggtttgaatttatcgcagatgaacatgtcaaggttaagaccttcttaaaaaagcacgaggtttctaagggattgctggccaagattaagtttcgaggtggagctattctggtcaataatcaaccgcaaaatgcaacgtatctattggacgttggagactacgttaccattgacattcccgctgagaaaggctttgaaaccttggaggctattgagcttccattagatattctctatgaggatgaccactttctagtcttgaataaaccctatggagtggcttctattcctagtgtcaatcactctaataccattgccaattttatcaagggttactatgtcaagcaaaattatgaaaatcagcaggttcacattgttaccagactagatagggatacttctggcttgatgctctttgccaagcacggttatgcccatgcacgattagacaagcagttgcagaagaaatctatcgagaaacgctactttgctttggttaagggagatggacatttggagccagaaggggaaattattgctccgattgcgcgtgatgaagattccattattaccagacgagtggctaaaggcggaaagtatgcccatacttcatacaagattgtagcttcttatggaaatattcacttggtctatattcacctgcacactggtcgaacccatcaaatccgagtccatttttctcatatcggttttcctttgctgggagatgatttgtatggtggtagtctggaagatggtattcaacgtcaggctctgcattgccattacctatccttttatcatccatttttagagcaagacttgcagttagaaagtcccttgccggatgattttagtaaccttattacccagttatcaactaatactctataaaaactgtctcagagtataattattatcttaaaggagaaaactcatggaagtttttgaaagtctcaaagccaaccttgttggtaaaaatgctcgtatcgttctccctgaaggggaagagcctcgtattcttcaagcaacaaaacgcttagtaaaagaaacagaagtgattcctgttttgcttggaaatcctgaaaaaattaaaatttatcttgaaattgaaggaatcatggatggttatgaggtcatcgaccctcaacattatcctcaatttgaagaaatggtttctgccttggtggagcgtcgcaagggcaaaatgactgaagaagatgtacgcaaggttttggttgaagatgtcaactactttggtgtgatgttggtttacttgggcttggttgatggaatggtgtcaggagcgattcactcaacagcttcaacagttcgcccagctctacaaatcatcaaaactcgtccaaatgtaactcgtacttcaggagccttcctcatggttcgtggtacggaacgttacctatttggagactgtgccattaacatcaatccagatgcagaagccttggctgaaattgccatcaactcagcaatcacagctaagatgtttggcatcgaacctaaaattgccatgttgagctattctactaaaggttcagggtttggtgaaagcgttgataaggtcgttgaagcaactaaaattgctcacgacttgcgtcctgaccttgaaatcgatggtgagttgcaatttgatgcagcctttgttcctgaaactgcagctctgaaagctcctggaagtacggtagctggtcaagcaaatgtcttcatcttcccaggtatcgaggcaggaaatattggttacaagatggctgaacgcctgggtggctttgcggctgtaggacctgttttgcaaggtttaaacaagccagttaatgatctttctcgtggatgtaatgcagatgatgtttacaagttgaccctcatcacagcagctcaagcagttcatcaatagtgaaaactataaagtgatatactatgctatactgtagttatgaaactatgtacgaaaagcactgccattaattcctgagaactaaattactgattggtgtcaaaaaggaaaacttccaagcgatgatatcctgtctatacacgacctatagaaatctgtaatatacatatccgtaaaacgataaattccctttttgattttaaatgagtatgaaaagagaattttttggctctttgtcaactgtagtgggttgaagaaaagctaagctcgagaaaggacaaatttcatcctttcttttttgatattcagagcgataaaaatccgttttttgaagttttcaaagttccgaaaaccaaaggcattgcgcttgataagtttgatgagattattggtcgcttccagtttggcgttagaatagtgtagttgaagggcgttgataatcttttctttatctttgaggaaggttttaaagacagtctgaaaaataggatgaacctgcttaagattgtcctcaataagtccgaaaaatttctctggttccttattctggaagtgaaaaagcaagagttgatagagctgatagtggtgtttcaagtcttccgaatagctcaaaagcttgtttaaaatctctttattggttaagtgcatacgaaaaataggacgataaaatcgcttatcactcagtttacggctatcctgttgaatgagtttccagtagcgcttgatag

SEQ ID NO: 7 - DNA, 19702 bp; double-stranded, linear
acccgatgtatcagcggatatttactctatttttcaaacgatgttatacccacaataaaagaaaaaagaccctaaggtctcctttgcttttattattaaacgcgttcaactttacctgatttcaaagcacgagctgaagcccaaacttttttaggtttaccatcgataagaacagtaactttttgaaggtttggttttacggcacgttttgtttggttcatcgcgtgtgaacggttgtttcctgatacagtcttacgacctgtaaagtaacatactttagccattgtgttttcctcctattagatctaatatagcggatgtgctagcaccacataccgtactatgttatcacattttcttgttttttgcaagggaattggaagattttttatttgtgtcttaaatcaggtcttgcgtgacatttctgctctccacatgccatcgttgattaacagaacaccagaattaaaattatgtgtataaaaatcatctctaactgcagctaagggtatagccgtcaagtccaaatcccacagctcatctatcgattttcttacaacaatatctgaatccaaatacagtacacgagactcgcttacatactttggaataaaatacctaaaaaagccgcatatgaaagtccctcaaaggggagacgataacctttcagaatattactgtcaatctaaacattcacaatctcactattcaaagtctctagtcttttttccatcaattggaaccattctcgcggaaggtcatcattaaaaacataaaacttaagattataatgatgaacacaaagagattttattgttgtttcaactttatccatataagcattatctgcacctaagacaatcgcttttttctcttctttcactttttatctcatttctttttattcccatcatattattcccatcatatgtttcccatcatatgtttctacgtaaccattattttcgcctattcgttcgtaaaaccataccagtggagattttagatgaagtcccattacggtttacaatttttacattacgacacggagttttacaaatcgatttcatttgccaaacgtagttagtgaggcagttagctagttcgccaaatagcgactagcgtccaacaatttggaactttagttccaattgttggtactgagtcacatcttctcctctaactctacgtctggatacttgtccgcaaaccagcggagggcaaagtcattttcaaagagaaagactggttggtcaaaacggtctttggctaagatattgcgacttgacgacatccgttcatccaagtcctcaggcttgatccaacgaacggtctttttacccattgggttcataactacttccgcattgtactcgccttccatgcggtgtttaaagacttcaaactggagttgacctacagcgcctagcatgtactcacctgtttggtaattcttataaagctgaacggctccttcttgcaccaattgctcaatccccttgtggaaggatttttgcttcataacattcttagcagaaactttcatgaaaatctcaggtgtaaaggttggcaggggttcaaattcaaacttgttttttccaaccgtcaaggtatccccaacctgataagtaccggtatcgtaaaccccgataatatcacctgccacggcattggtcacattctcacgactctccgccataaactgggtaacattagatagtttagcccccttaccagtacgagggagattgacactcatgccgcgctcaaattcgccagatacgatacggacaaaggcaatacggtcacggtgacgagggtccatgttggcttggattttaaagacaaagcctgagaaatccttgtcataaggatccacaatttcaccgtctgttttcttgtgaccatgtggttctggagcaaacttgaggaaggtttcaaggaaggtctgcacaccaaagtttgtcagggctgaaccgaaaaagacaggcgtcaattctccagccagaatagcttcctctgaaaactcattcccggcttcatttaaaagctcaatgtcatccttgacttgctcgtagaaaggattgctaccaaagagtttgtccccgtcttctagactggcaaaacgctcatcccctttgtaaagctctaaacgttggttatagaggtcatacaagccctcaaaggctttccccatcccgataggccagttcatagggtagctagcaatgcccaagatttcttccaattcttgcaagagatccaaaggctcacgaccgtcacggtccagcttgttcataaaggtaaagactggaatgccacgatgtttcacaacctcaaacaatttcttggtttgagcctcgatccccttggcagagtccacgaccatgaccgcagcatccaccgccatcaaggtacgataggtatcttctgagaagtcctcgtgccctggcgtgtctaagatattcacgcgcttgccgtcgtagtcaaattgcataacagatgaagtaacagaaatcccacgttgcttctcgatatccatccagtcagatttagcaaaagtccctgttttcttcccttttaccgtaccagcctcacgaatctcacccccaaagtagagtaactgctcagtgatggttgttttccccgcgtccgggtgggagataatggcaaaggtacgacgtttcttaatttcttcttgaatattcataagttctctttctttgattctctatttttcttgtttcaatagctgagaatgatttttacattggattttaccattcctttcaacactccattatatcggattttagcatttttttcaatttctatttcttttcacttccccctcccttatttataggaaaatatggtaaaatagaacagactaaaaatcatcatttcacgaaaggatgcaagatgaaaattacgcaagaagaggtaacacacgttgccaatctttcaaaattaagattctctgaagaagaaactgctgcctttgcgaccaccttgtctaagattgttgacatggttgaattgctgggcgaagttgacacaactggtgtcgcacctactacgactatggctgaccgcaagactgtactccgccctgatgtggccgaagaaggaatagaccgtgatcgcttgtttaaaaacgtacctgaaaaagacaactactatatcaaggtgccagctatcctagacaatggaggagatgcctaatgacttttaacaataaaactattgaagagttgcacaatctccttgtctctaaggaaatttctgcaacagaattgacccaagcaacacttgaaaatatcaagtctcgtgaggaagccctcaattcatttgtcaccatcgctgaggagcaagctcttgttcaagctaaagccattgatgaagctggaattgatgctgacaatgtcctttcaggaattccacttgctgttaaggataacatctctacagacggtattctcacaactgctgcctcaaaaatgctctacaactatgagccaatctttgatgcgacagctgttgccaatgcaaaaaccaagggcatgattgtcgttggaaagaccaacatggacgaatttgctatgggtggttcaggtgaaacttcacactacggagcaactaaaaacgcttggaaccacagcaaggttcctggtgggtcatcaagtggttctgccgcagctgtagcctcaggacaagttcgcttgtcacttggttctgatactggtggttccatccgccaacctgctgccttcaacggaatcgttggtctcaaaccaacctacggaacagtttcacgtttcggtctcattgcctttggtagctcattagaccagattggaccttttgctcctactgttaaggaaaatgccctcttgctcaacgctattgccagcgaagatgctaaagactctacttctgctcctgtccgcatcgccgactttacttcaaaaatcggccaagacatcaagggtatgaaaatcgctttgcctaaggaatacctaggcgaaggaattgatccagaggttaaggaaacaatcttaaacgcggccaaacactttgaaaaattgggtgctatcgtcgaagaagtcagccttcctcactctaaatacggtgttgccgtttattacatcatcgcttcatcagaagcttcatcaaacttgcaacgcttcgacggtatccgttacggctatcgcgcagaagatgcaaccaaccttgatgaaatctatgtaaacagccgaagccaaggttttggtgaagaggtaaaacgtcgtatcatgctgggtactttcagtctttcatcaggttactatgatgcctactacaaaaaggctggtcaagtccgtaccctcatcattcaagatttcgaaaaagtcttcgcggattacgatttgattttgggtccaactgctccaagtgttgcctatgacttggattctctcaaccatgacccagttgccatgtacttagccgacctattgaccatacctgtaaacttggcaggactgcctggaatttcgattcctgctggattctctcaaggtctacctgtcggactccaattgattggtcccaagtactctgaggaaaccatttaccaagctgctgctgcttttgaagcaacaacagactaccacaaacaacaacccgtgatttttggaggtgacaactaatgaactttgaaacagtcatcggacttgaagtccacgtagagctcaacaccaattcaaaaatcttctcacctacttctgcccactttggaaatgaccaaaatgccaacactaacgtgattgactggtctttcccaggagttctaccagttctcaataaaggggttgttgatgccggtatcaaggctgctcttgccctcaacatggacatccacaaaaagatgcactttgaccgcaagaactacttctatcctgataaccccaaagcctaccaaatttctcagtttgatgaaccaatcggatataatggctggattgaagtcaaactagaagacggtacgaccaagaaaatcggtatcgaacgtgcccacctagaggaagacgctggtaaaaacacccatggtacagatggctactcttatgttgacctcaaccgccaaggggttcccttgattgagattgtatctgaggcagatatgcgttctcctgaagaagcctatgcttatctgacagccctcaaggaagttatccagtacgctggcatttctgacgttaagatggaggaaggttcgatgcgtgtggatgccaacatctcccttcgtccttatggtcaagagaaattcggtaccaagactgaattgaagaacctcaactccttctcaaacgttcgtaaaggtcttgaatacgaagtccaacgccaggctgaaattcttcgctcaggtggtcaaatccgccaagaaacacgccgttacgatgaagcgaataaagcaaccatcctcatgcgtgtcaaggaaggggctgctgactaccgctacttcccagaaccagacctacccctctttgaaatttctgacgagtggattgaggaaatgcggactgagttgccagagtttccaaaagaacgtcgtgcgcgttatgtatctgaccttggtttatcagactacgatgctagtcagttgactgctaataaagtcacttctgacttctttgaaaaagctgttgccctaggtggtgatgccaaacaagtctctaactggctccaaggggaagtcgctcagttcttgaatgctgaaggtaaaacactggaacaaatcgaattgacaccagaaaacttggttgaaatgattgccatcatcgaagacggtactatttcatctaagattgccaagaaagtctttgtccatctagctaaaaatggcggtggcgcgcgtgaatacgtggaaaaagcaggtatggttcaaatttcagatccagctatcttgatcccaatcatccaccaagtctttgccgataacgaagctgctgttgccgacttcaagtcaggcaaacgtaacgccgacaaggctttacaggattccttatgaaggcaaccaaaggccaagccaacccacaagttgcccttaaactacttgcacaggaattggcgaagttgaaagaaaactagacagaacaaaaccagccctaaggttggttttttcttctctaccaactcccaataactattttggctttatttccagagtattttatggtaaaatgaagagtaataatatttattaaagaggtaaaaacatgattgaagcaagtaccttaaaagctggtatgacctttgaaacagctgacggcaaattgattcgcgttttggaagctagtcaccacaaaccaggtaaaggaaacacgatcatgcgtatgaaattgcgtgatgtccgtactggttctacatttgacacaagctaccgtccagaggaaaaatttgaacaagctattatcgagactgtcccagctcaatacttgtacaaaatggatgacacagcatacttcatgaatacagaaacttatgaccaatacgaaatccctgtagtcaatgttgaaaacgaattgctttacatccttgaaaactctgatgtgaaaatccaattctacggaactgaagtgatcggtgtcaccgttcctactactgttgagttgacagttgctgaaactcaaccatctatcaaaggtgctactgttacaggttctggtaaaccagcaacgatggaaactggacttgtcgtaaacgttccagacttcatcgaagcaggacaaaaactcgttatcaacactgcagaaggaacttacgtttctcgtgcctaatctctagaaagaggtcattctatgggaattgaagaacaacttggcgaaatcgttatcgccccacgtgtacttgaaaaaatcattgctatcgctactgcaaaggtagagggtgttcactctttttcaaacagatcagtgtctgataccctttcaaaactttcactcggccgtggcatttatcttaaaaacgtggacgaagaactcacagcagatatctatctctaccttgagtacggagtaaaagttcctaaggtagcggttgctatccagaaagctgtcaaagatgccgtccgtaatatggctgatgtagaactcgctgctatcaatattcacgttgcaggtatcgtcccagataaaacaccaaaaccagaattgaaagatctatttgacgaggacttcctcaatgactagtccactattagaatctagacgccaactccgtaaatgcgcttttcaagctctcatgagccttgagttcggtacggatgtcgaaactgcttgtcgtttcgcctatactcatgatcgtgaagatacggatgtacaacttccagcctttttgatagacctcgtttctggtgttcaagctaaaaaggaagaactagataagcaaatcactcagcatttaaaagcaggttggaccattgaacgcttaacgctcgtggagagaaacctccttcgcttgggagtctttgaaatcacttcatttgacactcctcagctggttgctgttaatgaagctatcgagcttgcaaaggacttctccgatcaaaaatctgcccgttttatcaatggactgctcagccagtttgtaacagaagaacaataaggctctttgtcaactgtagtgggttgaaaaaaagctaagctcgagaaaggacaaatttcgtcctttcttttttgatgttcaaagcgataaaaatccgttttttgaagttttcaaagtttcgaaaaccaaaggcattgcgcttgataagtttgatgagattattggtcgcttccagtttggcattagaatagtgtagttgaagggcgttgacaatcttttctttatctttgaggaaggttttaaagacagtctgaaaaataggatgagcctgcttaagattgtcctcaataagtccgaaaaatttctctggttccttattctggaagtgaaacagcaagagctgatagagctgatagtggtgtttcaagtcttgtgaatggctcaaaagcttgtctaaaatctctttattggttaagtgcatacgaaaagtaggacgataaaatcgcttatcactcagtctacggctatcctgttgaatgagtttccagtagcgcttgatatccttgtattcatgggattttcgatgaaactgattcatgatttggacacgcacacgactcatggcacggctaagatgttgtacaatgtgaaagcgatcaagaacgattttagcattcgggagtgaaacagtctgggagactgtttcagcctgagcctaggaatttgaaagcgaagctgtttagccaagtcatagtaagggctaaacatatccatagtaataattttgacgcgacatcggacaactctatcgtagcgaagaaagtgatttcgaatgatagcttgtgttctaccctcaagaacagtgatgatattgagattgttaaaatcttgcgcaatgaagctcatctttccctttgtaaaagcatactcatcccaagacataatctcaggaagacaagaaaaatcatgtttaaagtgaaaatcattgagcttacgaataacagttgaagttgagatggaaagctgatgggcaatatcagtcatagaaatcttttcaatcaacttttgagcaatcttttggttgatgatacgagggatttggtgatttttcttgacgatagaagtttcagcgaccatcatttttgaacagtgatagcacttgaatcgacgctttctaaggagaattctagtaggcataccagtcgtttcaagataaggaattttagaaggtttttgaaagtcatatttcttcaattggtttccgcactcagggcaagatggggcgtcgtagtccagtttggcgatgatttccttgtgtgtatccttattgatgatgtctaaaatctggatattagggtctttaatgtctagtaattttgtgataaaatgtaattgttccatatgaatctttctaatgagttgttttgtcgcttttcattataggtcatatgggactttttttctacaataaaataggctccataatatctataggggatttacccactacaaatattatagagccaacaataaaaagaaaaagtgtttgatagatatcaaacacttttttctttgcctcccactatctaaaaaaatgataatagatataattgtaaacaaaaatccagataggttttgcatgattgagaaagttaaaaaaactatggcagagaatcgttaatctcagattgtcggtagaacgataaacaagggcaaaaaagaaaccaatcagactataatataataaactaattggatctctgtgagatagtatcaaatggctaatcccaaagatgatagcagataggataacatccaaatagtacttggactagggaaagaaggtattcataaaataccctctatcaagagtctcctcaaaaacaggaccgatgattacaggcaggacaaaagataagatagtcgataaaaaggttggttgtccatttgaaaaaagcacggtaaaatactcatcatgaatattcctatgattaatcaaatgagcatagcgtgcccaaaaattaccgagaatctgataaaccacataagttgcaaataagtagaagacaaatgaccagttccagctctttttctcaaagataaagagcatctttttcttttttaacctccaaattaatagaaggaaacttcccactaatcccattgttaaaataagagaatagacatcagctcctaaccctaaaatgatcgtcacatacaatccaattgtttgtggtaaataggtagatagtaaaataataagcaaaaatattccaaattgtcttagtttttttgtgtttctcatcgtacttttttgaaagattaccctgctcggaagccgtacttccaagcatctatataagaattaagtgccccttgcctcatatagggagcaaattctctataatataaccatctactatatccatcttcccaaacagcaagaccacctgaagtttgctccaagtcctcagttgaaagaactgtaaatgtatttgtacctgtcattgcaagtaccttcttaaaatagattgttgtaggctcacatttatagtatatttctttttttgtctattttatagcccatctcctcaactggcaatttttcgacctgaattacatttttccataaaaaatgagacctttctagtctcatttagtcattcttagtattttctaaatcgttgatagcgttcttccagcaactcttctagcggtttttgtgaaagtctagccagctccgtttggagttcttttttgacactcttaatcagttctttactagaaagtcctatttcagaaatcaccttatccaccacgtccatttctaacagttcatgcgaagtgattttcatcagttctgctgcttccatagcgcgagtaccgtccttccataaaatggaagcaaagccttctggactgagaatggcatagatagaattttccagcatccagacacggtccgcgacagctagagccagagccccgcctgaaccaccttcaccgataataatggcgataataggaactttcaggtcactcatttccatgagattgcgagcgatagcttccccttgaccacgttcttccgctccgacaccaggataagcacctgctgtattgataaaggtcacaactggacggccaaatttctcagcctgtttcatcaaccgcagtgcctttcggtagccttctggatgtggttggccaaaattccgtttgaggttgtcttgcaaactcttgcctttttggataccaaccactgttacagcttggtctccaagccaaccaataccaccaacaactgcaccatcatcacgaaaagaacggtcaccatgtaattggataaattcatcaaaaatgcctgtcgcaaagtccaaggttgtcaagcgactctgctcacgcgcttctctgactatttttgcaatattcatctaggactccctccatgcaatctgactaggctagcaatcgtatctggtaagtctcttcttttgacaatagcatccacaaagccatgttctaataggaattctgccttttggaaatcctcaggcaagctttcacgaaccgtattttcaatcacacgacgcccagcaaaaccaaccaagctctgtggttcagccagaatgatatcgccttccatagcgaaagaagctgtcacaccaccagtcgttggatctgtcaaaatggtcaggtaaaagagaccagcatttgaatggcgtttaaccgccgcagagatcttagccatctgcatgagactcatgattccttcctgcatacgggctccaccagaggctgtgaataggacaactggcaatttttcgacagtcgcatactcaaacaaacgagtgattttttcacctacaaccgtacccatagaagccatgataaagttagaatccataatcccaagagccacagtctgacctttaataagagcagttcctgtcacaacggcttcatgcagacctgttttttcacgcatagatgccagtttcttttggtaaccagggaaatgcaagggatccttgctttcaatccctgtaaacaattctttgaaggttcccatatcaatcgtcaaagccaagcgttcttgggcagaaatacgaaaggtatagctacagtgcggacagatacgttcacttcccagatccttctgatagatggtatgcttacagcctggacactgggaaaataattcatctggaacctctggcttagcttgaggtttttccctaaccgaacgattgggattgattcgaatatacttatcttttttactaaatagagccattgattccccttttcggtttaaactcttaaagtcattttattctttttcttgatatttaggtaagaaggtttccatcaagaaggaagtatcataatccccagcaatgacattgcgatctgaaatgaggtcaagctggaaatctgcattggtctgcactccttcaatttctaattcatagagggcacgttgcattttcatcaaggcgtcaaaacgattttcgccgtgtactatgattttggcaatcatactatcataataaggcggaatggtataacctggataaactgctgaatccacgcgcaagccaactccaccacttggcagatagagattagtaatcttacctggacttggagcaaagttaaaggctgggttttctgcattgatacgacactcgatggcatgaccgcgtaggacaatatcttcttgcttaacagacaaaggctgacctgccgcaatgcaaatctgttccttaacgatatcaacacctgaaacaaactctgttactggatgttctacctgaacacgagtattcatctccatgaaatagaaattgctacttgcttcatcaagaagaaattcaatggttcctgcattctcatagccaacaaactctgccgctcgaacagcagcagcacctatttcatgacgcagcgtttttccgattgcaatcgagggactttcttccaaaaccttttggttattcctttgaagagaacaatcccgttcacccaagtgaatcacatgtccatgctcatcacctaggatttgaacctcaatgtgccgagctggatagataacccgttctatgtacatggcaccattgccataattggccttggcctcactagaggcagtttcaaaggcagaaacgaggtcatctggtttttcaaccttacgaatccctttaccacctccacctgctgaagccttgagcataacaggatagccaattttttcagcaacaatcaaagcttcttcagagttatgcacttctccatctgaacctggtataacaggcacacctgctttaatcatctgagcacgcgcattgatcttatcccccatcatatccataacatgaccagatggaccgataaacttgatacctacttcttcacacatggtcgcaaatttggaattttcactgagaaatccaaaaccagggtgaatagcttctgcctcagtcaagactgcagctgatagaactgcattaatattgagataagactctgttgccttgccaggaccaatacaaactgcttcatctgccaaaagcgtatgaagagcttccttatcagcagttgaataaaccgctaccgtcgcaatccccaattcacgtgccgcacggataatacgaaccgcaatttcaccacgattggcaattaaaatttttcgaaacatggagaacctccttagttcccaattgcaaaagtaagggtaccactggctgcaagcttgccatccacttcagcctttgcttcaaccacagctatggtgccacgacgttttacaaaagtcgctgtcataaccaattggtcgcctggtacaacttgcttcttgaacttaaccttgtccataccagcgtaaaagaccagttttcctttattttcaggttttgataactccaacacaccggcagtttgcgccaaggcttccataatcacaacacctggcataactgggtattgaggaaagtggccgttaaagaaaggctcgttgatggtcacatttttgatagcaacaatggtatcctcgctcacttccaagacacggtccactagaagcataggataacggtggggaagagcttctttgattccttgaatatcgatcatttgatacgtaccaatcctttaccaaactcaaccatttcttcgttagagacgagaatttccgttaccacaccatccttaggagctgggatttcattcatgactttcatggcttcgataattaccaatgtttgaccttttttgacactatcaccaactgtaacgaaggcaggtttatctggtccagcagccaagtaaaccactccaacaagtggactctctacaagatttccctcagtagccacacttgcttcagctggagctggaacttcttctgctacagtctctgctggagcagatgtaggagctactggactcggtgttgctagaacgggtgctggagcgacttgagttgcaacttcaggcacaggtcttgcttcattcttgctaaactgcaactcatccgtcccatttttataagaaaattctctcaaacttgactggtcaaattgagtcatcaagtctttaatatcgtttaaattcatacttatctattctcccaacgtttgaaagcaagaactgcattgtggcctccaaaaccaaaagtatttgaaatagcgtatggaatttctttctccaagccttgtccataaacgacattagcttcgatataatctgatacttcacttgtcccagctgtcattggtacaaagttatgacgcatagcttcgatggtgacgatagcttctactgcacccgcagcccccagcaaatgtcctgtaaaagacttggttgatgatacaggtacttccttaccaagaacagctacgatagcaccactttctcctttttcattggcaggagttgacgttccgtgagcattgacataggctacttgctctggagaaatctcagcttcttccaaggctagtttgatggccttgatagctccctgaccttctggatgtggagaagtcatgtggtaggcatcacaagtatttccgtaaccaaccacttcagccaggatagtagctccacgtttttcagcgtgttcaagactttctagaaccaacatccctgaaccttcacccataacaaacccattgcgatccttatcaaatgggatcgaagcacgagttggatcctctgtagtagagagagctgttaaggcttggaaaccagcgatggcaaaaggtgtgatagaagcttctgttcctcccaccaacatcacatcttggaaaccaaacttaatggagcggaaggcatccccaatcgcatcatttgatgaagagcaggcagtattgatagatttacaaacaccgtttgcaccaaaacgcatggctacattcccagaagccatatttggtaaagcttttggaagagtcattggtttgacacgtttgggtcctttttcatgaaggcgaagtacctgatcttcaatttccttgattccaccaataccagatgcaacgataacaccaaaacgatccctattaagagcctctacatcaagattggcatgatttacagcctcttgggctgcatacaaggcatataaagaatagttatcaaaacggttggtatctttttttacaaagtatttatcgaacggaaaatcttggatttctgccgcattatgcacatcaaagtcactatgatcaaattttgtaatgccaccaatgccgattttcccagttgctaaactattccaaaattcttctggtgtatttccgattggagatgttactccataacctgttaccactactcgatttagtttcattcttttcacctctagctttcgctacatacttaagccaccatcaatggcaaccacttgtccagttagataatcttggcctgctaaaaatactgtcaaatctgcaacctgctctgcctgcccaaattctttcatcggaatctgagctagtgtagcttccttaatcttatctgacaggatagcggtcatatcagactcaatcattcctggagcaatcacattgactcgtatattccgactagcgacctcgcgtgccacagacttggtaaagccaatcaagccagccttagaagcagcataattagcttgaccaatattccccatcaaaccaacaacactagacatattaatgatagcaccttctctggctttcatcatcggtttcaagactgattgtgtcatattaaaggcaccagtcagattgaccttgagcactttttcaaaatctgcttctgtcatcttgagcataagagtatcttgggtaatccctgcattgttgaccaaaacatctactgaacccagttctgcaatagcttgatcaatcatacgcttagcgtctgcaaaatctgatacatctcctgaaatgggaaccaccttgataccatagtttgaaaactcagcgagcaattcttctgagattgccccacgactgtttaagacaatgttggctcctgcttgagcaaacttgtgggcgatggcaagaccaattccacgactcgaacctgtaataaagatatttttatgttctagtttcatttttttcctttcaaaacttctacttattttagtctatttttctaaaagtgctactaaactcgcttgatcttccacatgagctaagtgagcagtttgatcaatttttttaacaaaacctgacaagactttccccggtccaatctcgataaagttgcttatgcctgcttcttgcatgaccccaatactttcatagaaacgaacgggttccttgacctgacgcgtcaagagctgagcaatgtcctctttttgcatcacagcagcttctgtattgccgactaggggacaagtaaaatctgaaaaacttacctgagctagagtttcagctagtttctggctagcaggttcaaggagagcggtgtgaaagggacctgacaccttaagaggaatcaagcgtttggcacctgcttcttgcaaaagttcaaccgctcgatcaactgcaaccacttctccagcaatgacgatttgtgcaggtgtgttatagttggctggagtaaccactccaagttcagaagctttttgacaggcttcttcaatgacctctactggcgtattgagaactgctaccatcttgccagagtcagcaggagccgcttcttccatataggctccacgcttagctaccaaggcaaccgcatcttcaaaatccaaggcgccacttgccaccaaggcagagtattctccaagagacaaaccagcaaccatatcaggctgatagcccttttcttgcaataaacggtagatagcaaccgaagtcgctagaatggctggttgcgtatagcgggtctgattgagtttgtcttcttccgtatcgatgagataacgcaaatcataaccgagcacctggctcgctcgatcaatcgtttctttaacaatcggatactgatcatagaaatcccgtcccatccctagatactgggcaccttgaccagcaaataaaaaggctgttttagtcatttcttacaactcctgtccagcgagaggcttcttcttgaattttcttagcggctccgtaatacaaatcttttaggatttcttcagctgtttcttctttagaaacaagccctgcgatttgacctgccataacagagccaccatccacatcaccgtgaacaactgctttggctagagcacctgctcccatttgttcaaagatttctaaatcaggatcttcttgcttaaaggcatctttttcagccagttcaaaatctctagtcaactgatttttaatagcacgaacagcatgaccaaagtgctgagctgaaatcgtagtatcaatatcccttgcttttaaaattttctccttgtagtttggatgggcattcgactcttttgcaactacaaaccgtgtccccacctgtacagcctctgcacctagcataaagccagccgcagcaccttcaccatccgcaattcctcctgcagcaataacaggaatagatatagctgtggctacctgtcgcaccaaggtcatggttgttaatttaccgatatgccccccagcttccattccttctgcaataacagcgtctgcaccgattttttccatgcgtttagctaaagcgacactaggaacaacaggaataacgattatcccagcttcatggaaacgttccatatacttgcttggatttcctgctcctgttgtgacaactttaacaccttcttcaataacgagatccacgatgtcttccacaaagggagataagagcatgatgttgaccccaaagggtttatcagtcaatgatttgattttatcaatattggccttgacaacttctttcggggcatttcccccaccgataattcctaatcctccagccttggaaacagcccctgccaaatcaccatcagcaacccaggccatccctccttggaaaataggataatcaatcttcaataattctgtaatacgcgttttcatagtgcctccaaccttccttgcttacgtaatagttcgatttcaccataatttgacagtcaaactattacctaaacaagagggagtgggtttctccctactccttctactaatattctgcttattttgcttgctcttcaacgtaagcaaccaagtcaccaactgttttcaagtcattttctgcttcgatttggatatcaaaagcatcttcgatttctgagattacttggaacaagtccaatgaatctgcgtccaaatcatcaaaagttgattcaagtgttacttctgatgcgtcttttccaagttcttcaacgataatttcttgtactttttcaaatactgccatgataggactcctttaaaataaatagtttttttataacaatgtgttcaccacatgattacctaaattgtaagaatgagcgtgccccaggtcaagcctccaccgaagcctgatagaagaacagtctggctaccatctaaagggatgagaccttgttctacacactctgaaagtaaaatcgggatactggctgcactggtattgccatattccatcatattggctggaagtttggctcggtcaacaccaatttttctagccatcttatccaaaatacggtcattggcttgatgaagtagcagataatccaagtctgtcacctctataggagattcatcaatagtctgcttgatagacttggctacatctcgaatggcaaaatcaaagactgtgcgtccatccatcttcaaaaacgaatctgcactttcttgatctgaaaatggagaatgtaaacctgaatgcccataagttaaacactcgctgcgacttccatcgctattgagactctcagctaagaaatgctcttgctcgctagcttctaacaagacaccaccagcaccatctccaaacaacacagctgttgatcgatccgaccaatcgactgccttagagagggtttcactaccaatcaccaagcctttttgaaagcgaccagaagcgataaacttttcagcagttgaaagagcaaatacaaatccactgcaagccgcggttaagtcaaaagcaaaggctttattagcaccaatattagcttgaacacgagcagctgtagagggcatcatcgaatctggagtaatggtagctaggatgataaaatccagttcttctcctgttattccagcttttgccatcagtttcttagcaacctctgtagccaaatcactggtagattctgttcttgaaatatgcctttgtcgtattcccgttcgacttgaaatccactcatcattggtatccataatctgagccaagtcgtgatttgtaaccacttgctctggcacataatgagcaacctgacttatttttgcaaaagccattatttcaaatcctccaaaaattggtaaagattagtcaaacctttacccatgacagcaatttcttcctcgctcatgccatcaataattttttctaccatggccttgtggaagcgtttatgcagtctatgaatcaagcgacccttctttgtcaaatgcagatgcaccacacgacgatcctgttctgaccgaactcgctcaatgtagcccgg

SEQ ID NO: 8 - DNA, 6211 bp; double-stranded, linear
gaaaatttcctctcttctcttgaaaaattttgaaaaaatggtatgatagtaacaagttatttttaagaggaaagaaaggggaataatggagaaaatcagtttagaatctcctaagacggggtcggacctagttttggaaacacttcgtgatttaggagttgataccatctttggttatcctggtggtgcggttttgcctttttatgatgcgatatataattttaaaggcattcgccacattctagggcgccatgagcaaggttgtttgcatgaagctgaaggttatgccaaatcaactggaaagttgggtgttgccgtcgtcactagtggaccaggagcaacaaatgccattacagggattgcggatgccatgagcgatagcgttccccttttggtctttacaggtcaggtggcgcgagcagggattgggaaggatgcctttcaggaggcagacatcgtgggaattaccatgccaatcactaagtacaattaccaagttcgtgagacagctgatattccgcgtatcattacggaagctgtccatatcgcaactacaggccgtccagggccagttgtaattgacctaccaaaagacatatctgctttagaaacagacttcatttattcaccagaagtgaatttaccaagttatcagccgactcttgagccgaatgatatgcaaatcaagaaaatcttgaagcaattgtccaaggctaaaaagccagtcttgttagctggtggtggaattagttatgctgaggctgctacggaactaaatgaatttgcagaacgctatcaaattccagtggtaaccagtcttttgggacaaggaacgattgcaacgagtcacccactctttcttggaatgggaggcatgcacgggtcattcgcagcaaatattgctatgacggaagcggactttatgattagtattggttctcgtttcgatgaccgtttgacggggaatcctaagactttcgctaagaatgctaaggttgcccacattgatattgacccagctgagattggcaagattatcagtgcagacattcctgtagttggagatgctaagaaggccttgcaaatgttgctagcagaaccaacagttcacaacaacactgaaaagtggattgagaaagtcactaaagacaagaatcgtgttcgttcttatgataagaaagagcgtgtggttcaaccgcaagcagttattgaacgaattggtgaattgacgaatggagatgccattgtggtaacagacgttggtcaacaccaaatgtggacagctcagtattatccctaccaaaatgaacgtcagttagtgacttcaggtggtttgggaacaatgggctttggaattccagcagcaatcggtgctaaaattgctaacccagataaggaagtagtcttgtttgttggggatggtggtttccaaatgaccaaccaggagttggctattttgaatatttacaaggtgccaatcaaggtggttatgctgaacaatcattcacttggaatggttcgccagtggcaggaatccttctatgaaggcagaacatcagagtcggtctttgatacccttcctgatttccaattgatggcgcaggcttatggtattaaaaactataagtttgacaatcctgagaccttggctcaagaccttgaagtcatcactgaggatgttcctatgctaattgaggtagatatttctcgtaaggaacaggtgttaccaatggtaccggctggtaagagtaatcatgagatgttgggggtgcagttccatgcgtagaatgttaacagcaaaactacaaaatcgttcaggagtcctcaatcgctttacaggtgtcctatctcgtcgtcaggttaatattgaaagcatctctgttggagcaacagaagatccgaatgtatcgcgtatcactattattattgatgttgcttctcatgatgaagtggagcaaatcatcaaacagctcaatcgtcagattgatgtgattcgcattcgagatattacagacaagcctcatttggagcgcgaggtgattttggttaagatgtcagcgccagctgagaagagagctgagattttagcgattattcaacctttccgtgcaacagtagtagacgtagcgccaagctcgattaccattcagatgacgggaaatgcagaaaagagcgaagccctattgcgagtcattcgcccatacggtattcgcaatattgctcgaacgggtgcaactggatttacccgcgattaaaaatccaacttaaatttattaaaccagcctaaaaggcaataaataatagaaaagagagaaaagctatgacagttcaaatggaatatgaaaaagatgttaaagtagcagcacttgacggtaaaaaaatcgccgttatcggttatggttcacaagggcatgcgcatgctcaaaacttgcgtgattcaggtcgtgacgttattatcggtgtacgtccaggtaaatcttttgataaagcaaaagaagatggatttgatacttacacagtagcagaagctactaagttggctgatgttatcatgatcttggcgccagacgaaattcaacaagaattgtacgaagcagaaatcgctccaaacttggaagctggaaacgcagttggatttgcccatggtttcaacatccactttgaatttatcaaagttcctgcggatgtagatgtcttcatgtgtgctcctaaaggaccaggacacttggtacgtcgtacttacgaagaaggatttggtgttccagctctttatgcagtataccaagatgcaacaggaaatgctaaaaacattgctatggactggtgtaaaggtgttggagcggctcgtgtaggtcttcttgaaacaacttacaaagaagaaactgaagaagatttgtttggtgaacaagctgtactttgtggtggtttgactgcccttatcgaagcaggtttcgaagtcttgacagaagcaggttacgctccagaattggcttactttgaagttcttcacgaaatgaaattgatcgttgacttgatctacgaaggtggattcaagaaaatgcgtcaatctatttcaaacactgctgaatacggtgactatgtatcaggtccacgtgtaatcactgaacaagttaaagaaaatatgaaggctgtcttggcagacatccaaaatggtaaatttgcaaatgactttgtaaatgactataaagctggacgtccaaaattgactgcttaccgtgaacaagcagctaaccttgaaattgaaaaagttggtgcagaattgcgtaaagcaatgccattcgttggtaaaaacgacgatgatgcattcaaaatctataactaattagaaatatatagcgctggagatgattttatgaaaaagattatgagaaaaattgcatcgttattattggttctagttgtataatgtaattacaccgtcggtaatagtgctagcagaccaaaataaagcagattggtcgtatgatgaaaatgctgtaattaacatttatgatgatgctaattttgaagatggtaggttgcatatgaactttgaacaattcttcaaattggcacaaatagctagagaagaaggtcttgaaattcattctccgtttgagagagctggtgcgactaaatctgctcgttatatagcgaaatggattttgagaaataaaaaacattaacaaatatagttggtaaatcattaggacctaaatcagctgttagattcggagaagctttatcctatattgaaggtcctcttcgcagaataaatgagacgatagatggcggtttatatcaaatagagcaaattattgcatctggattgaaagaatcgggtttaaatgactggactgcgaaaactttagcttcagctattcgtgggatattagatgtacttatttaggggttgaaatcatatgaatattaccaatttgttttctatcaagacaggatgtgatgaaactgataggcaactgcaaaaactattttttcagttggatttacaattgggagaattgacagatcaactaagaaaattagattctaattttgttcctcgtagtcaatttgtagacacgttggatttgaatgatgtagaatataaagaaattttaaactattttatcttccatcgtaatgatagtgaagaaagtttggtagaatggttatatgattggatttccacaaatcgttatgaacttcctaaagagttttcgattcgtatggctcataaataccatgaaagtgttactgaagttttcggagatgaataactaaaaaacagtcattagtgactgttttttatagaaaaagaggttttatatgttaagttcaaaagatataatcaaggctcacaaggtcttgaacggtgtggttgtgaatactccactggattacgatcattatttatcggagaagtatggtgctaagatttatttgaaaaaagaaaatgcccagcgtgttcgctcctttaaaattcgtggtgcctattatgccatttcccagctcagcaaggaagaacgtgaacgtggggtagtctgcgcttctgcgggaaatcatgcgcagggagtagcctatacttgtaatgaaatgaaaattcctgctactatctttatgcccattactacgccacaacaaaagattggtcaggttcgcttttttggtggggattttgtaactattaaactagttggagatacctttgatgcctcagccaaagcagctcaagaatttacagtctctgaaaatcgtacctttattgatccttttgatgatgctcatgttcaagcaggtcaaggaacagttgcttatgagattttagaagaagctcgaaaagaatcgattgattttgatgctgtcttggttcctgttggtggtggcggtctcattgccggggtttctacctatatcaaggaaacaagtccagagattgaggttatcggagtagaggcgaatggagcgcgttccatgaaagctgcctttgaggctggaggtccagtaaaactcaaggaaattgataaatttgctgatgggattgctgtgcaaaaggtaggtcagttgacctatgaagcaactcgtcaacatattaaaactttggtaggtgtcgatgagggattgatttctgaaaccttgattgacctttactctaagcaagggatagtcgcagaacctgctggagcggctagtatcgcctctttagaggttttagctgaatatattaaggggaaaaccatttgttgtatcatttctggaggaaataatgatatcaaccgtatgccagaaatggaagagcgtgccttgatttatgatggtatcaaacattactttgtggtcaatttcccacaacgtccaggagctttgcgtgagtttgtaaatgatatcctggggccaaatgatgatatcacacgttttgagtatatcaaacgagctagcaagggaacaggcccagtattaattgggatcgctttagcagataagcatgattatgcaggtttgattcgtagaatggaaggttttgatccagcttatattaacttaaatggtaatgaaacgctttataatatgcttgtctgaggactaataaaaaaatatcataccttcattttgatttcctatctattgacaagcatagtcacactgtctttaatactcttcgaaaatctcttcaaaccacgttagctctatctgcaacctcaaaacagtgttttgagcaacttgcggctagcttcctagtttgctctttgattttcattgagtataaggtatgatttgatttctttttgttgacaaatatactatattaaaaagatatataagtaattaactgagcttatctgtcttgtcatctctattaaggatggtttagataatcgggtgtctgcttctaggctagcacctcaatatccaaaggagtgatgaatttgaaggacataaggaatacctatctctcagatgatttattgaggaagaaagataggagtttttgagctagtgaaggcttggatttctaaaggttagaactatcatcttcagttcttaaatcgaagaaataagctatcttacggaaatagagaagcattttttaagaacttgaataatttcgcaccttaagagggtaataatacagtatttttattagcaaatatttatggtgtagaggctagcaaaacctatatattatcggatttaaaaaggaagtaagaaa

SEQ ID NO: 9 - DNA, 7939 bp; double-stranded, linear
ccggactccccacgattcttcaaaataactgagtatatttctatcttgattttcagatataaattcttccttctgtggcctcttcttacgcttgagaagagcttctccgacatggcttcttccttactgagcaaaaccttgagcatagataagtttgactggcaagcgtgctcttgtatatttggctcccttcccactattgtggatagcgaggcgtcttctcatatcagtcgtatagcctatatagtaggatccatcacgacactccagaacgtacatataagccttatgatccataataaatctcttcgatttcgggcgtataagagccatcatcattgtggacaatcaaaggaggtaagaccttaaagccacttgttgagccatccttgatcgcctcaatcaaaagcatattggcttccttttctctttttggataaacaaactgcaggcgcttaggggctagattatgtcgttttaacgtatccaaaatatccagaagtcgatcaggacgatgaaccatggccaaacgcccattagacttgagaatactctgggcactacgacagatttcttccaaattagtcgtgatttcgtgtcgagccaagagataatgttcactctcgttcagattagaataaggattcaccttgaaatagggtggattacacaaaatcatatccaccttactcccctgaatgtgagcaggcatatttttcaaatcatcgcagatgacctgcatttgctcctctaatccattcaaacggacagagcgttcagccatatccgccaaacgctcctgaatctcaacagacaatatctgtgcttgagtacgagtgctagcaaaaagccccactgctccattcccagcacagaaatccacaatcaaccccttcttaggaaaacgtggaaatcgtgataagagaacactatccaccgaatagctaaaaacctctctattttgaatgattttgatatctgtcgaaaagagctggttaatgcgctctcctgattttaataattgttcttcttccatggtcctattatagcaaattcatattaacattacaaaaaatataaaactctaaactacttcttcttttttaaatggtgcagggcttctccagtccagattggtagcattcgtcgaaagggagcaaagccgtagttaaagcggtcgcttgaaaagcgtctccgtctaggaaactggtacttttcttcctccaaagtgcggatagaaagactggctttccctgtaaattcatctaaatccactacctgaacttgaacctcttcatcgactttcaaggtttcatgaatattttcaataaatcctgtccgaatctctgaaatgtgaatcagccccgtatcacccgtctctaactcaacaaaggcaccgtagggctgaatccctgtaatacgcccctttagcttatcaccgattttcatcttagtcctcgatttcaatagtttcaattacaacatcttcaactggcttgtccatagctcctgtctcaacagcagcaatggcatccaagacagcgtaagatgcttcatcagctaactgaccaaaaaccgtgtgacggcggtctaggtgaggtgtcccaccttgattggcatagatttctgcaatcggttctggccaaccaccacgagtaatttctttcttagaataaggtaggtgttggttttgcacgataaagaactggctgccgttggtatttggaccagcatttgccatggaaagagcaccacggatattgtaaagctcttctgagaattcatcctcaaaagattcgccgtagattgactcgccacccataccagttccagttgggtctccaccttggatcataaagtccttgataatacggtggaaaatgacaccatcatagtagccatcttttgaaagagatacaaagttagccactgttttaggagcatgttcagggaaaagcttgatacgtaagtctccgtgattggtcttaatagtcgcaagaggaccttctactgtttcaatgtctacttgtggaaaatgcaattctttttctaccataccaaatacttctaaggcagcaaaaatgccatcttcttctaatgtttttgtaatataatctgctttttctttgattttatcatgagaaattcccatggcaacgctgattccagcataatcaaagagttccaagtcgttgagaccatctccaaaaaccatgaccttctctggtttcaagccaaggtgttccacaaccttttccacccccgtcgctttggagcctgaaatcggcacaatatcagacgaatgttgatgccaacgaaccatgcgaagtttgtctgagagactgtcaggcaagtgcaagtcatctcccttatcttcaaaagtccacatctgatagatatcttctttttcatggaaatcgggatctacatctaagtcgggataaattggattgatagcttcactcatcatatcggtgcgagtcgacaacttggcatcatgactcccaaccaagccatactcaattccttcttgcttagcccaagagatatactcctcaacatctgacttttcaatctgatgctgataaatgacctgaccttttttatcttcgatataagccccattcaaagttacaaaaaagtcaggcttgagatcacgaatctctggaacaacaccaaaaatgccacgtccagaggcgattcctgttaaaattcctttttcacgcaactgtttaaaaacagtgggaattgtagttggaataaaccctgtctttgaattccgcaatgtatcatcaatatcaaaaaagacaatcttgatcttctttgccttgtatcttaatttcgcgtccatctcactacctctttcaatctaactctttccattatatcataaagtaggcaaatcccctattttcaaaaagtttatcatttttattttaatttcttggatgagaaaagagacatatttatgaaaaagctccatcgtgcttttaatgtgttctcttgttttcaaactcgtaaaaagggagccactgatcctaactcgctctctcatttcaaagcttgtgaaaaaagacccgttggggtcttaattcgctttcttgttttcaagctcatgaaaaagagacccaactgggtcttttctttaatcttcgtttacgaaaggcatcaaagccattacgcgagcgcgtttgatagctgttgttactttacgttggtttttagctgaagttcctgttacacgacgaggaaggattttcccacgttctgaaacgaaacggctaagaagctcagtatctttgtaatcaacatattcaattttgtttgctgcgatgtaatcaacttttttacggcgtttgaatccgccacgacgttgttgagccatgttttttctcctttataagtttagttgtccattagaatggtaaatcatcatctgaaatatccaatgggtttgttgctccaaatggattttcattacgtgaaaagtctggtactgaatttgtaggtgctgaatagtttgcagttggtgcagagtaagctccacctgtgtgaccctcacgcacactacggctttccaacatttggaaattctcagccacgacctctgtcacgtagacacgttgtccttgctggttatcgtaactacgagtctggatacgacctgtcaccccgataagtgagccttttttagcccagttagcaagattttcagcctgttggcgccacataacgacattgataaaatcagcctcacgttcaccattttgactcttaaatgtacggtttactgcaagagtaaaagtcgcaactgctacatttgatggggtataacgcaactcagcgtcacgtgtcatacgccctacaagtacaacattgttaatcatagtttaccttcttacgcgtcaattttgacgatcatgtgacgaagaatgtcagcgttgatttttgaaagacggtcaaactctttaagagctgcatcgtcatttgcttcaacgttaacgatgtggtaaagtccttcacggaaatcttggatttcgtatgcaagacgacgtttttcccaagtttttgattcaacaacagttgcaccgttgtcagtcaaaatagagtcaaaacgtgctaccaaagcgtttttagcttcttcttcaatgtttggacgaatgatataaagaatttcgtatttagccattgatatgttcctccttttggtctaatgaccccaagactttgcaaggggtaagtgaggttcgctcacaataaactattatactagaaaaaatttttttacgcaagtaaaaacactagaattcgaaaaaacgccacatgggcgttttcctgttcttatggtttgatacggtgcaacatacgtgggaatggaatagcttcacggatatgttttgttcctgctgcgaaggttaccatacgttcgataccgataccaaatcctccgtgtggaactgtaccgtatttacgaaggtcaaggtagaattcatattctgtacgatccatgccaagttcatccatcttagcgacaagggcatcgtaatcttcctcacgcatagacccaccgataatttctccatagccttctggagcaagcaagtctgcacaaagcacgcgctctggatttccaggaactggtttcatgtagaaggccttgatggctgctggatagttcatgacaaatgttggcacaccaaagtggtttgaaatccaagtttcgtgtggtgacccaaagtcatcaccatgctcaagatgctcgtagtcagcatcttcatcattttcatgctcttgcaagaggtcaatggcttgatcgtaagtgatacgtttgaatggctctgcaatgtagcgtttcaagagttctgtatcacgttccaaggtttccaaggcttgaggcgcgcggtcaagaacaccttgtagaagagctttcacataagcttcttgcaagtcaagcgactcatcatgtgtcaagtatgagtactcagcatccatcatccagaactcagtcaagtgacggcgtgtttttgatttttcagcacggaaaactggaccaaagtcaaagacacgaccaagagccatagcccctgcttctaggtaaagctgacctgattggctcaagtaggctggcgttccgaagtagtcagtttcaaagagttctgtagaatcttctgccgcatttcctgaaagaattgggctgtcaaacttcataaaaccgttcttgtcaaagaactcataagttgcatagataatagcgttacggatttgcaacacagctacttgcttacgagagcgtagccacaagtgacggttatccatcaaaaagtctgttccgtgttcttttggtgtgattgggtagtcttgagattcaccgatcacttcgatgtctgtgatgtccaactcatagccaaatttagaacgttcgtcctctttgacaatacctgtcacataaacagacgtttcttggctcaagcgtttgataacatcaaacttctcaagtcccacttcttcaccaaatttttcgacaaagtttggtttaaaagccacaccttgaaagaaggctgttccatcacgcaattgtaagaaagcgatttttccttttcctgatttgttggcaacccaagcgccaatcgtcacttcctgaccaacatagtcttttacgtcaataatcgttacacgttttgtcattatttttccttttcttttttattctttatggcaaaccacctctatattgttcccatccaggtcaatcataaaagcagcatagtaaatcggatgctcacttcgataaccaggagccccattgtctcgcccacctgcctctaagccagcctcataacaagcctgaacttcttccttattttctgctaaaaaagcaaaatgaacaggatcttgtgttccctgagtcagccaaaaatcaccaccaggatgagggctgttcggggatagaaaactaattagagaactagtcttaaaagccaatttatagtccaaaggagcgagaaaactcctataaaatccttatgaaatttgtaaatcctttaccttaatctcaaaatgatcaatcattctcactacccataaatgctttcaagcgttcgactgcttctttaagcgtgtctaggtctgtcgcatagctgaggcggacattttctggtgctccaaatccagctcctgttaccaaggccacttcggcttcttctaagataacagttgtaaagtctgtcacatccgtgtagcctttcatctccatggcctttttgacatttgggaagagatagaaggccccttgcggtttgaccacttcaaatcctggtacctctgcaaggaggggatagatggtattaagacgttcctcaaaggcctgacgcatgctttctacagtatcttgctcacctgatagagcctcaactgctgcatattgggctactgctgacggattcgaagttgtttgacctgcaatcttggacatggcagcgataatgtctgcttctccaacggcataaccaatccgccaaccagtcatggcataagttttagacacaccattgatgaccactgtttgcttgcgaatcgcttccgataggctagaaatcggtgtgaactcatgaccattataaaccaagcggccatagatatcgtctgctaggatgagaatatcattttctacagcccagtttccaattgccaagagttcctcacgggtgtaaatcatacctgtgggattagatggcgaattcagcaccaaaaccttggtcttgtcagtgcgagctgcttctaactgctctacggtcaccttaaagtgattgtcttccttagcagaaacaaagacgggaacgccttctgccatcttgacctgatctccatagctaacccagtatggggttgggatgatgacttcatcacctggattgaccacagccataaagaaggtatagagagaatatttggctcccgcagcgactgtcacttgatttgacgctacagaatagccgtaaaagcgctcaaagtagctattgaccgccgccttaagctctggcagacctgaggttactgtataaaaagaagcacgcccatctcgaatcgatgcaatggcggcatcttggatatttttgggagtagtgaaatctggctcacccaaggttagagacaaaatatctctaccctcagccttcagtgctttggcacgggctccagcagccaaagtcacactttcttccatttctaaaacacggttggatagtttcataggccctccttgttgaccaatgctcctgtttcaaaatctactagataaaaatcagatcctgacttaacttcccagattggcttatcttgataacggccaaaggttatcttgtcaatctcgccagctcccttttccttagaaaccgtttctgctttttcttgtgaaacaccctgatttagctgataaacgtaaatcttatggtcatctttaccaatcaggacagcaagcgcttcttgctgtttgttacgaccaagaacgctgtaataagattccaagccattgtataaatcaacctgatcagcctgctctaatcctgcatactgctgagctaatttttctccttcacttttagctgtttgatagggtttcatgctaagagaaaccatatacagaaaggaaccactgataaccacaaacaaaatcgtcatccctagaccatactgccacagtagattattttttgctttgttttgtctttttttcactcgtctattttaccatctattaagctttattacaagtgaatataagaatactcttcgaaaatctcttcaaaccacgtcagctttatctgcagacctcaaagctgtgctttgagcaaccaattctatttctcccttcaaacaaaaccgattttgaaagtgaaacagttcttactttttcagtcacaaatgattagagtttgccggg

SEQ ID NO: 10 - DNA, 9897 bp; double-stranded, linear
ccgctctaccgtcaaataattaccattttgtttaataccgaaatttttatctactgaaaattcagttggtctgttggtacgatcgtcgtatacagtaccattctcacgaatagtataattgtaatcagtatcaccttgtttccttaatttaaggtaataattaccatcaatttgtttataacctgaatcttttctagttgcttctctaaaacttactccagcaggcatcacatcagcaaacatgagtacttgtttgttctttttttcaacaataacagagtcaatataggttgcaccaccgctgatttgtaagtcacgtccaccaacttcacgaggccattctaatggtactggcgcaaaatcatcgaatgccaatgttaattttggtttagtccatgtcttaccattatcatcactataacttgtagcaatattaattttattcaagaaatcatgagttccaccgtaacgagcgtcaatgcttgaaaatacccgaccattgctaaaagtatacagaactggaatacggaaatagttagaacctgttgtatcattagccgtataaattaaatgtccagtaacagcgtttgttgtcatctttttaacagtttcttcatccaatgcactattaaagaatttgatattttctagtgttccgttaaaaccaaacgccgtttttcctgcacgtttcactcccccaagcatatagtaatcaatacctttaatatccttgatgtttaggaaattatccactttcttttctactacttttgtaccatttgcgtataaagaatatgtttttttgactgaatctgctactactgcaacagtgttagtcacagcctcttgtttgtacttaccccaaactgaagcaggtctggatactaggttatttttattggaagaagtatcacgcgcttccatccccaactcaccattgtctctaaggaacacatctacataactattttgttgaccgggtttggaattagatattccaaacagagcttgtaagcctttctcacttgactgattgtacttaatcactacagtaaagtcaccgctagtaaatttatcctttaactctttagtaacattttctccgccccctgttaaagtaacattatttttttctaagacaggagtttcttccgctgtagaagatggatccttaacagtagtttcaactgttcgaggttgtacagtaacttccgaagagttatccgatgtaggttgtacttccgaaatcggagtcgttggtgcaacaggttgcaccaactttggtgttgatacttcagaagtttcagtctcctgagctgcaactgagttagcaacaaatgctgataataccactacagtacctaaggttacatattgtttaatattttttttcattttatttttcctcgtttaaaactttgataacaagttttttaacagtttcatcattgcaatgaatctttggttggtgaagatcttcttcaaaagtcaccaacatattccctggaagcaattcaacaatttgatagtctttgctatcgtaaaaagcaatatccttctcttcgctaaaaggtacacgtgactgggcacgaactggggaagttactgccattttttcagtattttcaacaacaatatgaatatctaaatatttcttatgagtttcaaaaatatctcctggaactccatcagctagataagtcatacaatttgcaaaaacattttccccgtcaatatcaatttttccatcaactaaatctgtcaaatttgtattttctaaaaaatcacagacttttgaaaaatatttattgacagaagcatatcgtttaaaatcagattgttcagaaataatcatattattttctcttttctattagtgacgaacttcccaacttgaatccgctttaatttctgtaatatcatgaatcgttgtatatttaggtgcagatactttatttccagtaagaacagatacaatataacctgaaactactgatacagagattgaaatcaatgaatatgcccagtagctaacagctgttggaggaaggaagtatttaataaataccatgacgatggttgatacaatcagcgctgcataagcaccttgtttatttgcttttttagaaacaaatccaagaataaatacaccaccaagtagaccaagtacaagtcccatgaaactattgaaccattcgtatgcagatttaatatctgagtgagccatgacaatggaaacaccaattgagaataaacctactgctagagatacgaattgtgcaattttcgtacgacgattgtctgacatatttttagaaatgacatcttgaatatccaatgtccatgaagttgcaacagagttcaaacctgttgaaatagttgattgagatgctgcataaatcgctgccaagatcaaacctgtgatacctactggtaactggtatgcaataaagtacataaagatttggtcttgagggatattgctagctgcactatctgcattttgtacttgatagaatacgtacaagcctgtaccaatcaagtaaaagactgttgcagttgcaagtgacaaaacaccgtttgtgaacaacatcttattaagtttcttaatattttgtgttgtagtaaaacgttgaaccaaatcttgagatgaagcataggaagacaagattgtaaagcctgaacccatcacaattaaaaagatggagtttgaaagcaagttaggatcgaaaagtttttcatttgcagcaaggaatttcccgtttgctaatgtttctgctactgcaccaaagccacctttaatattagcaatcagtacaaataaagctaaaacgacaccactaatcagaatcacaccttgaataaagtctgtccataatacggattttagaccaccagtataagaataaacaattgcaactacacccatcaaaataatcaaaatattgatgtcaattcctgtcaatactgataaaccagctgatgggaggtacataatgatagacatacgtcccaattgataaataataaacaagagtgctgaaataatacgaagtgctttagaattaaaacgtttatccaagtaatcatatgccgtatcgatgtctatccgtgcaaagataggtaagataaaacgaattgtcagtggaatagctactaccatccctaattgagcaaaccataaaatccagctacctgcataagagctaccagcgagtcccaagaaggaaatcggactgagcattgtggcaaaaatggataccgaagtaacataccaaggaaccgaaccatctcctttaaagaactcttttcctttcatctcttttttagagaaatagatacctgcaaccaacaccgcaagtaaataaacaatcaagataattaagtcaattattgtaaatcctgttgtgcccataacatatctccatattgattttatttattataaaaattcttttcgtgcttgttgaataagttctgctgcttgttttgcaacttccaagtcaccttctgccaatgcttctaaaggttgacgaacagaacctaaatcaagtttttcatttagacgcaaaacttcttttgctacagcatacatatttgccttacctgatatcatcttatagataacttcattgatagcatattgaagttttttagctgtatctaaatctcgttcttgaatcaaactttccaatttcaagaacaaatctggcataacgccataagtaccaccaataccagcttctgctcccatcaagcgaccaccaagatattgttcatctggaccattgaatacaatgtaatcttctccacctgcagctacaaacatttgaatatcttgtacaggcatagaagaatttttaactccaatcacacgaggattttgacgcattgttgcatacaaactaccagtcaacgcaacccctgccaattgtggaatattatagataataaaatctgtatttgacgcagcttcactcattgcattccaatatgctgcgattgaatactctggcaatttgaaataaataggtgggatagctgcaatagcatcgactccaacactttctgaatgttttgccaattcgatactatctttcgtgttattacatgcaatatggttgataactgttaatttacctttagcaacttccataacagcttcaataatttgtttacgatcttctacactttggtaaatacattcacctgaagaaccatttacatagataccttttacacctttgtcaatgaaatattgtaccagagattttacacgatcttggctaatttcaccattttcatcatagcaagcataaaatgcagggataacgcctttgtatttagttaaatctttcatcagatttctcctttatattgttttttatttgatgacattaataaatcgctgagcaatttcttttggacgtgtaatcgctccaccaatgactacactggtaacacctaaactataagctttttttaattgttctggataatgaatttttcttcggcaattaccggaatattaaaatcagccaattttttcattagttcaaaatcaggctcatctgattgtacacttgtacttgtgtaacctgataatgttgtaccaacaaaatcaacgcctgatttaaatgcatagagaccttcatctaaattacttacatccgccatcagcaattgattcggatatttttcttttatttttttgataaattcactgacaactaagccatcatatcttggtcttaaagttgcatcaaatgcaatgactgttgttccgcattctacaagttcatctacttctttcatcgtagcagtaatatatggttcttgaggtggataatcccttttgataattccaattattggtaaatctactactttctgaattgctttaatatcacgcacagaatttgcgcgaatgcccactgctcctgcctctaaagctgctttagccataaaaggcatcaagctaaattcttcattataaagggcttcaccaggtaaagcttgacaagaaacaatgactccaccttgaacttggcttataaatttttctttagtccaaatttggctcattttattattcctccttatggataatagtttgattgtaataatattgtctctctggactttccagataattagagaataagcagtctgtaattaaaagtattggaaactgaggtgatatgcgattgccatacgagagatgatcggtcgaagctaataacaatagttcatcaaagaaacaatcttcttcgtcaaattttcttgtagtcattaaaactgttttagcgcctttatctgcagctttttgtagaccttctagtacaatatcagtttgacctgaaatggatgctccaatgacaaggcaattttcattaagtagtaagctactccacaaaatcatatcctcgtctgataatacttcaccaatcactccgagacgcataaatctcatcttcatttcttgtaaagcaagaacagaacttcctttaccgtagagatatacacgctcagcagtttctatcatctcagcaatacgctcaagttgaacttcatcaagaaccgtgtaagtttttctcaacatttcctcatagtcggataaaactttttctgttgcctctgtatataatgccaacttttctttctcatgaatcatctcttggtatttgaaaatgaattgtctaaaacctttaaaaccacattttttcgcaaatcgagtcaatgttgctttggatacattaaggtattcgcacaatgctttagatgaataatcattcagaggttgctgttttaagaagaatttagcaatgtctttttcagcatatgccatatttggtaagttagcttctatcattggaattagttctttttgcagtaacatatgagctccttagttgaagtaaacgtttacattctttattttaacactttttttttttttcaatatttttcataaattagaaactagtttccaatttctttcgtttcataacagaacaacaaacataaaaatataatagtttttattctttttatcgtaattatatgtattgtaagaacgtttatcactaataatatgttcatattaaaatattttagtaatattttattttggttttattatttcttttcggaatttctatataatattttatttctaaaaaaattgaaaaaatatttctagtttctttattttatataggtaatatattttatttctaaattaaaagagaatcccataaaaactacagatttatgagataaatcaggtcacctattttaaaaaagcagcaaactataaactaaaaagttccacaccaaatgtaaccccatacttccccataagtcagatttatagcgcaccatacctaaaaacattccaagtgaaacgtacagacaccaagctagaatggttcctggatgatgtactaaggcaaataaaacacttgtcaaagcaactcgaatatctaattttctaaccaagttccataaaatttcacgatacagaaattcttcaaccatactcgcattgattaagaacaataaaaatgaaaaccaaggaacttgatgttgaaggccaattaaatttgtttgattcgtgcttccttgagcatgaatcaggctaaaacatagacttataatcagtagactagctagtccaataccaaggcatttcatcctagttttcatattgaccttgaccacttgttttcgttgaccatacatccataaaaaagaaaaaagagacgcaccatagagaacctgtagtatagttaactcaccgatacaaagaaatttcaataagtatagagataccaataggacatttacttgttggaatatataaactggaattattcttttcatagttacctccgaaataaatcttcataatctaaatctaatatctgcacaatcctttctacccatggactttgaggcattcgttgttccatcttgtagtggcgaatcttttgatataaacgattcaattcacttggatagtgaaactctcccgcaaacatttttctggttaactcaatccagctgatatttctttcagccaaaataatggacaagttctcccaaaatcgttcagccatattrcttctcctttagttagataaataatgtgtttgygccatgtaaatcaattgtttcgtatctcttggcaatagagctctagcctcttccaaattcagacttggataaacccgcttatttgaaaccacaaaaggaagtccgatggttagttcaggattttttaaaattatctcaacgaaatccgttaatcttagattgtcacggttcttaaatcgtaataaattgggagataaaaactcaaaacaatctgaagaatagctcatcatctcaattaatttgtcctttgtcatttcagaaactgaatgacaagatacctcaatgccatagttttggaagaagtctaaaagaagttgatttctttggctatttttacttagatagagatcaatcatgggagacctccaacaaatttgcttccatttgatattctgagacgattaaggaatctaacaactttgagaagttaatcgatttcttgtcttcatcataagcttttacagttacttgggttgtaagtatcccctcttttccctcggctcgatagtcttgtcaatataaaacaaaaacaagattctgattatcatctacaaaggcattaactccgttctttatatcctgactttcaaggaattccataacgttttgaagataggattcataaaatagtgggtaattatgttttttatggtaatcatctaaaaatgttacctcaaactcacatggataattgggcatcaaaaatatttgttcatccagctgtttgatttctgcatcatgtaattctgtttctaattcatcacaatctagtattgattctttatttaatgcttttatctttttcctctatttcttttaatttctttgcgattgcggcaatcacaggaacggttacactattaccaacttgtttatagagctgactattaatagagacttttctagcagcttcaaaagcctaatcaggaaagccatgcaatcgaaaacactctttaggagtgattcgtcgtattctcaaacggtaaaattgtccatctattaaaacaccagctacttggtaaacttgtttatcttctccttcatagctagccactactactcccatttgaccactagttgttaacgtattagctataccttttccaactctaccacgacgatactgagaacttggtctttctaaattgattgaatccccaatctctgcttgagcatatccttttttcgttgcttcccgtacttttagaaattggattggttctggaattagtattttggggattttatctcctccttgcatcgtagtcagtgttggagataagccctcacttccatagacacgacctgtctccttaaagctagtcggtaaatctccaacaacgacaatgccataacgatcctgagtatttaaagtaaacatcggctcttgattttccttaaagcgtctcccattttgtctcttgtctaatctatctggtgtcatacaaggaatcgcaactttaaatccttctcctttaccacgaactaaggttggcgcaagaccttctgaataatagactttaccgctcattccacttcttgatggattcaaatttcctagtgctttcaaagtctcagagttagttgcttgaccttctcgtctgaaaggaaataagagtctggtacctttctttctagaatgtccgataataaacaccctctctctgtttttgggaacgccaaaatccttactgttaagcacctgccactcaacatcaaaccccaactcatcaagtgtggtaagtattgtggtgaacgtccgtcccttatcgtgattgagtaggcctttaacattttcaagaaaaagaaaacgtggttggatttgtttggccgcccgagcaatttcaaagaacaaagttcctctagtatcttcaaatcccaatcgtcttcctgcgattgaaaatgcttgacaagggaatcccccacagatgacatcgactttccctctaagttttttaaattcgtcatctgaaacatctcgtatgtcatgaaattctatttctccttccgtttgaaaaatggacttataagatttcctagcaaatttatcaatctcacaaaatcccaagcactcatgcccttgagcttccattcccatcctaaagcctcctatcccagcaaataaatctaaaacccaaatcattcatacctctctcaactagatgtaacttacaaaacccctgacctcatgagccactttcttcctcctcatgaggtcagttttactttctgctgttccagtatcgtttttcctcgctagatttcctcaaaagggcagactcctcccttggttcgtcacacgattttttcatctcgactgttctttaatgcatcattaacgacgcttttcttctaggtggttcataaggaacaggaagattcaggttgacttttctaatcctagaataaagtgctgaaaacaattcggaataggcatagagactagacaatttgaggagctgcttgcgtcctgttcgaacacattttcctaccacgtgaagaaaaagatggcggaagcgtttgattgttaaagtttggaagtcacctccagctagatgtttgagaaaaagatagagattgtaggcgatacagctcatcatcatacgaactcgtttttgattaaggttgaactatccgttttatcgccaaaaaatccctccttcatctccttgatgaaattctcggcttgaccacgtccacgataaagctgaaactggtcttggcttgttccggtaccga

SEQ ID NO: 11 - DNA, 8148 bp; double-stranded, linear
ccgtggaacaagccaagaccagtttcagctttatcgtggacgtggtcaagccgagaatttcatcaaggagatgaaggagggattttttggcgataaaacggatagttcaaccttaatcaaaaacgaagttcgtatgatgatgagctgtatcgcctacaatctctatctttttctcaaacatctagctggaggtgacttccaaactttaacaatcaaacgcttccgccatctttttcttcacgtggtaggaaaatgtgttcgaacaggacgcaagcagctcctcaaattgtctagtctctatgcctattccgaattgttttcagcactttattctaggattagaaaagtcaacctgaatcttcctgttccttatgaaccacctagaagaaaagcgtcgttaatgatgcattaaagaacagtcgagatgaaaaaatcgtgtgacgaaccaagggaggagtctgcccttttgaggaaatctagcgaggaaaaacgatactggaacagcagaaagtaaaactgacctcatgaggaggaagaaagtggctcatgaggtcaggggttttgtaagttacatctagttgagagaggtatgaatgatttgggtaaatacaatgagcttgaaagaagtagcaaactcaccaagcgccaattctttgagaatcagatgctggattataccatcattgcgcatgagagttttgaaatcatccgtcattctgtctaccagacagatgatcgtgaagtggaaaatgctctggcttttgaagtgaaaaatgatgaaacagacaagctgattctgttattaagcgaggatattggtgtaggtgaaaaattgtgcctcgttgacggaacaaaaatgcgtggaaaatgtttagtatatgataaaataaatgagagaatgattcgcttgcagtgctagaaataggcattttgaatagtgaatatgttataataagtattagtaggaggtgttttagattggagaagaaactgaccataaaagacattgcggaaatggctcagacctcgaaaacaaccgtgtcattttacctaaacgggaaatatgaaaaaatgtcccaagagacacgtgaaaagattgaaaaagttattcatgaaacaaattacaaaccgagcattgttgcgcgtagcttaaactccaaacgaacaaaattaatcggtgttttgattggtgatattaccaacagtttctcaaaccaaattgttaagggaattgaggatatcgccagccagaatggctaccaggtaatgataggaaatagtaattacagccaagagagtgaggaccggtatattgaaagcatgcttctcttgggagtagacggctttattattcagccgacctctaatttccgaaaatattctcgtatcatcgatgagaaaaagaagaaaatggtcttttttgatagtcagctctatgaacaccggactagctgggttaaaaccaataactatgatgccgtttatgacatgacccagtcctgtatcgaaaaaggttatgaacattttctcttgattacagcggatacgagtcgtttgagtactcggattgagcgggcaagtggttttgtggatgctttaacagatgctaatatgcgtcacgccagtctaaccattgaagataagcatacgaatttggaacaaattaaggaatttttacaaaaagaaatcgatcccgatgaaaaaactctggtatttatccctaactgttgggccctacctctagtctttaccgttatcaaagagttgaattataacttgccacaagttgggttgattggttttgacaatacggagtggacttgcttttcttctccaagtgtttcgacgctggttcagccctcctttgaggaaggacaacaggctacaaagattttgattgaccagattgaaggtcgcaatcaagaagaaaggcaacaagtcttggattgtagtgtgaattggaaagagtcgactttctaaaatgaaggaaaatgacttgcaatctctgttaagaaataaaataatcccacctagaacaagctaggtgggattatttgcctatgaaatgagaaattatgggagcaagctcctaaatcaactgtttttgatctacttctttaactacttgataaaagttatagaagtaggccaaacttgaaatgatggttacgactaggaatattgaaaatttccattggacagggttggttaaaagttgtggaaaggatatgaggagaaagaagagggctgcgttgaggacaggtatccgttttgattgtattttctcaagtcctttattgagcgcaggaagaaagaggagtaggagtagtaaaactgtatgagaaatagctcctgaagtaagggcgaagaaaaggaaaatactgataaaaacatgaatgatcagtagtctagctagtgatttcataaggcacctcctaatcctggtcttttttagctcttgcaatacgaagtgagtcgacaatatgtatcatcactccgaaaaagaaagctcccagtatagttttaaaaatatgttttgtatttagaagagaactgataaaatttggattttcacttgttagggtatcaatgagtggaattataaaaaatatcactgttccataaatcgaacctgctttcagaccaggataacgtaactgtttcttttcttttttcatgagtttcctcctaatcctcatcttgatttttcttagtttttgcaatgcgacgggagatgaggaactgtatgctcgctccgaagaaaatagaaccgagaatacttgatacaccatttcttatagtgagaagagaatgaaaatagtcctgaccttcatctatgagtatcctgagaagaggagttataaaaaacatccatagaccaaagaacaaacctgctttcagacctgggtagtgtagttgcttgctttctttctcattcagcatatctggttcaatgactgtgatgcctgtttttttcatttggtaggtgacatagccagaagcgatgagggcaatcactaaaatcagaggaggatagattagagccacttcttgagggtatttataggccagaaggagtggaataagatttccgaaaatcatcagataaaagaggatgataaagacttggttcccaatactatcggcctcacgccgtttgtattcgtcaaggggaccagaaataccgtatgtgcgtttgatcagtttttcagtgaaggtttcttttttcatgagtttgctccttttttaaaaatcttcctcccaaaagagactgttgaggtcagtttggaggctgcgggcgagattgagacagagttccaaggttggattgtacttgtcgttttcaatcatattgatagtctgtctcgagacaccgatatccttggcgagttcgagctgggaaatacccaattccttgcgaaattctttcacacgattcatctgttctcctttctgatttatgtcgtatatatttgactatattatagtcttttaaacataaagtgtcaagtatttttgacatattttttgaagaaatagtagtctccttgtcctatttgtctgacaagtgcaagctggtcggatttgtggtaaaatagataagatatgacaaaagaatttcatcatgtaacggtcttactccacgaaacgattgatatgcttgacgtaaagcctgatggtatctacgttgatgcgactttgggcggagcaggacatagcgagtatttattaagtaaattaagtgaaaaaggccatctctatgcctttgaccaggatcagaatgccattgacaatgcgcaaaaacgcttggcaccttacattgagaagggaatggtgacctttatcaaggacaacttccgtcatttacaggcatgtttgcgcgaagctggtgttcaggaaattgatggaatttgttatgacttgggagtgtctagtcctcaattagaccagcgtgagcgtggtttttcttataaaaaggatgcgccactggacatgcggatgaatcaggatgctagcctgacagcctatgaagtggtgaacaattatgactatcatgacttggttcgtattttcttcaagtatggagaggacaaattctctaaacagattgcgcgtaagattgagcaagcgcgtgaagtgaagccgattgagacaacgactgagttagcagagattatcaagttggtcaaacctgccaaggaactcaagaagaaggggcatcctgctaagcagattttccaggctattcgaattgaagtcaatgatgaactgggagcggcagatgagtccatccagcaggctatggatatgttggctctggatggtagaatttcagtgattacctttcattccttagaagaccgcttgaccaagcaattgttcaaggaagcttcaacagttgaagttccaaaaggcttgcctttcatcccagatgatctcaagcccaagatggaattggtgtcccgtaagccaatcttgccaagtgcggaagagttagaagccaataaccgctcgcactcagccaagttgcgcgtggtcagaaaaattcacaagtaagagggaaaaagatggcagaaaaaatggaaaaaacaggtcaaatactacagatgcaacttaaacggttttcgcgtgtggaaaaagctttttacttttccattgctgtaaccactcttattgtagccattagtattatttttatgcagaccaagctcttgcaagtgcagaatgatttgacaaaaatcaatgcgcagatagaggaaaagaagaccgaattggacgatgccaagcaagaggtcaatgaactattacgtgcagaacgtttgaaagaaattgccaattcacacgatttgcaattaaacaatgaaaatattagaatagcggagtaagatatgaagtggacaaaaagagtaatccgttatgcgaccaaaaatcggaaatcgccggctgaaaacagacgcagagttggaaaaagtctgagtttattatctgtctttgtttttgccatttttttagtcaattttgcggtcattattgggacaggcactcgctttggaacagatttagcgaaggaagctaagaaggttcatcaaaccacccgtacagttcctgccaaacgtgggactatttatgaccgaaatggagtcccgattgctgaggatgcaacctcctataatgtctatgcggtcattgatgagaactataagtcagcaacgggtaagattctttacgtagaaaaaacacaatttaacaaggttgcagaggtctttcataagtatctggacatggaagaatcctatgtaagagagcaactctcgcaacctaatctcaagcaagtttcctttggagcaaagggaaatgggattacctatgccaatatgatgtctatcaaaaaagaattggaagctgcagaggtcaaggggattgattttacaaccagtcccaatcgtagttacccaaacggacaatttgcttctagttttatcggtctagctcagctccatgaaaatgaagatggaagcaagagcttgctgggaacctctggaatggagagttccttgaacagtattcttgcagggacagacggcattattacctatgaaaaggatcgtctgggtaatattgtacccggaacagaacaagtttcccaacgaacgatggacggtaaggatgtttatacaaccatttccagccccctccagtcctttatggaaacccagatggatgcttttcaagagaaggtaaaaggaaagtacatgacagcgactttggtcagtgctaaaacaggggaaattctggcaacaacgcaacgaccgacctttgatgcagatacaaaagaaggcattacagaggactttgtttggcgtgatatcctttaccaaagtaactatgagccaggttccactatgaaagtgatgatgttggctgctgctattgataataatacctttccaggaggagaagtctttaatagtagtgagttaaaaattgcagatgccacgattcgagattgggacgttaatgaaggattgactggtggcagaacgatgactttttctcaaggttttgcacactcaagtaacgttgggatgaccctccttgagcaaaagatgggagatgctacctggcttgattatcttaatcgttttaaatttggagttccgacccgtttcggtttgacggatgagtatgctggtcagcttcctgcggataatattgtcaacattgcgcaaagctcatttggacaagggatttcagtgacccagacgcaaatgattcgtgcctttacagctattgctaatgacggtgtcatgctggagcctaaatttattagtgccatttatgatccaaatgatcaaactgctcggaaatctcaaaaagaaattgtgggaaatcctgtttctaaagatgcagctagtctaactcggactaacatggttttggtagggacggatccggtttatggaaccatgtataaccacagcacaggcaagccaactgtaactgttcctgggcaaaatgtagccctcaagtctggtacggctcagattgctgacgagaaaaatggtggttatctagtcgggttaaccgactatattttctcggctgtatcgatgagtccggctgaaaatcctgattttatcttgtatgtgacggtccaacaacctgaacattattcaggtattcagttgggagaatttgccaatcctatcttggagcgggcttcagctatgaaagactctctcaatcttcaaacaacagctaaggctttagagcaagtaagtcaacaaagtccttatcctatgcctagtgtcaaggatatttcacctggtgatttagcagaagaattgcgtcgcaatcttgtacaacccatcgttgtgggaacaggaacgaagattaaaaacagttctgctgaagaagggaagaatcttgccccgaaccagcaagtccttatcttatctgataaagcagaggaggttccagatatgtatggttggacaaaggagactgctgagacccttgctaagtggctcaatatagaacttgaatttcaaggttcgggctctactgtgcagaagcaagatgttcgtgctaacacagctatcaaggacattaaaaaaattacattaactttaggagactaatatgtttatttccatcagtgctggaattgtgacatttttactaactttagtagaaattccggcctttatccaattttatagaaaggcgcaaattacaggccagcagatgcatgaggatgtcaaacagcatcaggcaaaagctgggactcctacaatgggaggtttggttttcttgattacttctgttttggttgctttctttttcgccctatttagtagccaattcagcaataatgtgggaatgattttgttcatcttggtcttgtatggcttggtcggatttttagatgactttctcaaggtctttcgtaaaatcaatgaggggcttaatcctaagcaaaaattagctcttcagcttctaggtggagttatcttctatcttttctatgagcgcggtggcgatatcctgtctgtctttggttatccagttcatttgggatttttctatattttcttcgctcttttctggctagtcggtttttcaaacgcagtaaacttgacagacggtgttgacggtttagctagtatttccgttgtgattagtttgtctgcctatggagttattgcctatgtgcaaggtcagatggatattcttctagtgattcttgccatgattggtggtttgctcggtttcttcatctttaaccataagcctgccaaggtctttatgggtgatgtgggaagtttggccctaggtgggatgctggcagctatctctatggctctccaccaagaatggactctcttgattatcggaattgtgtatgtttttgaaacaacttctgttatgatgcaagtcagttatttcaaactgacaggtggtaaacgtattttccgtatgacgcctgtacatcaccattttgagcttgggggattgtctggtaaaggaaatccttggagcgagtggaaggttgacttcttcttttggggagtgggacttctagcaagtctcctgaccctagcaattttatatttgatgtaagaatggcaccctgatgtttcaggg

SEQ ID NO: 12 - DNA, 9909 bp; double-stranded, linear
tactccacccttaatatccgttcctgtaaatactttaccgcttttaagttcatagaattgaacttttaaatgcttgtcttcaagcatcttttccatccaatttttaggagtttgaccagctttaaataaaaaccttgctggggtgattagtatagatttatctgcgattttataagcttcatcaataaaatagtgatatatcggctcatctctggcttctcctgtttcctgatacggaggatttcctatcacgacatcaaatttcatttcactttcctcgctagataggcgctcaaaacctatcattctattctttttccagtctttgatatgggttttagattcttctacttcttggacttctagctcatccgcaaacaaactcaattgttgagattgcttttgtttagctgaataaggactactttttttcaatccatccatctgaaagacattgtaagagataatagtcgcaatttctttcttttgctctaatgttggttgatttccagtcttagctagataatagtcctcaaaagttgccaaaagattctcacgcgccaaaaggagagaatctccttgatactcataaccatacgaagcatgataagcatcttttacaagtttataaaatgtgacttcatctgaaacctcacgactaatccgttgcagttttctatcaacaaaaccaactcgctcagataatggaatttcctcaccagttacggtatcatatctcgttaccatataaggtgcttcaccacaagttacctctaaccatcgtaagtccacatactcctcaagacttaacgagcctaatttcgattctacatatccattttgctttgcgaccaaccacgttggtgtaaacacttctgcccttatttttgtccgatctttttgttcatatttggatttttcagatctgggctgaatcaagttggcaaagtttccagtaaccttacttggattgatgcgatcacttggagcaaatccctttcctaacaattcataagaatgcgtangccaaacaattgatttctttgtcgttcgatcttttaaaagaatttttaataagtcagccgattctttagccaaactttcttcactaatatctattgtcatcagcaacctctcttatattgtaagccctattatatcatattttaaagaatgaaaatttacttgaaaaaagtaattcaataaatatctctccgatgaccaacttctagagtagcaacgactaattcatcatctacaatttgtacgataactcgataattaccaattctatagcgccattgaccaacgcgattaccaaccaaagcctttccgtgtcgtcttgggtcttccaaaacattggtttgtaaatagtttgtaattagcttctgcgtataacggtccaattttttcaattgcttgataaaacgtcttgttggaactaatttatacaaattattcatccttcaagcctaaatcatgcatcatttcttcccaagtaatgggttcaactcctttttccaagtcttctaaatactcttgataggctaaatctgccacacgagcatcgtattcatcttctagggcttcaagagttttggtgcgaataagttccgaaagggaaactccttcaaacttagccattgctttcataaatgttttatcagcttcagaaacttttaatgtaatagtagtcatcttttgtgctcccttttttaatggtaacaccattgtattactttttaggtgttcagtcaatataaaaagaacaccttctcagcgttctttctatatctctgtcaatggtgttgcggtatctggtgaggtatcataaaccttaaagtctactccgactcccagatcagcttgagccagctgattgaccatggtcatatgagccagttccttgatattgttttccttagataaatgcccaaggtaaatcttcttagtacgatttcctagcgtccgaatcatagcttcagcaccgtcctcgttagaaaggtgaccaaggtcagataggattcgttgtttgagtcgccaagcgtaagaacctgatcgcaaaatctctacatcatggttggcctcgataagataaccatccgcattttcgacaatgcccgccatacggtcactgacataacctgtatctgtcaagaggacaaaactcttatcatccttcataaagcgatagaactgcggtgcgactgcatcatggcttacaccaaaactctcgatgtcgatatctccaaaggttttggttttacccatttcaaaaatatgcttttgcgaagaatccaccttgccaagatatttactattttccatagcttgccaggtcttttcattggcataaagatccataccatacttgcgagccaaaacgcctactccatggatatgatctgaatgctcatgggtaatcaagatggcatccaggtcttctggcttacggttaatttcagctagcagactggtaattttcttgccagacaagcctgcatctactaaaagcttcttttttgaggtttccagataaaaagaatttccactggaacccgacgctaaaatactgtatttaaagcctatttcactcattctagtcttctacttcatcctcccatacttcttctttcactgcatccttatcataagggagtacaatggtaaaggttgaacccttgccgtattcactcttggcccaaataaagcccttatgttgtttgataatttctttagcgatagacagtcctagacctgtaccaccttgtgcacgacttctagcacgatccacacgatagaaacggtcaaagatacgtggtaaatcctgcttaggaatccccaaaccgtggtcagaaatggataaaatcatctggtcttcagttgtcttcattctgacagtgattttacccccatctggcgaatacttaatagcattatttaaaatattgtcgacaacctgcgtcatcttatctgtatcaatttccatccagatagaattgatgggataatctctcaccaactcatattttttctccttttcctgtcctttcatcttgtcaaaacgattgaggataaaggtaataaaagcagtgaagttaatcagttccacatctaggtgactggtagcattatcaatacgtgaaagatggaggagatccgtcaccatgcgcatcatacggttggtctcatcaagagaaaccttgataaagtctggtgctacagtttcacacaaagccccctcatccaaggcttcaagataggattttacgctagtcagaggagtccgtaactcatggctaacattggaaacaaagagtcttcgttcgcgttcttccttctcctgctccgtcgtatcatgcaaaacagccaccaaacctgaaataaagccagactctcgacgtatcaaggcaaagcgaactcgaaggttcaaatattcgccattgatatcttgggaatctagcaacaattctggactttgggtaatcaaatcacgcaattcatagttttcttctatcttgagcaattccaaaatgcttctattcagaacatcttccttaaccaaccccagttgcttcttggctgtatcgttaatcatgataatctgaccccgacggttagtcgcaagaaccccatctgtcatataaaacagaatactatttagcctcttactctcttgttctagattttcctgagtgagacgaataacctccgacaagtcattcaaattattggtaatattggtgatttcagacccaccttgcatatcaagaaccttggaataatctcctgcaatcaaatctttaaccttttgattgacttgcttcaactgaatattatcacgtctattttccagtaataagagggtcacaacaaggatgaaacctaacaaaatcaggataaagataaaatctctggtaaaaatggtttgtttcagtaaatcaagcattatttctcatgtaataccctacaccacggcgcgtcaagatatactctggtcggctgggcgtatcttcaatcttctcacgcagacgtcgtacagtcacatcaactgtacggacatcaccaaaatagtcataaccccagacagtctcaagcaagtgttcgcgcgtgatgacttgacctgtatgcgatgctaaatgatacaaaagctcaaattcacgatgggttaagtctagttcttcgccatattttttagccacgtaggcgtctggaacaatttctaaatccccaatttggataggttgaggtttactatctgcttcctgaccatctactggcataggttgagaacgacgcagaagagctttaacacgcgcctgcaactcacgattggagaagggttttgttacatagtcatctgccccaagttccaaaccgataaccttatcaaattcactatctttggctgaaagcataagaatgggcacactgcttgtcttacgaatggtcttagcaacttctaaaccatcaatttctggaagcatcaaatccagaataataatatctggttgctctgcttcaaattgctctagcgcttcacgaccattaaaagcagttacaacttcgtaaccttccttggtcatattaaacttgataatatccgagattggtttctcatcatctacaattagtatttttttcatatgttcacctttttctctactattataccaaaaaaatagtcagaagacacaatagctagtcttggctactgtctaagttggcttgtgcataaacctgccagattttttgttggggtttggcaagtgggtaattcttgaattcttctggtgaaagccagcgaacttccctatctgaaaaatcatggaagtcactcacctgacctgctacaatctgtacatgccattttcgatgactaaaaacatgctggactgtatcaaaacaaacatcaagccaatcaacatctaggtcatagtcctgctggaaactctcttctggactgggaccaaagttcacactttcttccgcaacctgatgaaagaggtcaaactgctcttcttgcgaaaagttatcaacttctataaaggggaaatgccaaaaacctgccaagagcttttcgctttcatttttttcaagtaaaaattgtccttgagaatttttcacaactaaggctttaagataaataggaaccggctttttcttaggagatttaattggataacggtccatggttccattctgatatgccgcactaaagtccttgactgggctttcttcaggtctgggatttacaggagactcaatatcagaccctaagtccatcaaggcttgattaaaatcacccggacgatccggattaatcaagatctccatcattgcctgaaaaatttttcgattacttggaatcccaatatcgtggttgacttcaaacagacgcgccaagacccgcatgacattaccatctacagctggctcaggcaagttaaaagcaatactggaaatggctcctgctgtgtaaggtccaatccctttcaagctggaaattccttcataggtatttggaaattggccaccaaagtcagtcataatctgctgggctgcagcctgcatattgcgaactcgagaataatagcccaagccctcccaagctttcagtaaactctcctcaggcgcagttgccagactttcgacagttggaaaccagtccaaaaatctttcgtagtaagggataactgtatccaccctggtctgctgaagcatgatttcagatacccagatgtgataaggatttttacttctcctccaaggcaaatctcttttgttttcatcataccaagcgagaagtttctcacggaaagaaatgactttctcctccggccacatgacgataccgtattctttcaaatctaacatatctctagtataacacagaaggtttcacctgtctttgtatctgatttataatattttcaatagatagtatataacttttctatctacttatactcaatgaaaatcaaagagcaaactaggaagctagccgcaggttgctcaaaacactgttttgaggttgtggatagaactgacagagtcagtatcatatactacggcaaggtgaagctgacgtagtttgaagagattttcgaagagtataaatcttattgatgaactgcttgcagtctgagaaaaaatgagcttggatattatttccaaactcacttaaagtcaatttcaatccactagaacaagcctagtacagttccatcgctttcaacatccatgttgagagctgctggacgttttggaagacctggcatggtcataacatcaccagttaaggcaacgatgaagcctgcacctaattttggtaccaattcacgaatggtaatttcaaagttttctggtgctccaagcgcatttggattgtctgagaaactgtattgagttttagccatacagattggcaatttgtcccaaccgttttgaacgatttgagcaatttgtgtttgagctttcttctcaaagttcactttgctaccacgatagatttcagtgacaattttttcaatcttttcttggacagaaaggtcattatcatacaaacgtttatagttagctggattttcagcaattgtcttaacaactgtttcggcaagtgctactccaccttctgctccatcagcccagacactagccaattcaactggtacatcgattgaggcacagagttcttttaaggctgcaatttcagcttctgtatcagatacaaattcgttaatagctacaactgctggaataccgaacttacggatattttcaacgtggcgtttcaagttagcaaaacctgcacgaactgcctctacattttcttcagtcagagcgtctttagccacaccaccattcatcttaagggcacgaagggttgcgacaataacaactgcatctggagatgttggcaagtttggtgtcttgatatcaaggaatttctcagcaccaaggtccgcaccaaaaccagcttcagtaacagtgtaatcagccaagtgaagggctgttgtcgtcgccaaaacagagttacagccatgagcgatattggcaaatggaccaccgtgtacaaaggcaggtgtaccgtaaattgtctgaaccaagtttggcttaatagcatccttcaaaatcaaagccaaggcaccctcaacctgcaaatcacctacagaaacaggcgtacggtcatagcgataaccaataacgatattcgccaaacgacgtttcaagtcctcgatgtccgttgccaagcaaagaattgccatgatttctgaagcaactgtaatatcaaaaccatcctcacgtggaataccgtttagaggaccaccaagaccaacagtcacatggcggagcgtacggtcgttcaagtccacaacgcgtttccagaggatacgacgttgatcaattcccagctcattcccttggtgcaagtggttgtcaatcaaggcagaaagggcattgttggcagttgtaatagcatgcatatctccagtaaagtggaggttgatgtcttccattggcagaacttgtgcatacccaccaccagcagcaccacccttgatccccatgactggaccaagagacggttcgcggatagcaatcatggttttcttgccaatcttgttcaaggcatccgcaagaccaatggtaagcgtcgactttccttcacctgcaggtgttgggttgatggcagtaaccaagatcaatttaccgactggattgctctcaactgcacgaattttatcaaagctgagtttagccttgtactttccgtacaactccaaatcgtcataagaaataccaagtttctctacaacatcaacaattggcttcaactcaatactctgtgcgatttcaatatctgttttcattcaaaattcctctaacctcttatatgataattcattatatcacaaaacaagatttttaacatcctaaaactctctaaacgttcgtaaatatctctgtttttaagacttttagagtcctttcttaaattttatatggctttatagtttgaaactataataaatcttcgtttttaccaaaaatttatcactttcattttacttaccgcttatttttgtgtacaatagtgctatgaaaattttagttacatcgggcggtaccagtgaagctatcgatagcgtccgctctatcactaaccattctacaggtcacttggggaaaattatcacagagactttgctttctgcagggtatgaagtttgtttaattacgacaaaacgagctctgaagccagagcctcatcctaacctaagtattcgagaaattaccaataccaaggaccttctaatagaaatgcaagaacgtgttcaggattatcaggtcttgatccactcaatggctgtttctgactacactcctgtttatatgacagggcttgaggaagttcaggctagctccaatctaaaagaatttttaagcaagcaaaatcatcaggccaagatttcttcaactgatgaggttcaggttttgttccttaaaaagacacccaaaatcatatccctagtcaaggaatggaatcctactattcatctgattggtttcaaactgctggttgatgttaccgaagatcatctggttgacattgcacgaaaaagtcttatcaagaatcaagcagatttaatcatcgcgaatgacctgactcaaatttcagcagatcagcaccgagctatatttgttgagaaaaatcagcttcaaacagtccagactaaagaagaaattgcagaactcctccttgaaaaaattcaagcctatcattcttagaaaggaaaactatggcaaacattctcttggctgtaacgggttcaatcgcctcttataagtcggcagatttagtcagttctctaaaaaaacaaggccatcaagtcactgtcttaatgactcaggctgctacagagtttatccaacctttgacactacaggtactctcacagaatcctgtccacttggatgtcatgaaggaaccctatcctgatcaggtcaatcatatcgaacttggaaaaaaagcagatttatttatcgtggtacctgcaactgctaacactattgcaaaactagctcacggatttgcggacaacatggtaaccagtacagctctagccctaccaagtcatattcccaaactaatagctcctgctatgaatacaaaaatgtatgaccatccagtaactcagaataatctgaaaacattagaaactacggctatcagctgattgctcctaaggaatccctactagcttgtggagaccacggacgaggagctttagctgacctcacaattattttagaaagaataaaggaaactatcgatgaaaaaacgctctaatattgcacccattgctatcttttttgctaccatgctcgtgatacactttctgagctcacttatctttaacctttttccatttccaatcaaaccgaccattgttcatattcctgtcattattgccagcattatttatggtccacgagttggggttacacttggatttttgatgggattacttagcttgacggttaacacgattacgattctaccgacaagctacctcttctctcccttcgtaccaaacggaaacatctactcagctatcattgccatcgtcccacgtattttgattggtttaactccttacttagtctataaactgatgaaaaacaagactggtctgattttagctggagcccttggttccttgacaaatactatctttgtccttggaggaatcttcttcctatttggaaatgtttataatggaaatatccaacttcttctggcaaccgttatctcaacaaattcaattgctgaattggtcatttctgcaattctaaccctagccattgttccacgactacaaaccttgaaaaaataaaaacagg

SEQ ID NO: 13 - DNA, 1126 bp; double-stranded, linear
taattttcatataatagtaaaatagaatgtgtgattcaataatcacctcaaatagaaaggaaattctatgtcaaatctatctgttaatgcaattcgttttctaggtattgacgccattaataaagccaactcaggtcatccaggtgtggttatgggagcggctccgatggcttacagcctctttacaaaacaacttcatatcaatccagctcaaccaaactggattaaccgcgaccgctttattctttcagcaggtcatggttcaatgctcctttatgctcttcttcacctttctggttttgaagatgtcagcatggatgagattaagagtttccgtcaatggggttcaaaaacaccaggtcacccagaatttggtcatacggcagggattgatgctacgacaggtcctctagggcaagggatttcaactgctactggttttgcccaagcagaacgtttcttggcagccaaatataaccgtgaaggttacaatatctttgaccactatacttacgttatctgtggagacggagacttgatggaaggtgtctcaagcgaggcagcttcatacgcaggcttgcaaaaacttgataagttggttgttctttatgattcaaatgatatcaacttggatggtgagacaaaggattcctttacagaaagtgttcgtgaccgttacaatgcctacggttggcatactgccttggttgaaaatggaacagacttggaagccatccatgctgctatcgaaacagcaaaagcttcaggcaagccatctttgattgaagtgaagacggttattggatacggttctccaaacaaacaaggaactaatgctgtacacggcgcccctcttggagcagatgaaactgcatcaactcgtcaagccctcggttgggactacgaaccatttgaaattccagaacaagtatatgctgatttcaaagaacatgttgcagaccgtggcgcatcagcttatcaagcttggactaaattagttgcagattataaagaagctcatccagaactggctgcagaagtagaagccatcatcgacggacgtgatccagtcgaagtgactccagcagacttcccagctttagaaaatggtttttctcaagcaact

SEQ ID NO: 14 - DNA, 2520 bp; double-stranded, linear
ccggcaacaaaaaagaaaaaatcaacagttaaaaaaaatctagtcatcgtggagtcgcctgctaagccaagacgattgaaaaatatctaggcagaaactacaaggttttagccagtgtcgggcatatccgtgatttgaagaaatccagtatgtccgtcgatattgaaaataattatgaaccgcaatatattaatatccgaggaaaaggccctcttatcaatgacttgaaaaaagaagctaaaaaagctaataaagtttttctcgcgagtgacccggaccgtgaaggagaagcgatttcttggcatttggcccatattctcaacttggatgaaaatgatgccaaccgtgtggtcttcaatgaaatcaccaaggatgcagtcaaaaatgcttttaaagaacctcgtaagatcgatatggacttggtcgatgcccaacaagctcgtcggatcttggatcgcttggtagggtattcgatttcgcctattttgtggaagaaggtcaagaagggcttgtcagcaggtcgcgttcagtccattgcccttaaactcatcattgaccgtgaaaatgaaatcaatgccttccagccagaagaatactggacagttgatgctgtctttaaaaagggaaccaaacaatttcatgcttccttctatggagtagatggtaaaaagatgaaactgaccagcaataacgaagtcaaggaagtcttgtctcgtctgacgagtaaagacttttcagtagatcaggtggataagaaagagcgcaagcgcaatgctcctttaccctataccacttcatctatgcagatggatgctgccaataaaatcaatttccgtactcgaaaaaccatgatggttgcccaacagctctatgaaggaattaatatcggttctggtgttcaaggtttgattacctatatgcgtaccgattcgactcgtatcagtcctgtagcgcaaaatgaggcggcaagcttcattacggatcgttttggtagcaagtattctaagcacggtagcaaggtcaaaaacgcatcaggtgctcaggatgcccatgaggctattcgtccgtcaagtgtctttaatacaccagaaagcatcgctaagtatctggacaaggatcagcttaagctatatacccttatctggaatcgttttgtggctagccagatgacagcggccgtttttgataccatggctgttaaattgtctcaaaaaggggttcaatttgctgccaatggtagtcaggttaagtttgatggttatcttgccatttataatgattctgacaagaataagatgttaccggacatggttgttggagatgtggtcaaacaggtcaatagcaaaccagagcaacatttcacccaaccgcctgcccgttattctgaagcaacactgattaaaaccttagaggaaaatggggttggacgtccatcaacctacgcgccaaccattgaaaccattcagaaacgttattatgttcgcctggcagccaaacgttttgaaccgacagagttgggagaaattgtcaataagctcatcgttgaatatttcccagatatcgtaaacgtgaccttcacagctgaaatggaaggtaaactggatgatgtcgaagttggaaaagagcagtggcgacgggtcattgatgccttttacaaaccattctctaaagaagttgccaaggctgaagaagaaatggaaaaaatccagattaaggatgaaccagctggatttgactgtgaagtgtgtggcagtccaatggtcattaaacttggtcgttttggtaaattctacgcttgtagcaatttcccagattgccgtcatacccaagcaatcgtgaaagagattggtgttgagtgtccaagctgtcatcagggacaaattattgagcgaaaaaccaagcgtaatcgcctattctatggttgcaatcgctatccagaatgtgaatttacctcttgggacaagcctgttggtcgtgactgtccaaaatgtggcaacttcctcatggagaaaaaagtccgtggtggtggcaagcaggttgtttgtagcaaaggcgactacgaggaagaaaagatggctctttgtcaactgtagtgggttgaagtcagctaagctcgagaaaggacaaattttgtcctttcttttttgatattcagagcgataaaaatccgttttttgaagttttcaaagttccgaaaaccaaaggcattgcgcttgataagtttgatgagattattggtcgcttccaatttggcgttagaatagtgtagttgaagggcgttgacgattttctctttgtcctttagaaaggttttaaagacagtctgaaaaagaggatgaacctgctttagattgtcctcaatgagtccgaaaaatttctccggttccttattctgaaagtgaaacagcaagagttgatagagctgatagtgatgtttcaagtcttgtgaatagctcaaaagcttgtttaaaatctctttattggttaaatgcatacgaaaagtagggcgataaaaatgtt

SEQ ID NO: 15 - DNA, 10993 bp; double-stranded, linear
ttttctcgataataacttccaccttattatttgggataccctcctcttcttcaccaccacgttcatagtagtcatcgcgatagagaaaagctacgatatcagcgtcctgctcaatagacccagattcacgaatatcagacaagaccggtctcttgtcctgacgttgttctacaccacgagaaagctgactcagagcgattactggaaccttcaattccttggctagtattttcaactgacgagaaatttcagaaacttcttgttgacgattttctcgaccagttcccgtgataagttgcaaatagtctatcaaaatcaaaccaagatttccagtttcttgagccaatttacgagaacgagaacgaatctctgtaatccgaatacctggcgtatcatcgatatagatactggcgttagctagattaccctgagcaatagtatatttttgccactcctcatctgtcaattgccctgtacggatagaatgtgactccactaagccttctgcagctaacatacgatctaccaagctttccgcacccatttcgagtgaaaaaatagcaaccgttttgtccaacttagtcccaatgttctgagcgatattcaaggcaaatgctgtcttaccaactgctggacgagctgctaagataatcaactcctcctcatgaagtcctgttgtcatatgatccaaatcacgataacctgtcgcaatacctgtaatatcggtcgtttgttgcgagcgagcttccagatttccaaagttgagattcaacacatctcgaatgttcttaaacccgcttcgatttgcattttcactgacatcaatcaaccctttttctgcctgagcaataatttcatcagctggttgtgacgcttcgtaagcttggttgacagactctgtcaacttggcaattaaacgacgtagcattgctttttctgcaacaatcttagcataatactccgcattagcagaagttggcacagaattaacaatctcaaccaagtaagacaagccaccaatattctgtaaatcaccttgattatcaaggatagtacgaaccgttgttgcatctatggcatcaccacgatcggataaatcgaccatggcttggaaaatcaaacgatgggcatacttaaaaaagtcccgagactcaatgtattctcgcacaaaaacaagtttactctcatcaataaagatagcccctaaaacggattgctcagctaagatatcttgaggttgtactcgtaactcttctacttctgccatcagacttcccttccttttacaatcttgtcaagaaggtgtaaacttatccttctttcacacgaagattgattacacttgtgatatcttgatagattttcactggcacatcaatcaaaccaaccgctcgaatcggagcttgtacttgaatatgacgtttatcaatcttaattccaaattgcttttgcaattcttctgcaatcttcttattggtaatagaaccaaaggtacgaccatctggaccaactttttcaacaaattctacaacagtttcttctgcttcaagttgtgctttaattgcttttccttctgcaatcatctcagcgtgagctttttcttccgatttttgtttaccacgaagttcacctacagcttgagcagtcgcttctttggctagattctttttgataagaaagttttgcgcataccctgttggtacttccttaatttcgccttttttaccttttcctttaacatctgctaaaaagattactttcattcttctttctccttttccttcatttcatttaatacaatttctgtcagtttttcacctgcttctgacaaggttacatctttaatttgagctgctgccaaattaaagtggcctccaccgcctaactcttccataatccgttgtacattcagtttactacgacttcgagctgagatagagataaatccttgtgtattcttcgcaagaacaaaactcgcttcaatacctgacatggctaacatggcatctgctgccttactaataacaactgtatcatagcatttcatgtccttagcctctgctattagtacatctgaacctaatttacgcccctgtaaaataagttcattgacctcacgatattcttcaaaatctgtcgcagcgatttcctggatagcaatactatcacttccgcgcgttctgagatagctagcaacatcaaatgtccgactagttactcgcgaggtgaaatttttagtatccaacatcataccagccatcaagacacttgcttgcatacgactcaaacgatttttcttagaattctggaactgaatcaattccgttaccaactcactggcactacttgcaccactttcgatataagtaataaccgcattatctggaaaatcctgatcccttctatggtggtcaataacaatggtttgggtaaataaatcataaaattcttttgataatgttaaggctgtctttgaatggtctacaagaatcaacaaagaacgattggtcaccatccccattgcatccttaacagacaacaacttcgtaactccttctttttctatgaatgaaacagctcgttcaatatctggagacatttgttcttcatcataaagagcatagctattttcaatcacattgctggcgaacaactgcatacctacagcagagcccaaagcatccatgtctaaatttttgtgaccgactacaaaaacctgatctacactccgaatcttatctgaaatagctgtcatcatagcgcgcgtacgagtccgtgtacgcttgattgaagcagcagacccaccaccaaaataaactggatttttcgtttcgtcgttttccttaacaaccacctggtcgccaccacgtacttcagccaagttcaaattgagcaaagcaactttccctatctcatcatgatttccatcgccataagaaaatcccatacttaaggtcaagggcaactgtctctgtttcgactcttctctgaaagcatcaataacagaaaatttatcattcatcaagccctcaagcaccgtgtagtcagtaaatagataaaatcgatccatacttacccgacgagaaaacatcatgtgtttttctgaaaactctgatataaaattagctacaaaactattgatttgactaatatctgactcagaagtttcatcctccaaatcatcataattatccacagagacaatcccaatcactggtctacttgttaccaattcatctgttatggcttgttccctggatacatctacaaaatacaaaacaccggaagaagcatccatatgaacagcataacgcttctcaccaagcttggcataagtagacggatttcctactgaagccttgataatcgtttgaacagcttctaaatcaaaatcaccatcttccttggtcaaaatcaattcagcatagggattaaaccactcaacctctccagaagataaattcaatttcataacacctacaggcatctgttccaatagagctgtcaaactttcttccgcttggtggtttacatactgtatctgttctacatcactccttgtataatgcactctcagtttcttaaataaaaaaacatagcctcctacaaaaagaaacaaaattaaaaccgtcaacagattattattaacaaaaataatgaaagtggataagactccaaacgcaatcaatcctactagaataggaaaaattggacttacataaaattttttcattcaaaacctcttggcacccattataccataatacccctcaaaaagcgactttttaaaagtgtaatcagtaattctatcaattataagaaaaaggtagtttacaattcagtaaacctacctttacacatattgaaattaagattctttaacctctaacaaaccaatttcgccatcctcacgacgataaatcacattggttgtctgatcttcaacatccacatagataaagaaatcatgccccaataaatccatttgtagaattgcttcttccaaatccattggttttaaatcaatttgttttgaacgaacaactttagactggacaatatttgaatcttccaccaaagcatctgtaaataattgaccagttgctaccttatttttatttttacgctcgatttttgttttatttttacgaatctgacgttcaattttatcagttacaaggtcaattgaaccatacatatcttgagatacatcttctgcgcggagagtaatagatccaagcggaatcgttacttccactttagccgttttttcacgataaacttttaagttaattcgggcatccaactcttgttctggttggaagtacttttcgatcttttcgagtttagaaactacataatcacgaattgcttctgttacttctaggttttcaccacggatactatatttaatcatatgagtaccttctttctaaacatttttgtttttatgattttattataacgctttcattctatttttgcaaattttttcctcatcttacaagggaaaatgtttttacatccttagcaccagcttcttccaacagtttcttaacacgatttatagttgctcctgtagtatagatatcatctataagtaggatttttttaggaatagtgactccacttttaataaagaaaggaagttctgtccccaagcgctctgaacgatttttagaagaactggctctctcttctcttttctctaataaatccagatactcaaagcctgctgcctctaccaagccctcaacctgattaaatcctctattagcatatctatcaggacttaggggaattacaacaaattgatactctttgtactttttcaactcctcacttaaaaatgaagcgaaaacttttcttaacaggaagtctccatcaaacttataccgactgaaaaaatccttcatagcttgattgtaagtaaaaatcgctctatgactgacttcaactccctctttacaccaaagttgacaatcttgacactttgttgacaactctgttttcatacaatttggacagttctcttccccaattctttcaaaagtagaatcacagtctgaacaaagacaagagtcatcattcctcagaagtaagagactactaaaagttaaaacagtcttcatagtctgcccacataacaagcacttcatagaccagcctccttattcatcatctgaatttccttaatcgccttcttgattgaagcatttaacccatcatggaagaaaagcaaatctcctgtcggtctatccatgcttcgtccaactcgtccaccaatctgaatcaaactagacttggtaaacaaacgatgattggcctctactacgaaaacatccacacaagggaaggtaactccgcgctccaagattgtcgtactgataagtattgtcagttctccatctcgaaaagcttgtacttgctctaatcgatcctctgttacagaagatacaaagccaattttctcatttggaaattgctcctgtaagatttctgctaactgctcccctttcttaatttctgaagcaaaaatgagtaacggataagctgtctttctctgcttctcaatataggactttaactttggtgacaaacgattcttgtctaagtagcgattaaaatccgataaccaaattggttttggaataatcaacggatttccatgaaaccgtctcggtaaattcagtctttttagttctcctaaacggacctttttatctaactcattggtcgaagtcgctgttaaaaagattctcaatccattctcctttacactattcttgacagcgtggtaaagcatgggattatcaacataaggaaaagcatctacttcatccactatcagcaaatcaaaagcttgataaaacttcaataactgatgggttgttgcaacaactagtggtgttcgaaaataaggttccgattctccatgtagcaaagctatcccgcaagaaaaatcctgttgcaggcgcttgtacagctccaaacaaacatctatgcgaggactagccaaacacactgcaccacccgcattgatcactttagccactacttgataaatcatttctgtctttccagctcctgttaccgcatgaactaaggttggcttttgcttgtctactacttgaagcaatccctctgacaccttctcttgaaaaggagttaattggccgcgccatttgagaacatcttgctttggaaaatcctcctgcggaaaatagtataaagtttgatcacttctgactcgcttcatcagcaagcactctcgacaatagtaagcaccgatgggcaaataccattcttctagaatagtactattacagcgttgacagaaaagtttccccttctcctttctcattgctggaagtttctccgccaactgacgttcttcttctgttaattcattctcagtaaataaacgaccgagataatctaaatttactttcatacttctttattcgtaaaaactagcactttagatgattttttagtacaattaaatcatggaatttaggacaattaaagaggacggtcaagtccaagaagaaatcaaaaaatctcgctttatctgccatgccaagcgtgtttatagcgaagaagaggctcgtgacttcattactgccatcaaaaaagaacactacaaagcgacacataactgctctgccttcattattggagaacgtagtgaaattaaacgtacaagtgatgatggtgagcctagtggtactgctggtgttcccatgcttggggtactagaaaatcacaatctcaccaatgtctgtgtggtcgtgacacgctactttggtggtattaaactaggcgctggaggactaattcgtgcttacgccggcagtgtcgccttagctgtcaaagaaattggtattattgaaataaaagaacaggctggcattgctattcaaatgtcttatgctcagtaccaagagtacagtaacttccttaaagaacatggtctcatggagctggatacaaactttacagatcaagtcgatacgatgatttatgttgataaagaagaaaaagaaactattaaagctgcacttgtggagttttttaatggaaaagtcactttaactgaccaaggtttacgagaggttgaagttcctgtaaacttagtgtaaacaatgaataatacagcgtttcgttgacattctcacaactactttagcgagcaaaataaaaagaggcgtaccaaaatatactagaaaatgaagcaattcaaacgaaacctgatatcgttttccttcacacctatttactagaattagctgaacgcaatcacttgaaaattaatgactttgatctatgatatatagaaatggtatggatagcgttatactaaagatatcttatacaaagaggtattcatatgtctatttataacaacattactgaattaatcggtcaaacaccgattgttaaacttaacaacatcgtgccagaaggtgctgcagacgtctatataaagcttgaagcatttaatcctggttcatctgtaaaagaccgtattgcccttagcatgattgaaaaagctgaacaagatggtattctgaaacctggttctactattgttgaagcaacaagtggaaacaccggtattggactttcatgggtaggtgctgctaaagggtataaagtcgtcatcgttatgcctgaaactatgagtgtagaacgacgtaaaattatccaagcttatggtgctgaactcgtcctaactcctggtagcgagggaatgaaaggtgctattgctaaggctcaagaaatcgctgctgaacgtgatggtttccttcctcttcaatttgacaatccagctaatccagaagtacacgaaagaacaacaggagctgagatactagctgctttcggtaaagatggattagatgcctttgttgctggagtaggtactggtggaacgatttctggtgtttctcatgcactcaaatcagaaaattctaacattcaagtttttgcagtagaagcagatgaatctgctattctatctggtgaaaaacctggtcctcacaaaattcaaggtatctcagctggatttattcctgatacacttgatactaaagcctatgatggtatcgttcgtgtaacatcagatgacgctcttgcactcggacgtgaaattggtggaaaagaaggcttccttgtagggatttcctcagctgcagctatctacggagccatcgaggttgccaaaaaattaggtacaggtaaaaaagtccttgccctagcaccagataacggtgaacgttatctctctacagcactttatgaattgtaaccgtccaataacgaagtctattgaaaaatctccagactagagaactcacggatagttcctaatctggagatttcttatttgcacttttcttgtacaactttagtccatggtaaataggcctctaaaacctctttgtttacgagagtttccacgtttggaagacattctagaagataggatagatatttctcactatttataatggattgaaataagatatgaacaaatcgattagaacatgatggtaaagcgtaatcccttgtttctcagctttcccagacaaaaaagtccaatagtaagtcagctgactatcactctctagcaccctataagaagtttcatccgcatgaagtaagggctgagtcaatagtctctctcgcaagaggttataaaggggctccaaatagtattgactcgtcttgatatgccaattagagatttccttacgtgtgattggtaaacccatcctagcccaatcttcttcttggcgataattgggtaccttcagattaaacttctgatggatggtgtgagcgataatagaagctgagccaaagttatgcgctaaaggggctttaggaataggagctttcacaagcttatccagatgattatcttttactcgttatggacaatgctatatggcataaatcaagtaccttaaagattccgactaatattggctttgcatttattcctccatacacaccagagatgaaccccattgaacaagtgtggaaagagattcgtaaacgtggatttaagaataaagcctttcgaactttggaagatgtcatacaaggactggagaaggaggtgataaagtccatcgttaatcggagacggactagaatgctttttgaaaacagatgagtataaaaagaaagtcctcatttcaatagaaatcacgactttctgatgaatttatagtaaaatgaaataagaacaggatagtcaaatcgatttctaacaatgttttagaagcagaggtgtactattctagtttaaatccactatatttggggagtgatagaaaagcccttcatcagccaatctacttgttcaggtgcgagagctttgacatccttttctgtactggaccaagtcagttttccgttctcaaagcgtttatataatatccaaaatccttgaccatcccagtaaagaactttaaagcggtctttacgtccaccacaaaagagaaagacttgatcggagaaaggatccaattcaaagtgggttttaactacataggctaatgagtctattccctgcctcatatctgtcttgccacaaacaaggtgaacttgacctaaatcacttagttgaattatcatagtacaatacctttcctccgataattattttttatctggtatactggaagttggggaattaggatagataccttgttatgacgcgcttactatgaatttgaagtatagtctcctaaatgcacttagcccttattatagggctttttgttttaattattctaatcgagtgagactggggaaaaaacaatttcaggaaaaatctaagccctatacaaaaaaggaagcaatttgcttcctttctattattagttattcaaggctgctgccattgtagctgcaacttcagcttcgaagtcgtttgcagctttctcgataccttcaccaacttcaaagcgagcaaactcaactaccgaagcgttaactgattcaaggtatgcttcaactgtcttgctgtcatccatgatgtaaacttgtgcaagaagtgtgtaagcttggtcaactttagtgttatcaagcatgaagcgatccattttacctggaataattttgtcccagattttttctggtttgccttctgcagccaattcagctttgatgtcagcttcagcttgagcaataacatcatcagttaattgagcttttgatccatacttcaagtgtggaagagctggtttattaaccattgcacggctttcgttgtcttggtcgataacgtgattcaattgtgccaactcatctttaacgaattgctcatccaattctttgtaagaaagaactgttggtttcatcgctgcgatgtgcattgacaattgtttagcaagtgcttcgtctccaccttcaacaactgaaataacaccgatacgtccaccgttatgttggtatgctccaaagtgttgtgcgtctgttttttcaatcaatgcaaagcgacggaatgagattttctctccgatagttgctgttgcagatacgtatgcagcttcaagagtttcacctgaaggcattatcaaagcaagagcttcttcgttgttagcaggttttccttcagcaatgactttagctgtagtatttaccaattcaacgaattgagcgttttttgcaacgaagtcagtttcagcgtttacttcaataactgctgcaacattaccgttaacataaacaccagtcaaaccttctgcagcaacacggtcagctttcttagctgccttagccatacctttttcacgaagcaattcaatcgctttttcgatgtcaccgtctgtttctacaagcgcttttttagcgtccataacaccggcaccagatttttcacgcaactcttttacaagtttagctgtaatttctgccattttaattctcctatattttttgaaaataggagagcgcggctaagccccgcctccgg

SEQ ID NO: 16 - DNA, 8411 bp; double-stranded, linear
cgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataaacgctgaaagcatctaagtgtgaaacccacctcaagatgagatttcccatgattatatatcagtaagagccctgagagatgatcaggtagataggttagaagtggaagtgtggcgacacatgtagcggactaatactaatagctcgaggacttatccaaagtaactgagaatatgaaagcgaacggttttcttaaattgaatagatattcaattttgagtaggtattactcagagttaagtgacgatagcctaggagatacacctgtacccatgccgaacacagaagttaagccctagaacgccggaagtagttgggggttgccccctgtgagatagggaagtcgcttagctttaatccgccatagctcagttggtagtagcgcatgactgttaatcatgatgtcgtaggttcgagtcctactggcggagtaattgataaaagggaacacagctgtgttcctctttttgtatcaatttgtatcaccaagcattttcataaggaagtctgttatttcttgagaactttctttttttccatgtgcaatccaagtttggcagacaccaaaaagtgcatgagttagatagatgctactatattctaattcagtggtatttagattcagttgcataaatcgcttttgtaaatctgtactaagcatgatatgaagtttatttcgtaagaaattttggatttctttagtcccattttcagaaagaagggcagccagaagtggttctgactctagatattcaaaaacttctaaaatagcgtctcttttgtgatgagcatgtttttgaaaaatatattcaaatgtatggaatagcttgctttgatagtgctcaatcatatcatacttatccttatagtgagtatagaagctggaacgactaattccggctttttctactaatttgacagtagaaattttatcaaatggctgttccatcagtaattgtaccatagcattttcaatagttcgctttgtttttaagcgtttgttactttcttgcatatttcctccttgtaaacaaattagactatatgtctaaaaatagattttttatcttgtaatttagattttttaatgtataatctattatatcaaaattttagacaatatgtttaaaaaaggagaaactaagtttaaagaatggaaagcaatttaaaaaaaaccaacctttattattgtcatgatcgggatttctcttattccagatctgtacaatatcatatttttgtcatcaatgtgggatccatatgggcaattgtctgacttacctgtggcagttgtaaataatgataaagaggcttcctataatggtaatactatggcaataggaaaagacatggtgtccaatttaaaagaaaataaaaccttggattttcattttgtagatgaagaggaaggaaagaagggattggaagatggcgattactatatggtagtgactttaccaagtgatttatctgaaaaaacaactacattatccaatattcaatcgacagcagcttatcaatcattgacaagtgagcaacaaactgagataagtgattctgtatctcaaaattcaactgatagtattcaatcggctcagtcaattgtagctttagtacaagatttacagggaagtttagaaaacttacaaaatcaatcttctaatctttcgactttaaaaaatcaatctaatcaagtatcacctattacttctacttctttgataggattgtcaagtggattaacagagatacaaggagatgttactagcaaattagttcctgccagtcagtcgattgcatcaggtgtaaacgcatatactacaggtgttgataaagtttctcagggcgcaagtcaactaagtgaaaaaaatgccaccttgacaggtagtttggataaactagtttcaggctcaaacaccttgacacaaaaatcttctagattgacagcaggagttggttaattacaatcaggatctgggcaattagcagacaaatccagtcagttactttcaggtgcttctccattagagaatagagctaataaattggcagatggatctgggaaactagcagaaggtggaacaaagttaacttctggattggaagatttacagacaggacttgcttctttaggacaaggactaggtaatgctagtgatcaactcaaatcagtatcaacagaatctaaaaatgcagagattttgtcaaatccactcaatctttcaaaaacagacaatgatcaagttcctgtaaatggaatcgcaatagctccttatatgatatcagttgctctttttttgcagcaatatcaacaaatatgatatttgcgaaattgccttcaggacgtcatccagagagccgttgggcttggttgaaatcttgagctgaaataaatggtattatagctgttttggcaggaattttggtatatggaggagttcagcttattggtttaactgctaatcatgagatgagaatatttattctcatcatcctaacaagtttagtattcatgtctatggtgaccactttagcaacgtggaatagccgtataggagcttttttctcacttattttgcttttactacagttagcatcaagtgcaggtacttatccacttgctttgacaaatgatttctttagatctattaatccctggttaccaatgagctattcagtttcgggattacgacaaacaatctctatcaacaagtcattttcctagctgtcatactagttctatttactagtttaggtatgctagcctatcaacataagaaaatggaagaagattaaaaaaatcgaccgattaactggtcgattttttatgccttagatgactttcgtctgtgattatagattccaaatagtaagagagaagtaaaggaacagattgctccagtaataaaaccattgggaatgaaggaaagtgtaatagttcctttccccttgggaatgtcaactttcataaatccagtttgagcttgtttaatttctattttcttaccatcttggtaggcagaccaacctttgtcataaggaatggtgaagaaaatagatgtatcttgttggacatcatatgtagcaaaaaccttgtttttagaagttgatactgtgacaggttgttctttaattttttgaattgcctcggtgaaagttttggtatctaaacgatagaaggtaggagattcaaatgatacttgtgaatttccagggaaactaacattgatattgaaagtttttttctctttagtatatcctagattaaagaaggagaagacattatcagttgtaaaagtctttttttcaccatttacaaggatgtcaaccttcttttgtttatcgttagaaaagtgaaggtttatgaaagagagataaacttggctgttttctggaacttcaatttgatactggattgctgcatcttcatttgaagaacttgtgacactaatcaaatcattagtattttctattttttctgttttttcataaggtattggagaaaaataatcaaaattgacgttagcaagttgatttaaaaatgaggcctgattatccaaggtatgttcattgaacttgacatcattgtaaacagattgactcgcaactgcaatcggaagagagtattgattttcatatagggtaagattatctttttgatagatatctttaaagccatacttatcaataggactgtctgagatattgtactggataccaaataaactatcagccaaaatactattatttgcatatcggagattgagattagtcccagaggatttaaaaccaagtttatctaaagtagagcttgatgaacgatttcgaacagatgaaaattgagagattccattgtagttgaatttcatactgtcatttcctgtctgagtttgtagtttttcagtacgagtaaattgatttccaatatatgttgagaaagattccatagctgggatatctcgactataagcacttcgagaagcaaatccccattccttagcaattccgtccatttgagatgaagcatttaaactcatttcaaccagtataaataaagagattagaatggcaaatagattcacagatataaactttttgataactgcaaggagtaaaagagaatagacaaccaaaaattcaagagtaagcagaatattcaaatctgttaaaaaagaataatgcgattttagatagatggtagctaaaaatcctgctactacaagaaaaagcgaaactaaaaaattccagactttaagttctttcagacgctttaagacttctgctgctgtgtaaattaacaaggtagagaaaatccaagcatagcgatgtaaaaacatgtttggagtatgcatgccttgccaaaataagtcaagagcttctatgtaaaagcttgcaattagaaatgcaaagaatattacatatatgagtttcacgtgaaacttaatagatttcagcgtaaaaaataaaatggtcaaaataaagggaaatagtccaacaaaaatcattgggatggccccatactttgttgtgtcaaaggaaccaatgaattgcttagcaaagagatcaagataccagctactttcagtttgaaactttgtaacttcagtcaatttttccccatgtgtctgtaaatcaaatagagtgggaagagtcataatcaaactagccataccagctaaaaaggagataactatgaaatcaagaacagatgattttcgagtcttaaagtcccacgaaatttgacagagataccagaaaataagaaacaatactgtcatatatccaaaataataattttgaataaataagattgacagacttgtaaagtacaataggagtttcttttcagttatcagtagatgtaaaccagttataattaaaggaatcaagataaaaacatctagccaggtttttatctctaattgactgacagtgaaactcatcagagcataggaagtagataaggctagttttaaaatctgagggatagattgaaacaatttattcaaactaaaaaaggttgacagaccaatcaatccaaattttaagagagttgtcagatagatagcatctggcatattcgttagatcaaaaaagtaaaccagaggcgcgagaaaactacccaagtaataactagatagggcatagaagtttagccctagaccacttgtaaaggtgtaaaacagattactatttccatgtaggatatttcgtaaggctacatcaaaaataacgtattgatgaaagccatctcctaatagaggagagttgtcgctattccagtagatactttgagatagatatactccagacataatcactacaggaatgatgaaagaaataaaataggttcgatatgtttttaaaaatgatttcatgttacctcgtagaatgatagaaaactcagttggttaacccaactgagttttgaagttttatttagtctttccaaagttctttaacttttgcttgtacttctgcattttctaggaattcatcgtaggtttcatcgatacggtcaatgacgccatttttagataagacaatgatatggttagccaaagtttgaataaattcgtggtcatggctggcaaagatgattgattctttaaagtttttcaatccatcattcaagcttgagatagattccaagtccaagtgatttgttggatcatcaagtacaaggacatttgattttaagagcatgagttttgaaagcatgacacgaactttttctccccctgacaagacatttacaggtttgttaacttcatctccagagaagagcatacggccgaggaagccacgtaggaaagtattgtcatcttcttctttacttgcgaattgacgcaaccagtcaagaattgattctcctcctgcaaaatcagctgagttatcttttggtaggtaagattgactagttgtaactccccacttgacagttccttcatagtcaatatctcccatgattgcacgaattaatgcagtcgtttgaatatcattttgtccaataagtgctgtcttatcatctggacgcaagatgaaactaatattatccaagatagtttcaccatcaatctttacagttaaattttctactgtcaagagatcattaccaatctcacgttccgctttaaagttgataaatggatatttacgactagatggcacaatctcttctagctcaatcttatcaagcattctcttacgtgatgttgcctgccttgacttagaagcattggcagagaaacgagcaacaaattcttgcaattgtttaattttttcttctgctttagcattacggtctgctagcaatttagcagcaagctcagaagattccttccagaagtcgtagtttccgacatagagtttgatttttccaaagtcaaggtcggccatgtgagtacaaactttgtttaagaagtgacggtcgtgggatactacgataactgtgttatcaaagtcaatcaagaagtcttctaaccaagtaatcgattggatatccaaaccgttagtaggctcgtccaagagaagaacatctggtttaccaaaaagtgctttggcgaggagaacctttactttttcaccgttggccaattcgctcatgttttggtagtgtaattcttctggaatgtttaggttttgaagtagttgagaggcttcactctctgcttcccaacctccaagttcggcaaactctccttcgagttcggcagcacgaaccccgtcctcgtctgagaaatcttccttcatgtagatagcatctttctctttcatgatgctataaagtttttcatttcccatgataacgacatcaatggcacgttcatcttcgtagtcaaagtgattttgacgaagaacagagagacgttcatctggaccaagagagatgtgaccagtagtaggttcgatatctccagctaaaatttttaaaaaggttgattttccggcaccattagcaccgattaatccgtaagtatttccttctgtaaatttgatattgacatcatcaaaaagtttgcgatcactaaaacgtagtgaaacatcagatactgtaagcaatgtttttctcctatatgtgtaatatatttattctactagaaaatacagaaatattcaaatttttatttgtcaattttgtgtaaattatatttacagtatcctttacacaaatctgtaaaaagcaaggctgatttattttgataaattacggttatttcattaaaaaaatgctataattgaaaggactatatcgaaggagaacaaaatgactaaacccattattttaacaggagaccgtccaacaggaaaattgcatattggacattatgttggaagtctcaaaaatcgagtattattacaggaagaggataagtatgatatgtttgtgttcttggctgaccaacaagccttgacagatcatgccaaagatcctcaaaccattgtagagtctatcggaaatgtggctttggattatcttgcagttggattggatccaaataagtcaactatttttattcaaagccagattccagagttggctgagttgtctatgtattatatgaatctagtttcgttagcacgtttggagcgaaatccaacagtcaagacagagatttctcagaaaggatttggagaaagcattccgacaggattcttggtctatccaatcgctcaagcagctgatatcacagctttcaaggctaattatgttcctgttgggacagatcagaaaccaatgattgagcaaactcgtgaaattgttcgttcttttaacaatgcatataactgtgatgtcttggtagagccggaaggtatttatccagaaaatgagagagcagggcgtttgcctggtttagatggaaatgctaaaatgtctaaatcactaaataatggtatttatttagctgatgatgcggatactttgcgtaaaaaagtaatgagtatgtatacagatccagatcatatccgcgttgaggatccaggtaagattgagggaaatatggttttccattatctagatgtttttggtcgtccagaagatgctcaagaaattgctgatatgaaagaacgttatcaacgaggtggtcttggtgatgtgaagaccaagcgttatctacttgaaatattagaacgtgaactgggtccgg

SEQ ID NO: 17 - DNA, 9064 bp; double-stranded, linear
tgccgtactcaagtacagcctgcgctaagtttcctagtttgctctttgattttcattgagtattagtaaccaaaatccgaccacatagccagcccctatgaatatagccattaaagctagcatggaatttaggaaattaaaaaccaccgcagatacaaaggttagcacaaaaacattaaaagcaatggtgtcagaagccaagactagaatatagggtgtcaaccgatctaaagttttggaatctaggaaaaataagtgtttatacatgatgacctcctctatggctgaaaagcaagccttttgtttttttaccccaagaccctatgtagaaaagtgagcaaaaacgggaaggtcgctacaatattattgatcacatgcaccgcataggatggataaatgctcttggtatagcgggtcaaaccagcaaagatgattccaactgttgcaaagacgaagatatctaacagactaggcaggcttgaaaaatgagggagagcaaataaaatagaaggaagaagcaaatcaagaccaaatcgcgaatgcttaaagaaagcatgttgcagtaatcctctataaatcaattcttccatcagtggaaccagaaagaacagggctatataaatacctagctctgcaaagttagtcccactataaccaatcaatacagcccaaccttccgcagttgactgaacatgtttagctgtctgaacgttaaaagagatctggaacactagcactaatactgtcaaaatcgaataccaaagccatttttttcttggaatgcggaagagataaccatggcctgtcttaacaagaaccacaatcatgactccaataaaaagtaaactcaagatattttgaatccagaataaattgcctatctgagaagaaaattgccaatagttttggacgataagcgtcagctgagaaagactaaatacgaaaaataagtaagagaagactgcacttattttgaatagaagttgatactttttcatagaaatcctccctactatgacctcaccttgtcaggctctactgctgtaagattaagaagacagtttgttttttttaaggctaacctgactactagataatagatacattaaggcattaaagacaatgaaaatatgtccatagaataaaatcaacctcgcatccaaaccaagataaagtttgattatcaaaaagatgagcaaaagaatttgaaaccataaggtttttccaaaaataaatttaaagcgatttcgaatatctacttccttgatttttaccgccacccctttattagcaagaaggaaaactcctgcttcaaacaaaccactgtaaagaacaagccacccaatagatacgatagagatttgtaaaaatgtccctaaaagaatatccaacacactactcaagaaaataacaaaaaataatctgtatttcatattaaatacctccattcatttatttcactaacaatttaatagagccttctactcaaatatcctgtcagaaaaggatagaaagctactttttataatacttcaagccccacatgagcagaagcgtgataaacaagcagagaatacacctatataagcgattagttgttgatagaattctgtttctgaaatacctctatacaaacaaatgacaaacataaaatctgccaagccgataaacataagttgattggttctaggactaaccaaatcatcatttacttatatttaagagtatctcttttattttaatgtatgttagcactgaaaagcaagacaggccaataatatttaaaatgaacagtaacggggttaagtctctaaaaaaattatctactgacactacaagaaatactatacatattatagtcgaaactatctttttcttatccataattatttactcctttcctaacaaatccagcttatcaatcaagagcgatttttaacataatgtagcagcacccgttgcaactttgacaagtttagtatatcattgttttttaaaatttttcatccaaatcttgaattgtcatcgaaacatcttgaattgttaaaaaatttaaaaagtaagcattaaaaacatactttcctctttatattgtattgataccaacttgtttgtagacttttcatcctgctatcacatatcattttgacaggcgaaacaatattaaagaaactcccctgtaaattaagctagcaaatacaggggagaaatttattttttagagagtactatccgtatcctttttggaagattttgaaaatatttttctaattaagtcatccatataaggaccaaatataccaactactaaaccaataataaaacttttaaaatccataattaccaccaacatattgctgcataggctacacctccaagtatagctccacctgcagcaccagttacacctattcctatagcaaatggtcccaatagaaatgtcaaaccgttgttgcacacccatcaattgcgccatatgcaacccctgctgcacaactaatttttcttccccaatcaatatctccaccttcaacgcaagcaagcatttcattatccataactgcaaattgtgacatcatttttgtatccatatagtgtatcacttttcagttacggaacaagtttaatataaaaattatcaaaaaaacataggcaataaagagaaaaattaatttatcatagattagaaataatatgacaaaacaattcaatgatgttaattcaatagtcttttgttttttatcggagatacttatggatagataaataagataggtttgaaaagcgaagagaataataaagaatatagccttcataaaatttagctttcatttttatgatgtagcggtataggctaaatatccacaaaccactgctcctccaattcctcctattgcagcgccccatggtcctagaagtctcccatatttcactccacccgctgcacaacctaaagcagcaactacagctgctcctccggaattacctccataaacctcactcagcattgtttcatttatattacaataagtattcatacaagtctccttttattaaaatccacccgttgcccctgttactcctgcccaaagatccacaccaaatttagctcctatgtatccacatgctcccataaatggtgctccaacaccactcgcagcacaaatagctgtccctagcccccagccaccaaaagcagcaccaccaccttctaagacattagtttgccaattattcttgcctccttcaatactagataacatagttatatccatttcatgaaattgttccataatttttgtatccatgacaaatactcttttttatttttaatttttgtcttgttgtaactttgacaagtttagtatatcatcgttttttaaaatttttcatccagattttgaatagtcatcgaaacgtcttgaattgcaaaaattacattagacttcctgcaaaactagaatcctagttcatgattgataataccagcactcaaattcattcgtaatccgaagcgtttacgatgacttcgataggttgttgaaaacattttaaacgtttttactttggcaaagatgttctcaaccttgcttctctccttagatagcgcatggttacaggctttatcttcaactgttagcggtttgagtttgctggatttacgtgaagtttgtgcttgaggatatatcttcatgagcccttgataaccactgtcagccaagattttaccagcttgtccgatatttctgcgactcattttgaacaacttcatatcatgacaatagttcacagtgatatccaaagaaacaattctcccttgacttgtgacaatcgcttgagtcttcatagcgtgaaatttctttttaccagaatcattcgctaattctttttttagggcgattgatttttacttccgtcgcatcaatcattaccgtgtcctcagaactgagaggagttcttgaaatcgtaacaccactttgaacaagagttacttcaacccattggctccgacggagtaagttgctttcgtgaacaccaaaatcagccgcaatttcttcataagtgcggtattctcgcacatattgaagagtggccataagaaggtcttctaggcttaatttaggttttcgtccaccttttgcgtgtttaagttgataagctgtttttaatacagctagcatctcttcaaaagtcgtgcgctgaacaccaacaagacgcttaaatcgtgcatcagttagttgtttacttgcttcataattcatagaactatagtaaaatgaaataagaacaggataaatcgatcaggacagtcaaatcgatttctaacaatgttttagaagtagaggcgtactattctagtttcaatctactatactataccatattttgtttcgcagggaatctattataaaagggtaagtattgcaaaaacacttacccttttcttttatacttcattaagctctactttttataatacttcaagccccacatgagcagaagcatgatgattaagcagagaacagcgccaatataagcgattatttgttggtaggattctcctgctgtgatacctctatacaaacaaataatagacataaaacctgtcaagccgatgaacataagttgattggttctaggactaaccaaatcatcatcttcaaactctcttatcctcatttccctagtgagataaacagtaaccaaaatagaagccaagttaataactactaaaagaaattggaaaactacggaaaaatttaaaaactgacgagatagaaatagataagtagaaacaagcaagggcaactgacctaagaacaatctcgcaaggaagatgttccgttttttagcaagaaaagttttcatttcttttctcctttctttttattgatagcaaaatagatcataactgcaatcacataggctatggtataaaatagctgataccaagcactctccctaagcggatatagaaagatggacatgattagatacagaacgaaaataatcagtatttttttcttcataagatttcctcctaaatgtgcgatttatcttagttgagcaagaacatttacactgctagtatagcacttattttgaccttggatcactcaaatcataaatggtcatcaaaacctcttgaattgtaaaaattaaaaaagcaagcatgaaaaacatactttcctctttatattgtattgataccaacttgtttgtagacttttcatcctgctatcacatatcattttgacaggcgaaacaatattaaagaaactcccctgtaaattaagctagcaaatacaggggagaaatttattttttagagagtactatccgtatcctttttggaagattttgaaaatatttttctaattaagtcatccatataaggaccaaatataccaactactaaaccaataataaaacttttaaaatccataattaccaccaacatgttgctgcataggctacacctccaagtatagctccacccgcagcaccagttgctgcaccttgccatgttcctgttttaatgcctagttgaagacctcttgctgctcctcctccaacacctgctttggcaaaatctccccaattgcatccgccaccttcaacgcaagcaagcatttcagtatccataacagaaaattgtgacatcatttttgtatccatgacaaatactccttttttaaaaaactaaaataaatcagaatagaatcctcataattttactataagtcttaccaacttagtcccaatttatcaccaaccatacctcctaagcatgttaatccacccccaattgcaccaatgtgtgctccaacaaatgcaccagcaagtccagctactcctaaagtggccaaacctgctccagttccaccagttataattcccgtagtgactcctgtaatcagtgcattttgacaatcagtggagctataccccccttcaactttcgcaagcatttcagtatccataacctctaactgtgacaacatttttgtattcatgatgaatacctcctttttattttcaatttgttaccaaagtcttaaattcaataaacaaatagattttttatagtatctttttgattttcttaaaaaagtatatacgtctactatcttcttaaaggtagcagtacctattttttagtctaagatttcaataatcttgagtatctaaaatatcttaatttcgttattctccttgcaataaaaagttttactatactatttattaacttgcagaaagcaaaaaatattagtaaataatagtttatagttaagttttttattcctaccaatccatcaactaagtaaagcatcaacgattacataaacgattgataatataattaaaattttgctaactatcttattctcatcattcttagataactttgatattttgtaagtaagtaaataagacagtaaattaatagcgataataatactatatttaagaatcataatcttacaaagaggacataattcctgaacctacacaaataagtgttgctgctcccccagttatcggaccagtcgcagcagctaatagtactgctccaatacaaccaccgattgcagatcctaaattgcctcttcctccactaactatttcgagttcttcattatccataacagaaaattgttccatcatttttgtattcatgacaaatactccttttttctttttttatttttgtcttgttgtaactttgataagtttagtatatcatcgttttttaaaatttttcatccagatcttgaattgtcatcgaaacgtcttgaattagcttttttatttcaagccacctctaaatgtttaaaaaaaataatttctaatcacttttttaccattcaggaagttttaatgactattcaagatttcataaaatatgaacttagttttatgacataatagacctatccactatatgaaaggaattgccaatgacttcttataaacgtacatttgttcctcaaatagatgcgagagactgtggtgtcgctgccttagcctcgattgctaaattctatggttcagatttttctctagctcacttgagagaacttgcaaagaccaataaagaagggacgactgctcttggcattgtaaaagccgctgatgaaatgggctttgaaacaagacctgttcaagcagataaaacgctctttgacatgagtgatgtcccctatccatttatcgttcacgttaacaaagaaggaaaactccaacattactatgttgtctatcaaacaaagaaagactatctgattattggtgatcctgacccttctgtaaaaatcactaaaatgtcaaaagaacgctttttctatgaatggactggagtagctatttttctagctaccaaacccagctatcaaccccataaagataaaaagaatggtctactaagcaagcttccttcctctgattttcaaacaaaaatctctcattgcttacattgttctctcaagcttattggtcactattatcaatataggtggttcttactatctccaaggaatcttggatgaatacattccaaatcagatgaaatcaactttaggaatcatctcagttggtctggttatcacctatatcctccaacaagtcatgagcttctccagagattatctcctaaccgttctgagtcagagattaagtattgatgtgattttatcctatattcgccatatttttgaacttcccatgtctttctttgcgacacgtcgtacaggagaaatcatttcacgattcacagatgctaactctattatagatgccttggcttctaccattctttctctttttctggatgtttctattctgattcttgtaggaggcgtcttactggcacaaaaccctaatctcttccttctttctcttatttccattcctatatacatgttcatcatcttttcttttatgaaacctttcgaaaaaatgaaccatgatgtcatgcaaagtaattctatggttagctctgccattatcgaagatatcaacgggattgaaactataaagtcgctcacgagtgaagaaaatcgctatcaaaatatagacagcgaatttgtagattatttggaaaaatcctttaagctcagtaaatattctattttacaaacgagtttaaagcagggaacaaaattagttctgaatatccttatcctatggtttggcgctcaattagtcatgtcaagtaaaatttctatcggtcagctgattacctttaacacacttttttcttactttacaactcctatggaaaatattatcaacctccaaaccaaactccaatctgcgaaggtcgctaataaccgtttgaacgaagtctatctagtcgaatctgaatttcaagttcaagaaaaccctgttcattcacattttttgatgggcgatattgaatttgatgacctttcttataagtatggttttggatgagataccttaacagatattaatctcacgattaaacaaggagataaggttagcctagttggagttagtggttctggtaaaacaactttagccaaaatgattgtcaatttctttgaaccctacaaagggcatatttccatcaatcatcaggatattaaaaacattgataaaaaagtcttgcgccgtcatattaattacctaccccaacaagcctatatctttaatggctctattttggaaaacttaaccttgggcggtaatcatatgattagtcaagaagatattctaaaagcttgtgaagtagctgaaatccgtcaagacattgaaagaatgcctatgggctatcaaactcagctctctgatggagctggtctatcaggaggacagaagcaacgaatcgctctcgctcgtgctcttttaactaaatctcctgttttaatactagatgaagctactagcggtcttgatgtcttgactgagaaaaaggttatagataatcttatgtctctaactgataaaaccattctctttgtagcccatcgtctcagtatagccgaacgaaccaaccgtgtcattgttcttgaccaggggaaaatcattgaagttggta

SEQ ID NO: 18 - DNA, 7780 bp; double-stranded, linear
ctccatttttttgatttcataaataaacaacctctctgttaattttgtataattataacgatatccaagttacttgtcaagtgttttttaaatttttatctcaaaaatattttttcgttcaaaaaaaggagccatcagttgatttcaagctcccttttatacagaattaaactattttatagttcgacaatcttacctgtttcaaagtagacaacccattcacagatatttttagcatagtcaccgatacgctccaagtaggaaataacttggaaataatcacgacccgtaacaatggcttctggatttttcttaatctcttcagtcgcaaggtcacggatagtttcaaaatagtggttaatttgctcatccatggaggccacccggtatgcgtcgtcaacagaaccattaagataaagatcaagtgctgcttccacaacgcttttaacttcacgtcccatttttttaatttcttcctctacagctggaatgcgctcttcccccttcatacggatggttgcctgggcaatggctacagcgtgatcccccatacgctccacatctgatacagccttaaggacagtcaagactgtacgcaaatcttgagagactggttgttggagtgcgatcatttcaaatgatttcttttccagtttcacttcgtattcatttacttctgcatcatcttcgatgacctcttttgccaggtcacggtcatgcgtgacaaaagcacgtaccgtacgattgatttgtgagagcacttcttgtcccatagcgtagaactggttatgtaatttctctaaatcttcttcaaattgagatcgtaacatctttcatctccttatccaaattttcctgtaatatagtcttccgtttccttgtgttggggatcaaggaacatctgcttggtatcattaaattcaatcaaatctccatctaggaaaaatcctgtcttatcagagatacgtgaagcttgctgcatggaacgggttaccagaagcatggtgtacttgtcttttagaccatacaaggtttcctcaattttaccagctgaaatcggatccaaagccgaagttggctcatccaagaggatgattttaggactagttgccaagacacgggccacgcagacacgctgctgttgaccacctgacaatccaatagctgaatcatatagacgatccttgacctcatcccagatagaggcaccttgcaaggctttttctacggcttcatccagaacctgcttatccttaattccattgatacgaagcccgtagacaacattctcatagatagtcatagggaaaggattaggttgttggaaaaccattccgatttccttacgtaattcaaccgtatctgtacgcggactgtagatgttgtgaccattgtacaccacggatccagttgtggtcacctctggattgagatctcccatgcggttgagagacttgaggagggttgacttccctgatccagatggaccaatcaaggctgtaatttccttaggttggaaagatagggaaacactattcaaagccttctttttattataataaacggacaggtctgatacctgtaaaatcgcatctgtcatacggtttcctttctaaccaaagtgaccagatacatagtcattggtggactgtagcttggcattttggaaaatagttgcagtcttgtcatactcaatcaaatcacccaagtaaaagaagcctgtatagtcacttgcacgagcagcctgctgcatattatgcgttacaatgatgatggtaaagtttttcttgagctcaaacatggtctcttctagttgcatggtcgcaatcggatccaaggctgaggctggctcatccattaagaggatatctggcttaacagagatggcacgagcgatacagagacgttgttgctgaccacctgataaggtcaaggctgacttgtggagatcgtctttaacctgatcccagagggcagcctgacgaagggaggtttctacgatttcatctaggacttgcttatccttaactccagcacgttcatgcgcaaaggtaatattacggtaaattgacttagcaaatggattgggacgttgaaaaaccattccaatgtgtttacgcatttcataaacgttgatttctggacggttgacatcaattccacgatagagaatctgcccagttactttagcaatatcaatagtatcattcatgcgattgagactgcgtaagtaggtagatttccccgatcccgacgggccaatcaaagctgtaattttatttctttcaaattgcatatcaatccccttaatggattcatttttaccatagtaaacatggacatccttagtagaaagggctactttttcttcaggaaaggtaaggatatgcttctcatcccagttatatgttgacatggcttctcctttaggcagcggttaatttcttgtgtagatagcttccgaacttacgagctccaaagttaaaaatcaggataaagatcaggagcacagcggcagaacctgctgatacaatggttccatctggaatagtgccttcactattgactttccagatatggacagccaaggtttctgcttgacggaagatagagatggggctagtcacactgaggatattccagttagaccagtcaagagctggcgccgattgccctgctgtatagatcagagctgcagcttcgccaaagatacgaccagatgccaagacgacacccgttacaatacctggaagcgcttccggaataacaacatgaaccactgtctcccagcgagaaatcccaagagccagaccagcctcacgttgggtatggtgaacgtgtttcaaactatcctctacattacgcgtcatctgaggcaagttaaagactgtcaaggccaaggcacctgaaatgattgaaaatccatactcaaactggactacaaagatcaagtaaccaaagagacccaccaccactgatggtaaagaggacaaaatttcaatacaagtccgcacaaagttggtaacaggaccttttttagcatattcagccaagtaaatcccagctcccatagaaagaggtacagaaataatcaaggtaatgaccaataggaaaaaggaattgtaaagctgaatgccaatcccaccacctgcttgaaaagcagaagaccttccagtcaagaaagaccaagagatatggggcaagccccgaaccaagatatagagaatcaaggaagccaagattgtcacaatgatgctagcaatcgtatagaggacagctgttgcaagtttatctaatttcttagcgcgcataatttttctttcctctttctttcgtaatcaatttaatcacactgttaaaaactaagctcatcaagagcagtaccaaggccagtgaccagagaacattattatttacagttcccatgacagtgttcccaattcccatagttaatatagaagttaaagttgcagctggtgtggtcaaggaagttgggataacagctgagtttccgacaaccatctggatagctagagcctcaccaaaggcacgcgccatcccaaagaccactgcagtgaaaataccagaacgggccgccttcaagatcacacgccagatagtctgccagcgagtggctcccatagcgaaactggcttcacgataataacgaggaaccgcacgcaagctatccgttgtcataaaggttacggtcggcaaaatcatgacaaagaggacggaaatccctgacaaaatcccaaaaccagtcccaccaaagacactgcgaacaaagggaacgacgacttgcaagccaataaatccgtacactactgaaggaatcccaaccaggagttcaatagctggttgcaaaatcttcgccccttttggtgatacttcggtcataaaaactgctgcaccaatagcaaagggtgttgcgataagggctgagagaatggtaacgataaaggaacccaaaatcataggaagggcaccaaattctttactagaaggattccaagttcctcccaaaagaaagtcaaagatattcacaccattgacaaagaaggtcgacaagcctttttgcgctacgaaaaccaaaatcatggccacaaggatgactatcaaagaaagacaggcaaaggtcaaaccttttcctaatttctccagacgagaattctttgatggaagcaacattttcttagctaattcttcttgattcattattgtctcccttccaacactgtcacagttccggcagcatctttttcaaccttcatttccttaatcggaatatacttcaatcctttgacaatcccttcttgggtctcatccgagagaacaaaattgagaaattctgcagccaactcattgggctgccccaatgtatacatatgctcataagaccacaagggccaattattgctacttatattttctggacttaagtcatagccattcaacttcatgcttttgaccgaatcatctatataggtaagagataaataagagatagctcctggactttttgatacgattgattttaccgctccatttgaatcctgctcctgactttgcatggcagactgaccttccataatgacagtatcaaaggtagcacgagagccagagccggctgcccgattgataacagagatgggtaagtccttaccaccaacctctttccaattggttacctcacctatgaagatttgacgaagttgctctgtcgttaggttatcaacatcaacctccttattgacaatcagagccaagccagctaccgcgaccttgtggtcaacaagagcagaagcatcaattccgtctttttcctcagcaaatacatctgagtttcctatatcaactgccccagactgaacctgggacaagcctgtaccagaacctcccccttggacattgaccgtttttccaacatggatcgtgccaaattcatctgccgctacttcaaccaagggttgcaaggcagttgagccaacagccgttatggattctccacgatcaatccagctagcacagcctactaaacaagccgtcagccaaaaagcgataagagacagagcaagcttttttctttttttcactgtttttctcctcgaaaataattatgaatactgtgaattttttaagtagttctttatgagttgacgcatgaattcttaccaaatttctgcgcaattgattatttatataatataggctatattactctttcctaacctccttttttcatatgtggataaaatctcttgtctatcccttcccccattgtcacccattatagtcatttcgtgtctctttttcccctttttaatgcaagggaaattactctccttagatgataatccaaaagctagaaaggtatctcaaacctctctactctcccagactagtttacaactaaaaggaaaagattctattttatgagaaatctagtttacaagcggtaagaacgctaataactaaacttcttgtactctttgaaaatctcttcaaaccagtgttttgagctatctatggctagcttcctagtttgctctttgattttcattgagtagtaaaactacatgtaatggcaatcaagatatcaagaatcatcctactaaaaaaatccatactttcactataacatagaataagatatttgactagcattttcatttgaatctgaggccttttggaaaataatttttcaaaacatttccagtaacctttgcaaagcccaagccattgcctttaaccaaaacttggtaccaaccatttggcagactttctgccagctgaacggtttctccagccgcatacttgacaaacgcttcttggccaatttcaaccgactgttcgacctgactcggtttcaaggctaaaccaagagcgaaactgggctcaaagcgtttcttcttaaaagtacccagatgcagtccattgcgagcaatcttgagcttccataaatctggcaaaagttctggcaagagataaagctggtctccaaaaatctgcaagatacccggtagattgaccttcaaatggttttgggcaaattcctgccacaaggcaacttgttcacggctgaggttactcttacttgccttaaatttaggagctggattgttacccttaaactgtagatgggcaacaaactgaccctctcccttaaactgatgaggatacatccgagccgtttctggcaggtcaataccagctaccattccattgatatgctctactggcaacaagtcaaaatcatactcttccagcaaccaattgacaatctcttcgttttcctcgggtgcccaggtacaggtcgaataaaccagatgaccaccttcagctaacatggtcactgcatcctccagaatttctctttgcaagctagcacattgactcggataatctaagctccaatagtccatagcatcaggttgcttacgaaacattccttcaccagagcaaggggcatcaagaacgattaagtcaaaatagcctttaaagaccttgaccaagcggtcggcagattcattggtcaccacgacatttgtcgctccaaaacgctccatgttttcaaccaaaatcttagcccgtttgcttgaaatttcattggaancaagtagcccctcccctgctagataggctgccagttgagttgatttgccccccggtgcagcagccaagtccaagaccttcataccaggactgggttgggctacttgagccaccatttgagcagcaggttcttgcgaataaactaaacctgtagcatgctcaggcgatttccctgaaaccttcccatagtggccccaaggggtttgagtaatggcatcagaaaaggaaagttgctcttcttttaagggattgacccgaaaggccgaaaccgcttcctcctcaaaagaggcaagaaaatctcttgcctcatctcctagtatctctttatatttttcaacaaatccttctggaaattgcatttaagttcttttcctttcgtaaatataggactgaatttcctcctgcatctcaagaggcaccatcatgaccggctgtctggtttgaaaatcaggagcttcaccaaaaagggtcacaacccgatagcccagactttcccctaaaatactagctgcggcataatcccatggttgcagataagtgagataggtcaacaaacgccctgacaaaatcttggcaaaactaatggccgcacttccatagacacgaacaccaagaaccgctcggctcaaatcagccagcccccattcattggtttccagcataccactattccctgcaatgagaaaatctccaagtggtttagttttaaaaggagctagggacctatcatttagacaaactggaaattccccaccaccgtggtaacaatcccctttgaccacatcataaatcagaccaaactgtccctgaccattttcaaaataagccatcataacagcaaaatcttcctgctgggctacaaaattattggtaccatcaatgggatcaatgacccaaaccttgccctcttgaaccgaggctcgcagacaaccttcttcagcacaaatcttatcctcaggataacgggacaaaatctcaccaaccaagagttcctgaacttctttgtccagtctggtcaccaaatctgttggagaggacttggtttcaacacgcaagtcttcctgcatatggtcaagaatgtactgacctgctttcttaacaagctctttagcaaattcaaatttactttccaagagaaatctttccttcccctttttctttgggg

SEQ ID NO: 19 - DNA, 4820 bp; double-stranded, linear
gtaatgatataggaacaccaggtgacctgatgggacgtcgtaagcctatgaactactagctgctaaaggctttaaagatggtatggtaccatatatctcaaaccaatacgaagaagaagccaaacaaaagggcaagacaatcaatctctacggtaaaacaagaggtttggttacagatgacttggttttggaaaaggtatttaataaccaatatcatacttggagtgagtttaagaaagctatgtatcaagaacgacaagatcagtttgatagattgaacaaagttacttttaatgatacaacacagccttggcaaacatttgccaagaaaactacaagcagtgtagatgaattacagaaattaatggacgttgctgttcgtaaggatgcagaacacaattactaccattggaataactacaatccagacatagatagtgaagtccacaagctcaagagagcaatctttaaagcctatcttgaccaaacaaatgattttagaagttcaatttttgagaataaaaaatagtgtctactattaggaaataaagtttaaaaaggtgatgaagaacaaaccaagattcaagcaggaattcctactgataatgaagtaagttatgatcttatttatcagcaggaaactcttcctgcaacaggttcatcaacttctgagcttacagctttaggcctattagctgttggtagtttagttcttttggttcataatatgacgggaacagttttttgctccctctgaaaagtcatcatttgatggcttttttctatatagggtaaaagatagggtaaaaggctatcatcggacaaaataaagaaggcatgatataatataaagtagatttctatgtcataaaacaagaactgtttggacatcattcatttgaaaactctctatgttcaaacaatagtaaaataaaataggggatctaaatccttgctatgaaaggaaaaaactcaatggctactattcaatggtttcctggtcacatgtctaaagctcgtcgacaggtgcaggagaatttaaaatttgttgattttgtgacgattttagtagatgcacgcttgcctctatctagtcaaaatcctatgttgaccaagattgttggtgataaaccaaaactcttgattttaaacaaggccgacttggctgatccagcaatgaccaaggaatggcgtcagtattttgaatcacaaggaatccagacgctagctatcaactccaaagagcaagtgactgtaaaagttgtaacagatgcggccaagaagctcatggctgataagattgctcgccagaaagaacgtgggattcagattgaaaccttgcgtactatgattatcgggattccaaacgctggtaaatcaactctgatgaaccgtttggctggtaaaaagattgctgttgttggaaacaagccaggggtcacaaaaggtcaacaatggcttaaaaccaataaagacctggaaatcttggatacaccggggattctctggcctaagtttgaggatgaaactgttgcacttaagttggcattgactggagctatcaaagaccagttgcttcctatggatgaggttaccatttttggtatcaattatttcaaagaacattatccagaaaagctggctgaacgcttcaaacaaatgaaaattgaagaagaagcgcctgtgattattatggatatgacccgcgccctcggtttccgtgatgactatgaccgtttttacagtctcttcgtgaaggaagtccgtgatggcaaactcggtaactataccttagatacattggaagacctcgatggcaacgattaaagaaatcaaagaattccttgtgacagtcaaggagttagaaagccctatttttttagagcttgaaaaggataatcgctcaggagttcaaaaggaaatcagcaagcgtaaaagagccattcaagctgaattagatgaaaatttgcgcttggaatccatgctttcttatgaaaaagaactttataagcaaggattgaccttaattgcaggtattgatgaggttggtcgtggtcctcttgctggtcctgtagtcgctgcggccgttattttatctaaaaattgtaagattaaaggtctcaacgacagcaagaaaattcctaaaaagaaacatctggagattttccaagccgttcaagaccaagccttgtcgattggaattggtatcatagataatcaggtcatcgaccaagtcaacatctatgaagcaaccaaactagccatgcaagaagcaatctcccagctcagccctcaaccagagcaccttttgattgatgccatgaaactggacttgcccatttcacaaacctccattatcaaaggagatgccaactccctctctatcgcagcagcatctatagtagccaaggtaacacgtgatgaattgctgaaagaatacgatcagcagttccctggctatgatttcgctactaatgcaggatatggcacagctaaacatctggaaggcctcacaaaactaggagttaccccaattcaccgaaccagctttgaacccgttaaatcactggttttaggtaaaaaagaaagttaattgaaaggaaataacatggaggaacagtcggaaatagtccgttctaagaaagaattcgcctttgcatccagcactatactatcccaagttggtcgaggaatcattgtcggcctcatcgttggaattatcgtcggatcctttcgtttcttaattgaaaagggcttccacctgatacaaggagtttatcaagatcaagggtacttagtgcgcaatctttttgtactggttttgttttatatactcatctgttggctcagtgccaaactaacacggtcagaaaaagatattaaaggctcaggaattcctcaagtcgaagccgaactgaaaggcctcatgtccctcaactggtggggcattctttggaaaaaatatgtgctaggtattcttgctattgccagtggactcatgctgggtcgagagggacccagcattcaacttggagcagttggtggtaaaggaattgccaagtggctcaaatccagtccagtagaggaacgttccttgattgccagtggagctgcagcaggtttagccgcagcctttaatgctcctattgcagcacttctctttgttgtagaagaagtctatcaccatttttcgcgctttttctgggtctcaactctagcagccagcatcgtagcaaactttgtgtctctactcatgttcggtttgacaccagtattggatatgccagataacattcctcccatgaccctagatcagtattggatatatctcgtcatgggaattttccttggattttcaggttttctctatgagaaagctgtattaaacgttggaagagtttatgacttgattggtcaaaaaatccatttggatagggcttattatcccatcttggcttttatccttatcataccagtcggaatcttcttacctcaaatcattggtggcggaaatcagcttgtcctttctttaactgaacaaaattttagtttccaagttttattagcttactttttaatccgctttatttggagtatgattagctatggaagtggactgccaggaggaattttcctccccattttagctcttggttctttgcttggtgccttagttggtgttatctgtgtcaatcttggacttgtcagtcaagagcaattccctatatttgtcattctaggaatgagtggctattttggagccatatcaaaagctcccttaaccgctatgatcctcgtaactgagatggtaggagatattcgcaaccttatgccacttggtcttgtcactcttgtttcttatattatcatggatttgctcaaaggtacgccagtctatgaagccatgctggaaaaaatgcttccagaagaagtatctagcgaaggagaagttacacttatcgaaataccagtttctgataaaattgctgggaaacaagttcatgaactcaacttaccacacaacgtcctcatcacaactcaagtccataatggcaagagccaaacagttaacggctcaaccagaatgtatctgggtgatatgattcacctggttattccaaaaagtgaaattggaaaagtcaaagatttgttgttgtagtatgagtatttacataatttatgttatgtaaatgatcagtttgatttatttagaaaaccgattctcaggaatgagatcggttattttttactgatgaggaattttacatataaataattgaactttattaaaaataagactataattaagttagaaatgataaagtataaagctagaaaggagtttactgtatcaaatctgtacagtaagattaaaatcatgaaaaagaaaacaatagcaattatatagagaaatgaaatagaaataggataaaacaatcaggacaatcaaatcaatttctagcaatgttttagaagtccagatgtactattctagtttcaatctattatacaatgtgttttgtatctcatagctccttatatagctcttcagttatgtagtattaacagaagtttagtgggtgagatttttattattttccttattctgttttgtttgtaggtctaagtctttttatcactttgaaaaactcctataacatctttccgaaaaactataattttcttgaaaaatatacaagtctatgctatactactagtatacttacttatggagaaaatacatgaaacgtgagattttactggaacgaatcgacaaactaaaacaactcatgccctggtaagttctggaatactaccaa

SEQ ID NO: 20 - DNA, 21338 bp; double-stranded, linear
ctacgacatcatgattaacagtcatgcgctactaccaactgagctatggcggataaaatagtccgtacgggattcgaacccgtgttaccgccgtgaaaaggcggtgtcttaaccccttgaccaacggaccttctatctgtagcagatataaccattatatcaatttcttgctaattgtcaatcacttttgagattttttctctaaaatatcttttaattttctaatttttaatcttgaaataggacaacgatggtcttcatagaaaacaatttctaagttttttcgatcaatttctctgatattacctatatttaccaaaaatgacttgtgaggagaataaaatcgctgagtatgtttgtccttttcctgaatatctgtcatggtaccataaaactcttttgcaaaattcttaccaataatgcgcaatttatgagatacccctgttgtttcaatatacaaaatatcatggtaaggaatttttaaatcatttcccttgtaattgtagtcgaaataatctacaacatcttcattttcaagtaacatactcttcgtgtagaagatattttgctcaattctcttcttaaacatctcatcattgatatccttatcaacaaaatctagggctgatacctggtatttataggttagagtcgcaaactctgatcgactagtgataaagacgataatagcgtaaggattgtaatgacgaatgagctgagccacttcaaatccctttttctcaattccatgaatatcgatatctaggaaataaagctgatttacttcatcattttcaatgtattcttcaaattcacggacttttcccgttgtcttgtatgatattggaatattcgattctttcgaaatttcatccaatattctctctagtctcacttgatgttcaataacatcttctaaaattaaaactttcattcaaattccctcttaaatctaatgatttgtctaaatgtactgccttccatctctgtttctaaaataatattgttgtacttatctagtagttctttcacattatttaatccgactccgcgatttcttcccttagtggagaatcctaaggcaaatagatctcctgaaggagtcatcgtcattttacatgaattctgaatcacaataactgtttcagtttccatcttaataactgctacttccatctgctttttatagctatcagccgatccttcgacagcattattcaataaaacgctcatgatacgaaccaaatccaatagttcaattggaagcttggtaatcgtatcttttacttccagtgtaaactctacaccattatttcgagcatagacaattgactgagcaaccaaacttcgtaaagctgagtcttctatgttgttcaaatcaaagtaagtgtacttatctgaacgcaatttatgatttgctttgactaaaacttcattgtaaattctgtcaatttcctgtaaattaccactgtcaattgccatctgcatgctgacaagcattccagcataatcatgtcgaaaaccacggatttcattatacagaccaacaatttcatctgtgtaattctgtaaatgtttctgttcaaatttcttctgcttcaaagcaatctctttctccatttgaactttatgagaattcattgcaaagaaggtcaaaaggagagagataaagacaatagatgacaaaatacttccaaaactattcaaatgtttaatcgtacttaccatatctgaaacgaaagatacaatatgtagcaatagtaaagcaaaaaatacttttttcaagaaaggataaaggtagtccttgtcaaaataggctagttccaaatggaaatagtaaatgatttttaatgtaacaaaataggttaacaccgtcacaacgaaaaagaatgggaaatgatattgtaaaacaaaattatctcctgttatagaggagaaaattacggacagaaagttatgagtgctctcatataaaagagatagtagtaaacttaggaatagtcctctatccctctcatactgtttcatccatcgaaaataggaatataagcccaaaggaaataaaaatctttcaatccctattttatctaaatatagaagataaaaggaaaattcaagtactatttcagttagtaatgtataagcaccaaaaacgtataattcttttctatttattcgacctttacaaattaaacggtaactgtgactaataattaaaaaatgaacaataactgtcccaaatccaagtaaatccattactctttctccttatttcattacttttttcgtaggaaaagaaaatcaaggatgattcttgaaatcctcatctccccacctttaatcttttgtaagtctttttccttcaaagctacaaactgttccaatttaactgtgtttttcataataaaatctcctaaaatgttttttcttgtaagctaacttacaaaaaccattatacaaaatggaatttcgttttagataaaattctctcaactgtcatttttttctcccaaagtgtacttttttaagaaaaaagccgggaaaattcccagctttgctattatattgatcccagcaggattcgaacctgcgaccgttcgcttagaaggcgaatgctctatccagctgagctatgagacctaatacaattattctaccaaaaattcaattaaaagtcaattttctatttatggtaggggaatccctgctgaatcgtaaaagcgcgatagatttgttcaacaagaactagtctcattaactgatggggtaaggttaggcgaccaaaactgacagaaagattggctctattttttacagatgatgataatcctaaacttcccccaataataaaagtaagagtagaaaatccttttatagaagtttcttctaactgcttactaaattcttctgagaagaaagttttcccttcaatggctaacacaataacgaaatcacggtcagcaatttttgataaaattctctgaccttctatttctaaaatcttttgattttctgattcactggccttatctggtgttttttcatctgataactcaatcatttcaaacttagcaaatctagaaattcgttttgaatactctgcgataccatcttttaaatacttttctttcagtttcccaactgttacaactttaattttcatgactctattctaacatattctctattttttcacatcttattcacaaaataaaaaatagatttcaattaagaaaatcacaatttcaaaagagttatccacagtttgtgtaaaacttttgtgtttaagttataattaagctagtcagtttatactttcagtaattcaaacatatggaggcaaatatgaaacatctaaaaacattttacaaaaaatggtttcaattattagtcgttatcgtcattagcttttttagtggagccttgggtagtttttcaataactcaactaactcaaaaaagtagtgtaaacaactctaacaacaatagtactattacacaaactgcctataagaacgaaaattcaacaacacaggctgttaacaaagtaaaagatgctgttgtttctgttattacttattcggcaaacagacaaaatagcgtatttggcaatgatgatactgacacagattctcagcgaatctctagtgaaggatctggagttatttataaaaagaatgataaagaagcttacatcgtcaccaacaatcacgttattaatggcgccagcaaagtagatattcgattgtcagatgggactaaagtacctggagaaattgtcggagctgacactttctctgatattgctgtcgtcaaaatctcttcagaaaaagtgacaacagtagctgagtttggtgattctagtaagttaactgtaggagaaactgctattgccatcggtagcccgttaggttctgaatatgcaaatactgtcactcaaggtatcgtatccagtctcaatagaaatgtatccttaaaatcggaagatggacaagctatttctacaaaagccatccaaactgatactgctattaacccaggtaactctggcggcccactgatcaatattcaagggcaggttatcggaattacctcaagtaaaattgctacaaatggaggaacatctgtagaaggtcttggtttcgcaattcctgcaaatgatgctatcaatattattgaacagttagaaaaaaacggaaaagtgacgcgtccagctttgggaatccagatggttaatttatctaatgtgagtacaagcgacatcagaagactcaatattccaagtaatgttacatctggtgtaattgttcgttcggtacaaagtaatatgcctgccaatggtcaccttgaaaaatacgatgtaattacaaaagtagatgacaaagagattgcttcatcaacagacttacaaagtgctctttacaaccattctatcggagacaccattaagataacctactatcgtaacgggaaagaagaaactacctctatcaaacttaacaagagttcaggtgatttagaatcttaattgacatctatgtaaagaaagctttacataagagaaaagatgtgttagtgtagaatcatggaaaaatttgaaatgatttctatcacagatatacaaaaaaatccctatcaaccccgaaaagaatttgatagagaaaaactagatgaactagcacagtctatcaaagaaaatggggtcattcaaccgattattgttcgtcaatctcctgttattggttatgaaatccttgcaggagagagacgctatcgggcttcacttttagctggtctacggtctatcccagctgttgttaaacagatttcagaccaagagatgatggtccagtccattattgaaaatttacagagagaaaatttaaacccaatagaagaagcacgcgcctatgaatctctcgtagagaaaggattcacccatgctgaaattgcagataagatgggcaagtctcgtccatatatcagcaactccattcgtttactttccttgccagaacagattctttcagaagtagaaaatggcaaactatcacaagcccatgcgcgttccctagttgggttaaataaggaacaacaagactatttctttcaacggattatagaagaagatatttctgtaaggaaattagaagctcttctgacagagaaaaaacaaaagaaacagcaaaaaactaatcatttcatacaaaatgaagaaaaacagttaagaaaactactcggattagatgtagaaattaaactatctaaaaaagacagtggaaaaatcattatttctttttcaaatcaagaagaatatagtagaattatcaacagcctgaaataaggctgttcttttatttttttatctcacaaggttatccactatgtttttcgataaaaagcttaataaatcaataatttcttcttttatccccaacctgtggataaagtttggtaacattgtggattatttttcacagcttgtggaaaattcttgctatctatggtaaaatatctctagtattaaacttttaaatagtaaaggaggagaaaggattgaaagaaaaacaattttggaatcgtatattagaatttgcacaagaaagactgactcgatccatgtatgatttctatgctattcaagctgaactcatcaaggtagaggaaaatgttgccactatatttctacctcgctctgaaatggaaatggtctgggaaaaacaactaaaagatattattgtagtagctggttttgaaatttatgacgctgaaataactccccactatattttcaccaaacctcaagatacgactagctcacaagttgaagaagctacaaatttaactctttataactatagtccaaagttagtatctattccttattcagatacgggattaaaagaaaagtatacctttgataactttattcaaggggatggaaatgtttgggctgtatcagccgctttagctgtctctgaagatttggctctgacctataaccctctttttatctatggaggaccaggccttggtaagactcacttattaaacgctattggaaatgaaattctaaaaaatattcctaatgcgcgtgttaaatatatccctgccgaaagctttattaatgactttcttgatcacctaagacttggggaaatggaaaagtttaaaaagacctatcgtagtcttgatcttttgttaatcgatgatatccagtcactcagcggaaaaaaagtcgcaactcaggaagaatttttcaatacctttaacgcccttcatgacaagcaaaaacagattgtcctaacgagtgatcgtagtccaaaacatctagaagggctcgaggagaggcttgtcacgcgttttagttggggattgacacaaactatcaccccccctgactttgaaacacgtattgccattttacaaagtaagacggaacatttaggctacaatttccaaagtgatactctagaatacctagctgggcaatttgattcaaatgttcgagatcttgagggagccatcaacgacatcactttaattgccagagtaaaaaaaatcaaggatatcactattgatattgctgcagaagccattagagcccgcaaacaagatgttagccaaatgctcgtcatcccaattgataaaatccaaactgaagttggtaacttttatggtgttagtatcaaagaaatgaagggaagtagacgccttcaaaatattgttttggcccgtcaagtagccatgtatttatctagagaactaacagataatagtcttccaaaaattgggaaggaatttgggggaaaagatcataccacagtcattcatgcccatgccaaaataaaatctttgattgatcaagacgataatttacgtttagaaattgaatcaatcaaaaagaaaatcaaataatttgtggataacttttagttttttatcttttttatccacattttttaaacaagctaaaaaacttgatatgacttgtttaaaggctgttttccacagatttcacagactctattattactattatctttctaatactaaaaataaataaaggagaatccatgattcatttttcaattaataaaaatttatttctacaagcattaaatactactaagagagctattagttctaaaaatgccattcctattttatcaacagtaaaaattgacgtgaccaatgaaggtattactttaattggttcaaatggtcaaatttcaattgaaaattttatttctcaaaaaaatgaagatgctggtttgttaattacttctttaggttcgatccttcttgaagcttctttctttatcaatgtagtatctagtttacctgatgtaactcttgattttaaagaaattgaacaaaatcaaattgttttaaccagtggcaaatcagaaattaccctaaaaggaaaagatagcgaacaatatccacgaatccaagaaatttcagcaagcactcctttaatacttgaaacaaaattactcaagaaaattattaatgaaacagcctttgctgcaagtacacaagagagtcgtccgattttaacaggtgtccacttcgtattgagtcaacacaaagagttaaaaacagttgcaacagactctcatcgcctaagccagaaaaaattgactcttgaaaaaaatagtgatgattttgatgtcgtaattcctagccgttctctacgcgaattttcagcggtatttacagatgatatcgaaactgtagagattttctttgccaataaccaaatcctctttagaagcgaaaatattagcttctatactcgtctcctagaaggaaactatcctgatacagatcgcttgattccaacagactttaacactactattacttttaatgtggtaaacttacgccagtcaatggagcgtgcccgtcttttatcaagtgcgactcaaaatggtactgtgaaacttgaaattaaggatggggttgttagcgcccatgttcactctccagaagttggtaaagtaaacgaagaaatcgatactgatcaggttactggtgaagatttgaccattagtttcaacccaacttacttgattgattctcttaaagctttaaatagcgaaaaggtgactattagctttatctcagctgttcgtccatttactcttgtgccagcagatactgacgaagacttcatgcagctcattacaccagttcgtacaaattaagtgaaagaggttgagcctggctcgcctcttttatgatataatcgaaaaagaaaaggagagtagtatgtatcaagttggaaattttgttgagatgaaaaaatcacacgcttgtacaatcaagtcgactggtaaaaaggctaatcgttgggaaattacacgtgtaggagcagatatcaaaataaaatgtagtaattgtgagcatgttgtcatgatggggcgatatgattttgagcgaaaaatgaataaaattattgactgagaacccttagttagagggttagcactttatccctttttgtgttataatattagggattgaaatgaaaacggagaatgagaaatatggctttgacagcaggtatcgttggtttgccaaacgttggtaaatcaacactatttaatgcaattacaaaagcaggagcagaggcagcaaactacccatttgcgacgattgatccaaatgttggaatggtggaagttccagatgaacgcctacaaaaactaactgaaatgataactcctaaaaagacagttcccacaacatttgaatttacagatattgcagggattgtaaaaggagcttcaaaaggagaggggctagggaataaattcttggccaatattcgtgaagtagatgcgattgttcacgtagttcgtgcttttgatgatgaaaatgtaatgcgcgagcaaggacgtgaagacgcctttgtagatccacttgcagatattgataccattaatctggaattgattcttgctgacttagaatcagtgaacaaacgatatgcgcgtgtagaaaagatggcacgtacgcaaaaagataaagaatcagtagcagaattcaatgttcttcaaaagattaaaccagtcctagaagacgggaaatcagctcgtaccattgaatttacagatgaggaacaaaaggttgtcaaaggtcttttccttttgacgactaaaccagttctttatgtagctaatgtggacgaggatgtggtttcagaacctgactctatcgactatgtcaaacaaattcgtgaatttgcagcgacagaaaatgctgaagtagtcgttatttctgcgcgtgctgaggaagaaatttctgaattgaatgatgaagataaaaaagagtttcttgaagccattggtttgacagaatcaggtgtagataagttgacgcgtgcagcttaccacttgcttggattgggaacttacttcacagctggtgaaaaagaagttcgcgcttggactttcaaacgtggtatgaaggctcctcaagcagctggtattatccactcagactttgaaaaaggctttattcgtgcagtaaccatgtcatatgaagatctagtgaaatacggatctgaaaaggccgtaaaagaagctggacgcttgcgtgaagaaggaaaagaatatatcgttcaagatggcgatatcatggaattccgctttaatgtctaaaaattaataaatggtgtcaattaggttggaaaaaaattccaacccttttggcttttgaaaggaaaaataaatgaccaaattacttgtaggcttgggaaatccaggggataaatattttgaaacaaaacacaatgttggttttatgttgattgatcaactagcgaagaaacagaatgtcacttttacacacgataagatatttcaagctgacctagcatcctttttcctaaatggagaaaaaatttatctggttaaaccaacgacctttatgaatgaaagtggaaaagcagttcatgctttattaacttactatggtttggatattgacgatttacttatcatttacgatgatcttgacatggaagttgggaaaattcgtttaagagcaaaaggctcagcaggtggtcataatggtatcaagtctattattcaacatataggaactcaggtctttaaccgtgttaagattggaattggaagacctaaaaatggtatgtcagttgttcatcatgttttgagtaagtttgacagggatgattatatcggtattttacagtctgttgacaaagttgacgattctgtaaactactatttacaagagaaaaattttgagaaaacaatgcagaggtataacggataaatggtgaccttattagatttattctcagaaaatgatcagattaaaaaatggcatcaaaatttaacagataagaaaagacaactaatacttggtttatcaacatctactaaggctcttgcaattgcaagcagtttagaaaaagaagataggattgtgttattgacgtcaacttatggagaagcagaaggacttgttagtgatcttatttctatcttgggtgaggaactcgtctatccatttttggtagatgatgctcctatggtggagtttttgatgtcttcacaggaaaaaattatttcacgggttgaagccttgcgttttttgactgattcatctaagaaagggattttagtttgtaatatcgcagcaagtcgattgattttaccgtctcccaatgcattcaaagatagtattgtaaaaatctcagttggtgaagaatatgatcaacacgcgtttatccatcagttaaaggaaaatggctatcgaaaagttactcaagtacaaactcagggcgaatttagtcttcgaggagatattttagatatttttgaaatatcccagttagaaccttgtcgaattgagttttttggtgatgaaattgatggtatcaggtcatttgaagtagaaacacaattatcgaaagaaaataagacagaactcactatctttccagctagtgatatgcttttgagagaaaaggattatcaacgaggacagtcagctttagaaaaacaaatttcaaaaactttatcacctattttgaaatcatacctagaagaaattctttcaagttttcaccaaaaacaaagtcatgcagactctcggaagtttttatctttgtgctatgataagacatggactgtctttgattatattgaaaaagatactccaatattctttgatgattatcaaaaattgatgaatcagtatgaagtctttgaaagagacttagcgcagtactttacagaagaattacagaatagtaaagcattttctgatatgcagtatttttctgatattgaacaaatctataaaaaacaaagtccagtgacctttttctctaatcttcaaaagggtttaggaaatctcaaatttgacaaaatttatcaattcaatcaatatcctatgcaggaatttttcaatcagttttcttttctaaaagaagaaattgaacgatataaaaaaatggattacaccattattctgcagtctagcaattcaatgggaagtaaaacattggaggatatgttagaggaatatcagattaaattggattctagagataagacaaatatctgtaaagaatctgtaaacttaatagagggtaatctcagacatggttttcattttgtagatgaaaagattttattgataactgaacatgagatttttcaaaagaaattaaagcgtcgttttcgaagacaacatgtttcaaatgcagagagattaaaagattacaatgaacttgaaaaaggggactatgttgtccatcatatccatgggattggtcaatatctaggaattgaaaccattgaaatcaagggaattcatcgcgattatgtcagtgtccaataccaaaatggtgatcaaatttctatccccgtggaacagattcatctactgtccaaatatatttcaagtgatggtaaagctccaaaactcaataaattaaatgacggtcattttaaaaaggccaagcaaaaggttaagaaccaggtagaggatatagctgatgatttaatcaaactctactctgaacgtagtcagttgaagggttttgctttctcagctgatgatgatgatcaagatgcctttgatgatgctttcccttatgttgaaacggatgatcaacttcgtagtattgaggaaatcaagagggatatgcaggcttctcagccaatggatcgacttttagttggggatgttggttttggaaagactgaagttgctatgcgtgcagcctttaaagcagtcaatgatcacaaacaggttgtcattctagttccgacgacggttttagcgcaacagcactatacgaattttaaggaacgattccaaaattttgcagttaatattgatgtgttgagtcgctttagaagtaaaaaagagcagactgcaacacttgaaaaattgaaaaacggtcaagtcgatattttgattggaacacatcgtgttttgtcaaaagatgttgtgtttgctgatttgggcttgatgattattgatgaggaacagcgatttggtgtcaagcataaggaaactttgaaagaactgaagaaacaagtggatgtcctaaccttgaccgctacgccaatccctcgtaccctccatatgtctatgctgggaatcagagatttatctgttattgaaactccgccgactaatcgctatcctgttcagacctatgttttggaaaagaatgatagtgtcattcgtgatgctgtcttgcgtgaaatggagcgtggaggtcaagtttattatctttacaacaaagttgacacaattgttcagaaggtttcagaattacaggagttgattccggaggcttcgattggatatgttcatggtcgaatgagtgaagtccagttggaaaatactctattagactttattgagggacaatacgatatcttggtgacgactactattattgagacaggggtggacattccaaatgctaatactttatttattgaaaatgcggaccatatgggcttgtcaaccttatatcagttaagaggaagagtcggtcgtagtaatcgtattgcttatgcttatctcatgtatcgtccagaaaaatcaatcagtgaagtctctgaaaagagattagaagcgattaaaggatttacagaattgggctctggctttaagattgcaatgcgagatctttcgattcgtggagcaggaaatcttttaggaaaatcccagtctggtttcattgattctgttggttttgaattgtattcgcagttattagaggaagctattgctaaacgaaacggtaatgctaacgctaacacaagaaccaaagggaatgctgagttgattttgcaaattgatgcctatcttcctgatacttatatttctgatcaacgacataagattgaaatttacaagaaaattcgtcaaattgacaaccgtgtcaattatgaagagttacaagaggagttgatagaccgttttggagaatacccagatgtagtagcctatctgttagagattggtttggtcaaatcatacttggacaaggtctttgttcaacgtgtggaaagaaaagataataaaattacaattcaatttgaaaaagtcactcaacgactgtttttagctcaagattattttaaagctttatccgtaacgaacttaaaagcaggcatcgctgagaataagggattaatggagcttgtatttgatgtccaaaataagaaagattatgaaattttagaaggtttgctgatttttggagaaagtttattagagataaaagagtctaaggaagaaaattccatttgatatttttcttctataaaatagataaaaatggtacaataataaattgaggtaataaggatgagattagataaatatttaaaagtatcgcgaattatcaagcgtcgtacagtcgcaaaggaagtagcagataaaggtagaatcaaggttaatggaatcttggccaaaagttcaacggacttgaaagttaatgaccaagttgaaattcgctttggcaataagttgctgcttgtaaaagtactagagatgaaagatagtacaaaaaaagaagatgcagcaggaatgtatgaaattatcagtgaaacacgggtagaagaaaatgtctaaaaatattgtacaattgaataattcttttattcaaaatgaataccaacgtcgtcgctacctgatgaaagaacgacaaaaacggaatcgttttatgggaggggtattgattttgattatgctattatttatcttgccaacttttaatttagcgcagagttatcagcaattactccaaagacgtcagcaattagcagacttgcaaactcagtatcaaactttgagtgatgaaaaggataaggagacagcatttgctaccaagttgaaagatgaagattatgctgctaaatatacacgagcgaagtactattattctaagtcgagggaaaaagtttatacgattcctgacttgcttcaaaggtgataaaatggaaaatttattagacgtaatagagcaatttttgagtttgtcagatgaaaagctggaagaattggctgataaaaatcaattattgcgtttacaagaagaaaaggaaaggaagaatgcgtaaattcttaattattttgttgctaccaagttttttgaccatttcaaaagtcgttagcacagaaaaagaagtcgtctatacttcgaaagaaatttattacctttcacaatctgactttggtatttattttagagaaaaattaagttctcccatggtttatggagaggttcctgtttatgcgaatgaagatttagtagtggaatctgggaaattgactcccaaaacaagttttcaaataaccgagtggcgcttaaataaacaaggaattccagtatttaagctatcaaatcatcaatttatagctgcggacaaacgatttttatatgatcaatcagaggtaactccaacaataaaaaaagtatggttagaatctgactttaaactgtacaatagtccttatgatttaaaagaagtgaaatcatccttatcagcttattcgcaagtatcaatcgacaagaccatgtttgtagaaggaagagaatttctacatattgatcaggctggatgggtagctaaagaatcaacttctgaagaagataatcggatgagtaaagttcaagaaatgttatctgaaaaatatcagaaagattctttctctatttatgttaagcaactgactactggaaaagaagctggtatcaatcaagatgaaaagatgtatgcagccagcgttttgaaactctcttatctctattatacgcaagaaaaaataaatgagggtctttatcagttagatacgactgtaaaatacgtatctgcagtcaatgattttccaggttcttataaaccagagggaagtggtagtcttcctaaaaaagaagataataaagaatattctttaaaggatttaattacgaaagtatcaaaagaatctgataatgtagctcataatctattgggatattacatttcaaaccaatctgatgccacattcaaatccaagatgtctgccattatgggagatgattgggatccaaaagaaaaattgatttcttctaagatggccgggaagtttatggaagctatttataatcaaaatggatttgtgctagagtctttgactaaaacagattttgatagtcagcgaattgccaaaggtgtttctgttaaagtagctcataaaattggagatgcggatgaatttaagcatgatacgggtgttgtctatgcagattctccatttattctttctattttcactaagaattctgattatgatacgatttctaagatagccaaggatgtttatgaggttctaaaatgagggaaccagattttttaaatcattttctcaagaagggatatttcaaaaagcatgctaaggcggttctagctctttctggtggattagattccatgtttctatttaaggtattgtctacttatcaaaaagagttagagattgaattgattctagctcatgtgaatcataagcagagaattgaatcagattgggaagaaaaggaattaaggaagttggctgctgaagcagagcttcctatttatatcagcaatttttcaggagaattttcagaagcgcgtgcacgaaattttcgttatgatttttttcaagaggtcatgaaaaagacaggtgcgacagctttagtcactgcccaccatgctgatgatcaggtggaaacgatttttatgcgcttgattcgaggaactcgcttgcgctatctatcaggaattaaggagaagcaagtagtcggagagatagaaatcattcgtcccttcttgcattttcagaaaaaagactttccatcaatttttcactttgaagatacatcaaatcaggagaatcattattttcgaaatcgtattcgaaattcttacttaccagaattggaaaaagaaaatcctcgatttagggatgcaatcttaggcattggcaatgaaattttagattatgatttggcaatagctgaattatctaacaatattaatgtggaagatttacagcagttattttcttactctgagtctacacaaagagttttacttcaaacttatctgaatcgttttccagatttgaatcttacaaaagctcagtttgctgaagttcagcagattttaaaatctaaaagccagtatcgtcatccgattaaaaatggctatgaattgataaaagagtaccaacagtttcagatttgtaaaatcagtccgcaggctgatgaaaaggaagatgaacttgtgttacactatcaaaatcaggtagcttatcaaggatatttattttcttttggacttccattagaaggtgaattaattcaacaaatacctgtttcacgtgaaacatccatacacattcgtcatcgaaaaacaggagatgttttgattaaaaatgggcatagaaaaaaactcagacgtttatttattgatttgaaaatccctatggaaaagagaaactctgctcttattattgagcaatttggtgaaattgtctcaattttgggaattgcgaccaataatttgagtaaaaaaacgaaaaatgatataatgaacactgtactttatatagaaaaaatagataggtaaaaaatgttagaaaacgatattaaaaaagtcctcgtttcacacgatgaaattacagaagcagctaaaaaactaggtgctcaattaactaaagactatgcaggaaaaaatccaatcttagttgggattttaaaaggatctattccttttatggctgaattggtcaaacatattgatacacatattgaaatggacttcatgatggtttctagctaccatggtggaacagcaagtagtggtgttatcaatattaaacaagatgtgactcaagatatcaaaggaagacatgttctatttgtagaagatatcattgatacaggtcaaactttgaagaatttgcgagatatgtttaaagaaagagaagcagcttctgttaaaattgcaaccttgttggataaaccagaaggacgtgttgtagaaattgaggcagactatacttgctttactatcccaaatgagtttgtagtaggttatggtttagactacaaagaaaattatcgtaatcttccttatattggagtattgaaagaggaagtgtattcaaattagaaagaataatctttaatgaaaaaacaaaataatggtttaattaaaaatccttttctatggttattatttatctttttccttgtgacaggattccagtatttctattctgggaataactcaggaggaagtcagcaaatcaactatactgagttggtacaagaaattaccgatggtaatgtaaaagaattaacttaccaaccaaatggtagtgttatcgaagtttctggtgtctataaaaatcctaaaacaagtaaagaagaaacaggtattcagtttttcacgccatctgttactaaggtagagaaatttaccagcactattcttcctgcagatactaccgtatcagaattgcaaaaacttgctactgaccataaagcagaagtaactgttaagcatgaaagttcaagtggtatatggattaatctactcgtatccattgtgccatttggaattctattcttcttcctattctctatgatgggaaatatgggaggaggcaatggccgtaatccaatgagttttggacgtagtaaggctaaagcagcaaataaagaagatattaaagtaagattttcagatgttgctggagctgaggaagaaaaacaagaactagttgaagttgttgagttcttaaaagatccaaaacgattcacaaaacttggagcccgtattccagcaggtgttcttttggagggacctccggggacaggtaaaactttgcttgctaaggcagtcgctggagaagcaggtgttccattctttagtatctcaggttctgactttgtagaaatgtttgtcggagttggagctagtcgtgttcgctctctttttgaggatgccaaaaaagcagcaccagctatcatctttatcgatgaaattgatgctgttggacgtcaacgtggagtcggtctcggcggaggtaatgacgaacgtgaacaaaccttgaaccaacttttgattgagatggatggttttgagggaaatgaagggattatcgtcatcgctgcgacaaaccgttcagatgtacttgaccctgcccttttgcgtccaggacgttttgatagaaaagtattggttggtcgtcctgatgttaaaggtcgtgaagcaatcttgaaagttcacgctaagaataagcctttagcagaagatgttgatttgaaattagtggctcaacaaactccaggctttgttggtgctgatttagagaatgtcttgaatgaagcagctttagttgctgctcgtcgcaataaatcgataattgatgcttcagatattgatgaagcagaagatagagttattgctggaccttctaagaaagataagacagtttcacaaaaagaacgagaattggttgcttaccatgaggcaggacataccattgttggtctagtcttgtcgaatgctcgcgttgtccataaggttacaattgtaccacgcggccgtgcaggcggatacatgattgcacttcctaaagaggatcaaatgcttctatctaaagaagatatgaaagagcaattggctggcttaatgggtggacgtgtagctgaagaaattatctttaatgtccaaaccacaggagcttcaaacgactttgaacaagcgacacaaatggcacgtgcaatggttacagagtacggtatgagtgaaaaacttggcccagtacaatatgaaggaaaccatgctatgcttggtgcacagagtcctcaaaaatcaatttcagaacaaacagcttatgaaattgatgaagaggttcgttcattattaaatgaggcacgaaataaagctgctgaaattattcagtcaaatcgtgaaactcacaagttaattgcagaagcattattgaaatacgaaacattggatagtacacaaattaaagctctttacgaaacaggaaagatgcctgaagcagtagaagaggaatctcatgcactatcctatgatgaagtaaagtcaaaaatgaatgacgaaaaataaccctgagagaggctggagcctctcttttttgtgcagtttaggagctaaagggaacagaatggagaaaatggaacaaatgtgttttctaatctgttagactgtatctagaaaggggaaaattatgattaaagaattgtatgaagaagtccaagggactgtgtataagtgtagaaatgaatattaccttcatttatgggaattgtcggattgggagcaagaaggcatgctctgcttacatgaattgattagtagagaagaaggactggtagacgatattccacgtttaaggaaatatttcaagaccaagtttcgaaatcgaattttagactatatccgtaaacaggaaagtcagaagcgtagatacgataaagaaccctatgaagaagtgggtgagatcagtcatcgtataagtgaggggggtctctggctagatgattattatctctttcatgaaacactaagagattatagaaacaaacaaagtaaagagaaacaagaagaactagaacgcgtcttaagcaatgaacgatttcgagggcgtcaaagagtattaagagacttacgcattgtgtttaaggagtttactatccgtacccactagtaagtcatgcaaaaaaaatgaaaaaaattagaaaaagtagttgacaaagtttgaaaaggctgtataatagtaagagttgaaaataacaactcaggtccgttggtcaaggggttaagacaccgccttttcacggcggtaacacgggttcgaatcccgtacggactatggtatgttgcgtcaggaccacttgatgaaaaaaagtttaaaaaaacttaaaaatcttcaaaaaagtgttgacaagcgaaagcagttgtgatatactaatatagttgtcgcttgagagaagcaagtgacaaagacctttgaaaactgaacaagacgaaccaatgtgcagggcgctacaacgtaagttgtagtactgaacaatgaaaaaaacaataaatctgtcagtgacagaaatgagtaagaactcaaactttttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgttgcatgacatttgcttaaaaggtgcacttgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccata

SEQ ID NO: 21 - DNA, 6273 bp; double-stranded, linear
tgtttttaaagagccgtgtctggatagactttcggacgcaacgctctattagataatgaactgcctatacacaagatttctaaccttagtcgacatgagctgaaacctcttatttgttaagtagttcacaaaatattatacacctattttatgaatagtcaactgtctttacagtaaaattttagaaaatcatgaaaattttctctttctttccattttaagtgacattcagtcattctcacatcaaaaaagcccagacgaaattgtctgagcattcttttatctagtcgtttaaggaagttgagttcagtatgtttaaagtctctgtcccatcatttcttcaacaaaccttgttcttggagaaactccttggctacttgctttgctgacttgccttcaacaccgacttggtagttgagctggctcatctggctttctgtaatcttaccagccaatgtattaagaactctttccaactctgggtgtttcttgagaagagcttctttcatgagtggagccccttgataaggtgggaagagttgcttgtcatcttccaagacctgtaaatcataacgctccaattccgcatcagtcgaataggcatccgtgatttgaatatcccctgactgaatagcctgatagcgaagggctggctcaatggtcgctacattgagattgagaccatacattgattgcaagcccttatttccatcttcacggtcgttaaactcgagtgtaaaacctgccttcaactgcccttccacttttttcaagtctgaaatggtcttcaagccatattcttgagcaatctttttcggaacagctacagcataggtgttttgataagacatgggtttgagataggctagatgatcctgcttagcaatgccatcacgcgccacctgataaacctgttctggttcatgactcaccttgggtgatggttgaagcaaactttcagtcaccgtaccagtaaattcaggatagatgtcaatatcgccttttttcagagcttcataaaggaagcttgtcttcccaaaattcggtttaacagtcgcagtcatgctggtattttcttcaatcagcaacttatacatattggccaaaatttctggttctggacctattttcccagcaataaccaagttttccttctctttttgaaccaaaagagctggactataagacagacccagtaataaagccaccaaggcaaaacctgagaaaatcgtccgtaattttgctttttccatcacttttagtaggaagttaaaggcaatggctagcactgcagaagaaagtgccccaatcaaaatcaaactggcattattacggtcaattcccaaaagaataaaggaacctagtccccctgcaccaatcaaggccgccaaggttgccgtaccgataatcaaaacagctgccgtccgaatcccagacatgataacaggcatggcgagtggaatttcaaatttcttgagacgttcccatctggtcatcccaaaggcaatcccagcctcttgcaggttcggatcaattcccttcagcccagtgatagtattttgcaaaatagggaaaatcgcataaatcactagagctgtcaaagccggcaaggtcccaattcccatcaaagggataaagagccccaacaaggccagagacgggatggtctggaaaatacctgcaatctgcaagacccagtcggccagcttctcatgatagcgaagaaaaacagccaagggaatcgcaagcaaaatagctagtaacaaggtcaaaagcgacaactgcaaatgttgagatagagctgtcaaccaatcactaaaacgatcctgaaaagttgcaattaaattagtcatgaacactacctccaaacaagtctgctacaaagtctgttgcaggcgcttttaaaattgtctcgggattcgctacctggcgaatttctccatcctgcaagacagcaatacggtccgccaacttcaaggcttcatccgtatcatgggttacaaaaatcgttgtcatcccaaactctttatgcaattcttttgtcagaacctgcaactgttttctcgaaatagcatccaaggccgaaaagggttcatccatgaggaaaatcttgggctgaccaatcatagctcggacaataccgacccgttgctgttctccaccagataattcactaggtaagcgatgcccatactcggctactggtaaaccaaccttagccaaaagctcttctgttttcttcgtaatttcttccttgctccaccccttcatttcaggaatgagagcaatattttccgcaactgttagatttggaaaaagagcaatagcctgtaaaacataaccagtagaaagacgaagttcacgctcatcatagtctttgatgcgcttcccatccatataaatatttccatcagttggttccaaaagacggttaatcatcttgagcatggtcgtcttacctgacccagaaggccctactaaaaccataaattccccatcctcaatctgtaagttgacatctctcaagacatccttttctgtgtagcgcagtgctacatttttgtattcaatcattctttgtcctcaatttaaaacttccctcgattggtcaagtcttctaccttaggcataacttccttattatcccaatgctccacaattttcccgttctctaaacggaagatatcgtactgggcataagcaacgccatcaatctgagtctgaccatagctaaccacatagtttccttgtcctaagagttggaaaacaaagtcaaaagtgacactatattcagccacatagtttttataagcagcacttccttgtccaatatcatgattatgctgaatcaaatcgtctgccacataatcactccactgctctagctccccattttggaaaatttctgtcaagaaacggcgaaccagctttttattttctgctttcttatccaaatccttgatttcaaaatctccaaaaatttgatctagttggtcattttcaggtgttcgatagtagtcaatgacatcccaatgctcaacaatacaaccattctcatcctcacggaaagtatccgtcgtcacccattgagcttctccaccattcagatattgatgaacatgaacaaagaccagattgccatcctcaatggtgcggacaatcttaatctgacgctctggatgacgctcaaagaaatctgcaaagaaggctgcaaatccttctttcccgtcaggaacacctgtcgaatgttggatataggtatcccctacagactgggcttgagcctcagcaactcgtccgtcttgaatggcatggatgtataggttgtgagcatttttcacttgttgtgacatattctaaacctcatttcccttctctttcagattcgccaaaattctttcttgaaaaccttcaaattggtgaatttcttcctctgaaaatcctttgtaaaagatagtatccaatttctgactgacacgatgccccacttctttctgggacttgcctaactccgttaaaactaaatacttcttacgcttgtcttttccacacggactaacaattacaagcttttgttcctctagcttttttatcatagtcgtcagcgtattattcgcaagtccagtcgcaagcgcgatatctgtcgcagttgcgcagccagtttcactattccataaaaccgctaaaatcttgccctgttcacccctataaagagcctcaggatcttgactcagtaacttttgaaaaatccgcccattcaacaaacgaatatgatgggctagcaaatgaccatctttcataacacctccaatttatttcgatatcgaaatgaataaaacaattgtaacactcatcgttctaactgtcaactatttcgatttagaaataatttttgataattatccacaccaccatactccggctcaactaacttttaacgagagtttctaaactccttcgtcctccagtctacaaaagccttccattcgtactatcctatattttatgaggggacacatttttcctatcagaccatttattttaaagatagaagtaaatcataattgcttccatctgttcttttatagtatattgaagttagactagagcactgtatcttctaaaacattgatagaaagcgatttgaatttcccaatcaatttgttcgtatttatagcatttcgaaactggaataggacaccatgactgctaaaagatttctataaattcatttaatttcctcaatcaatttgttcatatcttatttcattccgctataatttcaccttaccctatctttttcgtagcacccttcaaacagcctatcccctaccgtttgacgattcctcacttcgctccacttccattacagaagtttcttcactactatgggctcggctgacttctcatgattccttgttactactatttgaacgctcacgagatagatcttacaaaaaatgctttgatccacaatggaatcaaagcattttaaagagttcctcatacataagcgcagaagtcgcagttcctctgtacttggcttcttctcttttgacaaagcgagccaagttgagcaactcaggtgctggatgtttgggatttaggagcaattcacgattgaccaggcctgagagacgaactgcctgcaattgctcatttgtagtaggcagttttttagtagtctctaggagagcagcaactaaatcttcactcaaatcatgtcgagcatgattgtaaagatcttttataaggctttctaggtttggttctaccatccctaccacctcccttatggtttaataatgtttaatcaaatcaaccgttgaacgatccaatttcttcaccaaggcttgtaagaaagcttgcgcttctaggaagtcatccattgcatagagggtttggtgagaatggatataacgagcgcagacaccgatagttgttgatgggacaccaccatttttcagatgagctgcacctgcatctgttccgcctttaccacagtagtattggtacttgataccagcttcttcagccgttgtcaaaaggaaatccttcatccctgggagaagcaagtgacctggatcatagaaacgaatcaaggttccatctccaatcttgccttgaccaccgtagacatcacctgctggtgagcaatcaactgcgaggaagacttctgggtcaaacttggttgtagaggtatgagcgccacgcagaccaacttcttcttggacgttagaacccagatagagttcattgccgagtttttgacccgataaagcttcagctagctcgcttaccatgaggacaccgtagcggttatcccaagcttttgagatgatatttttttcattggctgtcaaaattgcagaactatctggtacaatggtatcaccaggacggatgccaaaactttctgcctcagccttgtccgcaaaaccaccatcaaaaacgatatcggcaatggctggcatggttggtcccccctttccacgagtcaaatgcggaggaacagaacctgaaatcacaggaatttcatgaccatcacgagtcaagagtttgaaacgttggctgctaaccaccatggggttccagccaccgatttctacgacacggaaggtaccatctggcttgatttcgctgaccataaaaccaacttcgtccatatgagaagcgaccaagacgcgcggtgcatccacagcttctgaatgtttgataccaaaaataccacccaagccatctgtcaccacttcatccacatgcggtgtcaacttttcacgaagataagcacggacaggcgcttcatgacctgagactgcagcaagttctgttacttctttaatttttgaaaataatgttgtcatttcagttccttctttctttcatccattttaccactttttataggagaaggatagtgggaaggtggatttctaagttagtatcttagtcctgctctatcttagaaaaggatagtattctcttgcatgtagtgcaaaatctagtaaacattccaaaattaactcgaatatttatttccaaacaaaaaaacaatacaccatcaaagttgtttggatttttcatgaaatttacagaaaatagttgacttccctttcttctttctttaaatatatagttggttgagtttggaatagtacgctgtagctgctaaaacatttctagaaattaatttgactttcctaatagagttgttcatatcttatttcaatttactatagtacaaaactagaaaaggaaaaaatcatgaccagg

SEQ ID NO: 22 - DNA, 28171 bp; double-stranded, linear
acaacctttttcaaaaactcaccttggtacggagatgttttgctttctgctattattttcggttatattcatatcaattttgctttaactcctcttgcttttttcatttatgctagtggaggtcttattttagctctattgtatcgcatgactaaaaatctctactatccaatactagttcatattctcattaatatcactgccttctgggatgtgtggttgctcctattttcaggaagttagcttactaaaataatgtcggaactttccggcattttcttttttcacaaatagtcaacgtttttcttttcgatattgtagtggtgtgtatccagttatttttttgaattgattttgaaaataaggttgacttgagaaaggcagatagtgaagatagttaagaagaataggatgttcttttttcctttttggaaaacttctaaaatatggtataatgaaaagataaagaagttgggggtagaagatgaacattcaacaattacgctatgttgtggctattgccaatagtggtacttttcgtgaagctgctgaaaagatgtatgttagtcagccgagtctgtctatttctgttcgtgatttggaaaaagagttgggctttaagattttccgtcggaccagctcagggactttcttgacccgtcgtgggatggaattttatgaaaaatcgcaagaattggttaaaggatttgatatttttcaaaatcagtatgccaatcctgaagaagaaaaagatgaattttctgttgctagccagcactatgacttcttgccaccaactattacggccttttcagagcgctatcctgactataagaacttccgtatttttgaatcaactactgttcaaatattagatgaagtggcgcaagggcatagtgagattgggattatctacctcaacaatcaaaataaaaaggggattatgcaacgggttgaaaaattaggtctggaggtcatcgaattgattcctttccatacccatatttatctccgtgagggtcatcctttagcccagaaagaggaattagtcatggaggatttagcggatttaccaacggttcgtttcactcaagagaaagacgagtacctttattattcagagaactttgtcgataccagcgctagctcacagatgtttaatgtgacagaccgtgccaccttgaatggtattttggagcggacggacgcctatgcgacaggttctggatttttagatagtgacagtgttaatggcattacagttattcgtctcaaggataacctagataaccgcatggtctatgttaaacgtgaagaagtggagcttagtcaagctgggactctcttcgtagaagtcatgcaagaatattttgatcaaaagaggaaatcatgaaaaaaagagcaatagtggcagtcattgtactgcttttgattgggctggatcagttggtcaaatcctatatcgtccagcagattccactgggtgaagtgcgctcctggatccccaatttcgttagcttgacctacctgcaaaatcgaggtgcagccttttctatcttacaagatcagcagctgttattcgctgtcattactctggttgtcgtgataggtgccatttggtatttacataaacacatggaggactcattctggatggtcttgggtttgactctaataatcgcgggtggtcttggaaactttattgacagggtcagtcagggctttgttgtggatatgttccaccttgactttatcaactttgcaattttcaatgtggcagatagctatctgacggttggagtgattattttattgattgcaatgctaaaagaggaaataaatggaaattaaaattgaaactggtggtctgcgtttggataaggctttgtcagatttgtcagaattatcacgtagtctcgcgaatgaacaaattaaatcaggccaggtcttggtcaatggtcaagtcaagaaagctaaatacacagtccaagagggtgatgtcgtcacttaccatgtgccagaaccagaggtattagagtatgtggctgaggatcttccgctagaaatagtctaccaagatgaggatgtggctgtcgttaacaaacctcagggaatggttgtgcacccgagtgctggtcataccagtggaaccctagtaaatgccctcatgtatcatattaaggacttgtcgggtatcaatggggttctgcgtccagggattgttcaccgtattgataaggatacgtcaggtcttctcatgattgctaaaaacgatgatgcgcatctagcacttgcccaagaactcaaggataaaaagtctctccgcaaatattgggcgattgttcatggaaatctacctaatgatcgtggtgtaattgaagcgccgattggccggagtgaaaaagaccgtaagaaacaggctgtaactgctaaagggaagcctgcagtgacgcgttttcacgtcttggaacgctttggcgattatagcttagtagagttgcaactggagacagggcgcactcatcaaatccgtgtccacatggcttatatcggccatccagtcgctggtgatgaggtctatggtcctcgcaagactttgaaaggacatggacaatttcttcatgccaagactttaggttttactcatccgagaacaggtaagaccttggaatttaaagcagatatcccagagatttttaaggaaaccttggagagattgagaaagtaagaatgaaaaagaaattaactagtttagcacttgtaggcgcttttttaggtttgtcatggtatgggaatgttcaggctcaagaaagttcaggaaataaaatccactttatcaatgttcaagaaggtggcagtgatgcgattattcttgaaagcaatggacattttgccatggtggatacaggagaagattatgatttcccagatggaagtgattctcgctatccatggagagaaggaattgaaacgtcttataagcatgttctaacagaccgtgtctttcgtcgtttgaaggaattgggtgtccaaaaacttgattttattttggtgacccatacccacagtgatcatattggaaatgttgatgaattactgtctacctatccagttgaccgagtctatcttaagaaatatagtgatagtcgtattactaattctgaacgtctatgggataatctgtatggctatgataaggttttacagactgctgcagaaaaaggtgtttcagttattcaaaatatcacacaaggggatgctcattttcagtttggggacatggatattcagctctataattatgaaaatgaaactgattcatcgggtgaattaaagaaaatttgggatgacaattccaattccttgattagcgtggtgaaagtcaatggcaagaaaatttaccttgggggcgatttagataatgttcatggagcagaagacaagtatggtcctctcattggaaaagttgatttgatgaagtttaatcatcaccatgataccaacaaatcaaataccaaggatttcattaaaaatttgagtccgagtttgattgttcaaacttcggatagtctaccttggaaaaatggtgttgatagtgagtatgttaattggctcaaagaacgaggaattgagagaatcaacgcagccagcaaagactatgatgcaacagtttttgatattcgaaaagacggttttgtcaatatttcaacatcctacaagccgattccaagttttcaagctggttggcataagagtgcatatgggaactggtggtatcaagcgcctgattctacaggagagtatgctgtcggttggaatgaaatcgaaggtgaatggtattactttaaccaaacgggtatcttgttacagaatcaatggaaaaaatggaacaatcattggttctatttgacagactctggtgcttctgctaaaaattggaagaaaatcgctggaatctggtattattttaacaaagaaaaccagatggaaattggttggattcaagataaagagcagtggtattatttggatgttgatggttctatgaagacaggatggcttcaatatatggggcaatggtattactttgctccatcaggggaaatgaaaatgggctgggtaaaagataaagaaacctggtactatatggattctactggtgtcatgaagacaggtgagatagaagttgctggtcaacattattatctggaagattcaggagctatgaagcaaggctggcataaaaaggcaaatgattggtatttctacaagacagacggttcacgagctgtgggttggatcaaggacaaggataaatggtacttcttgaaagaaaatggtcaattacttgtgaacggtaagacaccagaaggttatactgtggattcaagtggtgcctggttagtggatgtttcgatcgagaaatctgctacaattaaaactacaagtcattcagaaataaaagaatccaaagaagtagtgaaaaaggatcttgaaaataaagaaacgagtcaacatgaaagtgttacaaatttttcaactagtcaagatttgacatcctcaacttcacaaagctctgaaacgagtgtaaacaaatcggaatcagaacagtagtagaaaagaaggttttagggccttctttttcctatcaactcttttctatttcctgttattcatgttataatggataaatatgaataatcggagtgagactatgaaatacaaacggattgtctttaaggtgggtacttcttctctgacaaatgaggatggaagtttatcacgtagtaaggtaaaggatattacccagcagttggctatgctgcacgaggctggtcatgagttgattttggtgtcttcaggtgccattgcggctggttttggagccttaggatttaaaaagcgtccgactaagattgctgataaacaggcttcagcagcggtagggcaggggcttttgttggaagaatatacaaccaatcttctcttgcgtcaaatcgtttctgcacaaatcttgctgacccaagatgactttgtggataagcgtcgttataaaaatgcccatcaggctttgtcggttttgctcaaccgtggggcaattcctatcatcaatgagaatgatagtgtcgttattgatgagctcaaggttggggacaatgacactctaagtgctcaagtagcggcgatggtccaagcagaccttttagttttcttgacagatgtggacggtctctatactggaaatcctaattcagatccaagagccaaacgcttggagagaatcgagaccatcaatcgtgagattattgatatggctggtggagctggttcgtcaaacggaactgggggtatgttaaccaaaatcaaggctgcaactatcgcgacggaatcaggagttcctgtttatatctgctcatccttgaaatcagattccatgattgaggcggcagaggagaccgaggatggttcttactttgttgctcaagagaaggggcttcgtacccagaaacaatggcttgccttctatgctcagagtcaaggttctatttgggttgataaaggggctgcggaagctctctctcaatatggaaagagtcttctcttatctggtatcgttgaagcagaaggagtcttttcttacggtgatatcgtgacagtatttgacaaggaaagtggaaaatcacttggaaaaggacgcgtgcaatttggagcatctgctttggaggatatgttgcgttctcaaaaagccaagggtgtcttgatttaccgtgacgactggatttccattactcctgaaatccaactactttttacagaattttagaggtaaactatggtgagtagacaagaacaatttgaacaggtacaggctgttaaaaaatcgattaacacagctagtgaagaagtgaaaaaccaagccttgctagccatggctgatcacttagtggctgctactgaggaaattttagcggctaatgccctcgatatggcagcggctaaggggaaaatctcagatgtgatgttggatcgtctttatttggatgcagatcgtatagaagcgatggcaagaggaattcgtgaagtggttgccttaccagatccaatcggtgaagttttagaaacaagtcagcttgaaaatggtttggttatcacaaaaaaacgtgtagctatgggtgtcatcggtattatctatgaaagccgtccaaatgtgacgtctgatgcggctgctttgactcttaagagtggaaatgcggttgttcttcgtagtggtaaggatgcctatcaaacaacccatgccattgtcacagccttgaagaagggcttggagacgactactattcatccaaatgtgattcaactggtggaggatactagccgtgaaagtagttatgctatgatgaaggccaagggctatctagaccttctcattcctcgtggaggagctggcttgatcaatgcagtggttgagaatgcgattgtacctgttatcgagacagggactgggattgtccatgtctatgtggataaggatgcagacgaagacaaggcgctgtctatcatcaacaatgctaaaaccagtcgtccttctgtttgtaatgccatggaggttctgctggttcatgaaaacaaggcagcaagcttccttcctcgcttggagcaagtgttggttgcagagcgtaaggaagctggactggaaccaattcaattccgcctagatagcaaagcaagccagtttgtttcaggtcaagcagctgagacccaagactttgacaccgagtttttagactatgtccttgctgttaaggttgtgagcagtttagaagaagcggttgcgcacattgaatcccacagcacccatcattcggatgctattgtgacggaaaatgctgaagctgcagcatactttacagatcaagtggactctgcagcggtgtatgttaatgcctcaactcgtttcacagatggaggacaatttggtcttggttgtgaaatggggatttctactcagaaattgcacgcgcgtggtcccatgggcttgaaagagttgaccagctacaagtatgtggttgccggtgatgggcagataagggagtaagagatgaagattggatttatcggtttggggaatatgggtgctagcttggcaaaatctgtcttgcagactaggacgtcagatgagattctccttgccaatcgtagtcaagctaaggtagatgctttcattgcagactttggtggtcaggcttccagcaatgaagaaatgtttgcagaagcagatgtgatttttctaggagttaagcctgctcagttttctgaactgctttctcaataccagaccatccttgaaaaaagagaaagtcttcttttgatttcgatggcagctggattgaccttagaaaaactagcaagtcttatcccaagtcaacaccgaattattcgtatgatgcctaatacccctgcttctatcgggcaaggagtgattagttatgccttgtctcctaattgcagggctgaggacagtgagctcttttatcagcttttagccaaggctggtctcttggttgaactaggagaaagtttaatcgatgcagcgacaggtcttgcaggttgtggaccagcctttgtctatctttttatcgaggccttggcagatgcaggtgttcagacaggattaccacgagaaatagcattgaaaatggcagcacaaactgtggtaggagctgggcaattggtccttgaaagtcagcaacatcctggagtattgaaagaccaagtctgtagcccaggcggttcgactatcgctggtgtagcaagcctagaagcgcatgctttccgaggaacagtcatggatgcagttcatcaagcctacaaacgaacacaagaactaggtaaataagaggtagttttgactgcctcttttatggtggctgaaatgagaagacacaaaaagattgtcacaaacccctatttttttgatagaatagaagtagtaaaaaagaaatgagttagacatgtcaaaaggatttttagtctctcttgagggaccagagggagcaggcaagaccagtgttttagaggctctgctaccaattttagaggaaaaaggagtagaggtgttgacgacccgtgaacctggcggagtcttgattggggagaagattcgggaagtgattttggatccaagtcatactcagatggatgctaaaacagagctacttctctatattgccagtcgcagacagcatttggtggaaaaagttcttccagcccttgaagctggcaagttggtcatcatggatcgttttatcgatagttctgttgcctatcagggatttggtcgtggcttagatattgaagccattgactggctcaatcagtttgcgacagatggcctcaaacccgatttgacactctattttgacatcgaggtggaagaagggctggctcgtattgctgctaatagtgaccgcgaggttaatcgtttggatttggaagggttggacttgcataaaaaagttcgtcaaggctacctttctcttctggataaagagggaaatcgcattgtcaagattgatgctagtctccctttggagcaagttgtggaaactaccaaggctgtcttgtttgacggaatgggcttggccaaatgaaacaagatcaactaaaggcttggcaaccagctcagtttgaccgttttgtccgtatcttagaacaagaccagctcaatcacgcctatctcttttcaggtttctttgaaagcttggaaatggcgcaatttttagctaagagcctcttttgtacggataaagttggcgtcttaccatgtgagaaatgccgaagttgcaagctgattgaacagggagaatttcccgatgtcaccttgattaaaccagttaatcaggtcattaagacggaacgcattcgagaattggtgggtcagttttctcaagcagggattgaaagccagcaacaggtctttatcatcgagcaagcggataaaatgcatcccaacgcagccaattctctgctcaaggtcatcgaagaaccccagagtgaagtttatattttcttcttgactagcgatgaggaaaagatgttaccgacaatccgaagtcggactcagatcttccactttaaaaagcaagaagaaaaacttatcttactcttagaacaaatgggacttgttaagaaaaaagcgactcttttagctaagtttagtcaatcgcgagctgaagcagaaaagttggctaatcaggcaagtttttggaccttggtcgatgaaagtgaacgcctgctgacttggttagtagctaagaaaaaagaaagttatctacaggttgccaaattagccaacttggcagatgataaggaaaaacaggatcaggttttacggattcttgaagttctctgtgggcaggacctcttgcaggtaagagtaagagtgattctacaagatttactagaagctagaaaaatgtggcaagctaatgtcagctttcaaaatgccatggaatatctggtcttgaaagaaatataaactcaaaaatgaatgataaagaaaggaaagggctgttttatggacaaaaaagaattatttgacgcgctggatgatttttcccaacaattattggtaaccttagccgatgtggaagccatcaagaaaaatctcaagagcctggtagaggaaaatacagctcttcgcttggaaaatagtaagttgcgagaacgcttgggtgaggtggaagcagatgctcctgtcaaggccaagcatgttcgtgaaagtgtccgtcgcatttaccgtgatggatttcacgtatgtaatgatttttatggacaacgtcgagagcaggacgaggaatgtatgttttgtgacgagttgctatacagggagtaggcatgcagattcaaaaaagttttaaggggcagtctccctatggcaagctgtatctagtggcaacgccgattggcaatctagatgatatgacttttcgtgctatccagaccttgaaagaagtggactggattgctgctgaggatacgcgcaatacagggcttttgctcaagcattttgacatttccaccaagcagatcagttttcatgagcacaatgccaaggaaaaaattcctgatttgattggtttcttgaaagcagggcaaagtattgctcaggtctctgatgccggtttgcctagcatttcagaccctggtcatgatttagttaaggcagctattgaggaagaaattgcagttgtgacagttccaggtgcctctgcaggaatttctgccttgattgccagtggtttagcgccacagccacatatcttttacggttttttaccgagaaaatcaggtcagcagaagcaattttttggcttgaaaaaagattatcctgaaacacagattttttatgaatcacctcatcgtgtagcagacacgttggaaaatatgttagaagtctacggtgaccgctccgttgtcttggtcagggaattgaccaaaatctatgaagaataccaacgaggtactatctctgagttattagaaagcattgctgaaacgccactcaagggcgaatgtcttctcattgttgagggtgccagtcagggtgtggaggaaaaggacgaggaagacttgttcgtagaaattcaaacccgcatccagcaaggtgtgaagaaaaaccaagctatcaaggaagtcgctaagatttaccagtggaataaaagtcagctctacgctgcctaccacgactgggaagaaaaacaataaagggagacaggatgtaataattctgtctgtttctgtttaacttaattagtgatgataatataaagatgtatcacttggtatagaagctttggtattaagttttttattaagcccatacggaataccgatggttggagcagcagttatagcgttcttagaaggtataaatagaaaaataaggtcattttaaatcaaaggattgataaatcagaaagaaggtgattttttgcgaacatacgaaaataaagaagaactaaaagctgagatagagaaaacatttgagaaatatattttagaatttgataatattccagaaaatttaaaagataagagagctgatgaagttgacagaactccagcagaaaaccttgcttatcaggttggttggaccaacttggttcttaaatgggaagaagatgaaagaaaggggcttcaagtaaaaacaccatcggataaatttaaatggaatcaacttggtgaattatatcagtggttcacagatacctacgctcatttatctctgcaagagttgaaagcaaaattaaatgaaaatattaattctatctctgcaatgattgattcgttgagtgaggaagaattatttgaaccgcatatgagaaagtgggctgatgaagcgactaaaacagcgacttgggaagtgtataagtttattcatgtaaatacggttgcaccttttggaactttcagaactaaaatcagaaaatggaagaagatagtattataaattatatttttaactttaaaaaatttcataaaaatggttaccaaaggcgatagaagaaaaactatcgtctttttctttgcaaatttttaagaagggaggtgatcttgcatggactttgaatatttttataacagagaagcggaaagatttaacttcttaaaagtaccggagatattagttgatagagaagaatttcggggcttatcagcagaagcaattatcctttattccatacttcttaaacagacaggaatgtcatttaagaataactggatagacaaggaaggcagagtatttatctattttactgtcgaagaaattatgaaaagaagaaatatctcaaagccaactgccataaaaacattagatgagcttgatgtaaaaaaggaataggactgatcgaaagagtaaggcttggacttggtaagccgaacatcatttatgttaaagactttatgagtatatttcaggtaaaagaaaatgacttacagaagtcaaaaaacttaacttcagaagtaaaagattttaacctcagaagtaaagaaaatgaacttcaagaggttaagaaccttgactctaactatatagagaataataagagtaagtatagtaagagagaatatagttttggtgaaaacggacttggaacatttcaaaatgtgtttttagctgctgaagatatatcggatttacaaatcataatgaactcacagcttgagaattacattagacttcctgcaaaactagaatcctagttcatgattgataatgccagcaatcaaattcattcgtaatccgaagcgtttacgatgatttcgatagattgttgaaaacattttaaacgtttttactttggcaaagatgttctcaatcttgcttctctccttggatagcgcatggttacaggctttatcttcagctgttagcggcttgagtttgctggatttacgtggagtttgtacttgaggatatatcttcatgagcccttgataaccactgtcagacaagattttaccagcttgtccgatatttctgcgactcattttgaacaacttcatatcacgacaatagttcacagcgatatccaaagaaacaattctcccttgacttgtgacaatcgcttgagccttcatagcgtgaaatttctttttaccagaatgattcgctaattctttttttagggcgattgatttttacttccgtcgcatcaatcattaccgtgtcctcagaactgagaggagttcttgaaatcgtaacaccactttgaacaagagttacttcaacccattggctccgacggattaagttgctttcgtgaataccaaaatcagccgcaatttgttcataagttcgatattctcgcacatattgaagagtggccataagaaggtcttctaggcttaatttaggttttcgtccaccttttgcgtgtttaagttgataagctgtttttaatacagctaatatctcttcaaaagtcgtgcgctgaacaccaacaagacgcttaaatcgtgcatcagttagttgtttacttgcttcatcattcatagaactactataccatattttgtttcgcaggaagtctattggaaagtaagaaatattgaagctgaggctattagaagaaattgtgagcgtggtgctattttttcaggtaaaataaaatatcacgaagattcacagtttaaaggagatcactatgttgaatgttatgctgttttagataatacggttatagcaagagatagaataacagtccctatcgatccgttatgtggaaaagattttatagagtagcatataattgattcttaactggaatactcactatctctttacatcaagaaaatgactaaacagggaagtttgccttcttccctttttttgttatactagtagaagaaaaaattagaaagatttgtgggtgtcaaacagcccagtggggtgttttaatatggacttaggtcccacccaaagaggtattagtgtcgtgtctcaatcttatatcaatgttatcggtgctggtttggcaggttctgaagcagcttaccaaatcgcagagcgtggtattccagttaaactatatgaaatgcgtggtgtcaagtctacaccccagcataaaacagacaattttgctgagttggtttgttccaattctttgcgtggggatgctttgacaaatgcagttggtcttctcaaggaagaaatgcgtcgcttgggttctgttatcttggaatctgctgaggctacacgtgttcctgcaggtggtgcccttgcagtggaccgtgatggtttctctcaaatggtgaccgaaaaagttgccaaccaccccttgattgaagtggttcgtgatgaaattacagaattgccgacagatgttattacggttatcgctactggtcctttgacaagtgatgccttggctgaaaagattcatgctcttaatgacggtgctggtttttatttctacgatgcggcagcgcctattatcgatgtcaacactatcgatatgagcaaggtctacctcaaatcacgttatgataagggagaagcggcctacctcaatgcccctatgaccaagcaagaatttatggatttccatgaagctttggtcaatgcagaagaagcaccgcttagttcttttgaaaaagaaaagtactttgaaggatgtatgcctatcgaagtcatggccaaacgtggcattaaaactatgctttatggccctatgaagccagtcggtcttgagtacccagacgactatacaggacctcgtgatggagaatttaaaacaccttatgcggttgtgcaacttcgtcaggataatgcagctggtagcctctacaatattgttggtttccagacccacctcaaatggggagaacaaaagcgtgtcttccaaatgattccgggtcttgaaaatgcggagtttgtccgttatggtgtgatgcatcgcaattcttacatggattcaccaaatcttcttgagcagacttaccgttctaagaaacaaccaaatctcttctttgctggtcaaatgacgggtgtggaaggctatgttgagtcggcggcttcaggcttagttgcgggaattaacgcagctcgtctcttcaaggaagaaagcgaggctattttccccgagacgacagcgattggaagcttagctcattacattacccatgccgacagcaaacatttccaaccaatgaatgtcaattttgggatcatcaaggagttggaaggcgagcgtatccgtgataagaaggctcgttatgaaaaaattgcagagcgtgcccttgccgacttagaggaatttttgactgtctaatttttttgaaagaattgctcatgatactataaaaatcttagaaattgtgataaaataggtaggatgaaagaaggagagtgaaaatggcgaatcccaagtataaacgtattttaatcaagttatcaggtgaagcccttgccggtgaacgtggcgtagggattgatatccaaacagttcaaacaatcgcaaaagagattcaagaagttcatagcttaggtatcgaaattgcccttgttatcggtggaggaaatctctggcgtggagaacctgcagcagaagcaggtatggaccgtgttcaggcagattacacaggaatgcttgggactgttatgaatgctcttgtgatggcagattcattgcaacaagttggggttgatacgcgtgtacaaacagctattgccatgcaacaagtggcagagccttatgtccgtggacgtgcccttcgtcaccttgaaaaaggccgtatcgttatctttggtgctggaattggttcaccttacttctcgacagatacaacagcggcccttcgtgcagctgaaatcgaagcagatgccatcctcatggctaaaaatggtgtcgatggtgtttacaatgccgatcctaagaaagataagacagctgttaagtttgaagaattgacccaccgtgacgttatcaataaaggtcttcgtatcatggactcaacagcttcaaccctctcaatggacaacgacattgacttggttgtattcaacatgaaccaaccaggcaacatcaaacgtgtcgtatttggtgaaaatatcggaacaacagtttcaaataatatcgaagaaaaggaataagaaagaatatggctaacgcaattattgaaaaagctaaagagagaatgacccagtctcaccaatcacttgctcgtgaatttggtggtatccgtgctggtcgtgccaatgcaagcttgcttgaccgtgtacatgtagaatactatggagtcgaaactcctcttaaccaaatcgcttcaattacgattccagaagcgcgtgttttgttggtaacaccatttgacaagtcttcattgaaagacatcgaacgtgccttgaacgcttctgatattggtatcacaccggctaatgacggttctgtgattcgcttggttatcccagctcttacagaagaaactcgtcgtgaccttgctaaagaagtgaagaaggtcggcgaaaatgctaaagtggctgtccgcaatatccgtcgcgatgctatggacgaagctaagaaacgagaaaaagcaaaagaaatcactgaagacgaattgaagactcttgaaaaagacattcaaaaagtaacagacgatgctgttaaacacatcgacgacatgactgctaacaaagagaaagaacttttggaagtctaaaaataaacagaaaaactcagttggcattgctggctgagttttattcgaaagaaggaaatatgaatacaaatcttgcaagttttatcgttggactgatcatcgatgaaaacgaccgtttttactttgtgcaaaaggatggtcaaacctatgctcttgctaaggaagaaggccaacatacagtaggggatacggtcaaaggttttgcatacacggatatgaagcaaaaactccgcctgacaaccttagaagtgactgccactcaggaccaatttggttggggacgtgtcacagaggttcgtaaggacttgggtgtctttgtggatacaggccttcctgacaaggaaatcgttgtgtcactcgatattctccctgagctcaaggaactctggcctaagaagggcgaccaactctacatccgtcttgaagtggataagaaagaccgtatctggggcctcttggcttatcaagaagacttccaacgtcttgctcgtcctgcctacaacaacatgcagaaccaaaactggccagccattgtttaccgtctcaagctgtcaggaacttttgtttacctaccagaaaataatatgcttggttttattcatcctagcgagcgttacgcagagccacgtttggggcaagtattagatgcgcgcgttattggtttccgtgaagtggaccgcactctgaacctctccctcaaaccacgctcctttgaaatgttggaaaacgatgctcagatgattttgacttatttggaaagcaatggcggtttcatgaccttaaatgacaagtcatctccagacgacatcaaggcaacctttggcatttctaaaggtcagttcaagaaagctttaggtggtcttatgaaggctggtaaaatcaagcaggaccagtttgggacagagttgatttagggaggcttatgagaaaatcattttacacttggctcatgaccgagcgcaatcctaaaagtaacagtcccaaagcaattttggcagacctcgcttttgaagagtcagcctttccaaaacacacagatgattttgatgaggtcagtcgctttttggaggagcatgccagtttctcttttaacctaggagattttgacagcatttggcaggaatatctagaacactagcatttattcattgggtttgggctagtaatttctccatccctctgctataataaaaagaaataaaaggattagagaggttctttatttgaaggaacattcaatagacattcaactgagtcatccagatgacctgtttcatctttttggttccaatgaacgccatcttcgtttgatggaagaagagcttgatgttgtgattcatgctcgtacggagattgtccaggttttgggagaagagtctgcctgtgaggaagcccgtcaagttattcaggctttgatggtcttggtaaatcgtgggatgaccgttggtacgccagatgtagtcactgcgattagcatggtcaaaaatgatgaaattgacaagtttgtcgccctttacgaagaagaaattatcaaggataatactgggaaacctatccgtgtcaaaaccctagggcaaaagctttatgtggacagtgtcaaacagcatgatgtgacctttggaattgggccagcaggtacagggaagaccttccttgcagtgaccttggcagtgactgcccttaaacgtgggcaagtcaagcgaattatcctaactcgtccagcggtggaagcgggagagagtcttggatttcttccgggtgatcttaaggagaaggtggatccttaccttcgtcctgtttacgatgccttgtatcaaattcttgggaaagaccaaacgactcgtctcatggagcgtgaaattatcgaaattgcgccccttgcctatatgcgtggccggaccttggatgatgcctttgtcattctcgatgaggcgcaaaacacgaccatcatgcagatgaagatgttcttgacgcgtttaggttttcattctaagatgattgtcaatggagatattagtcagattgacctgccacgtaatgtcaagtccggtttgattgatgctcaagagaaactcaagaacatccatcagattgactttgttcatttttcagccaaggatgtggttcgccatcctgttgtcgctcagattatccgagcctatgaatattctactgaagttgcacacgactgattttgaggaagttcgcctgcaaaagaatagacttgttcggtaactgtaaaaagtgttatactatttttatggaaacagtatacgacaaagcacaaaaacttaactcaaaaaacttcaaactattgattggtgtcaaaaaggaaacctttcaactcatgctagaacacctgaattcagcctatcagattcagcaccgaaaaggtggacgtccacgtagtctgcccatggaagaccagctcattatgaccctccgttacttgcgatattatcccactcagcgtctgctggcctttgattttggcgtcggtgtagctacggtaaatgccatcatcacttgggtggaggatacacttcgtgcgtcaggtagctttgatttggaccatttagaagccccgagtgctgctgtggctattgacgtgaccgaaagtccgattcagcgtccaaacaaaaccaaagcaaaaattattctggtaaaaagaaacgacacaccttaaaaactcaaattatgctggatttgacgacacataaagtctgtcaaatggccttttctgacggacatacgcatgattttactctcttcaaagaaagtattggacaaagtttgcctgaaacgacgcttgcctttgttgacctaggttatttaggcatcttgaaatttcatgagaatactttcattcctgctaaaaattccaaaaatcgccgcctgagtgaggatgataagcagttaaataaagagatgtcagcgatacgaattgaaattgaacattttaacgctaaattcaagaccttccaaatcatgtcagtcccttatcgtaaccgcagaaaacgtttcgagttacgggcggaattaatttgtgccatcatcaattatgaagtgaactagattccgaacaagtctaatatacttttgagagaggaaaatccagttgtataggctaaaggttttatccaaaggtctgagacaacgattaggcacgatggaaagaacttttatgtggctgatgacgatcagtgcatcttcctgtgtcataatcacagggcacaagaaagtaggaatttgaaaagatgattgaccaactatctaagtattacagttgtaggatactaactgaaaaggatattccaagtattttatctttatatgaaagtaatcctctgtattttcagcattgtccaccagagccaaattttgcaactgtaaaagaggacatgctttgtctacctgaaggtaaagctaaggctgataagttttttgttggattttggaatggatctgaccttgtggctgttatggattttgtctatgcatatcctgatgaggagactgtttttattggtttgtttatggttgatcaagcctatcagagaaaagggattggtagtcatattgtgacagaagcactagcttattttgctaagaactttcgaaaggcacgtttggcttatgttaagggaaatccgcaatctcagcatttttgggaaaagcagggctttaaatcaattggatgcgaggttaagcaagaactctatacggttgttatcgctgaacagagcctagaagattagaaatggcatcaagtaagaactatttggaatttgttttggaacaattatcaggattagatgatgtgacttaccgttccatgatgggggagtatattctttacttccgcggcaagattattggcggcatttatgacgatcgctttttagttaaacccgtgcaagcagtcttagataagattgaccaatcttcttttgagtttccatacaaaggtgccaaagaaatgatttgagtggaagaacttgataataagatgtttctataagacctaattttagctatgtataaccaactgccaacgcccaaacctaaaaagaaaaagcaagggtgaacgaagtaaaaaagaagtctgctaaggccctgtctttgcacgggtaaaattttatatataaaaagaagctgggactaaagagctcagcttcctttggtttatataattgtcattacaagacgaagtggttgggcgaaactctgttgactttattcaatttagagtttcttatgcacaattgagtctggaacgaaagtctccagttgcaaagtatacagtacaataaaccaacgatgtaatagctgatgacacaaagcacagtgggtaggacttgcgaagtcacccttttcttttcaaaatttatactaaatcattgatatcagtgtagtcacgattaagtccttgagcaactggtaggttagtcaagtaaccttgataagtagtcacaccttgacgcaagccttcatcttcagagattgcttgtgcgaatcctttgccagccaaagcttcgatataaggaagagtgacattggttagggcgatggttgaagtgcgagcaaccgcaccagggatattggcaacggcatagtggagaacaccgtgtttttcatagacgggttcatcgtgcgttgtcacacggtcagctgtttcgataacgccaccttggtcaacagcaacgtcaacgatacagagcctggacgcatttgtttgaccatctcatctgtcaccaattccggtgcttttgcaccagggatgagaatggctccaatcaccacatcagcatctctcacacttgcttcaatgttgaatgaattagacataagagtttgaatttgacttccaaagacttcttctagaactgagagacgcttggaactaatatctaaaatagtcacttgagcaccaagaccaagggcgatgcgggcagcatgtgtaccgacgacaccaccaccgatgatagttacttttccttttggaacacctggtacaccaccaagtagaacaccagagccaccagcttgcttagtaaggaagtgagctccgatttgaacagccatacgacctgcaacctcactcataggaacgaggagcggtagttgtccttgattgtcacgaacagtttcagttgtttttgctgttaacatagcatctgctaattctggagcagcggccatgtgcaagtaggtgaagagaagaagatcgtcgcgcaagtaaccgtattcagaacttaaagattcttttactttcacaaccaactctgctgcccaagcttcaccagcagtagcgacaatctcagctccttgcttttgatagtcagcatcagtaaagccagaaccgagaccagcatttgtttcgataaggacacgatgaccacgactaactaagctatgaacacctgcaggtgtgagggcgacacggttttcgttatttttaatttcttttgggattccgattaacattgagataacctacctttcaattgacggtcttgttttggttgtcacattccagttcataaatcaaaaatgtgacggtttcattgtatatgaaaccgcttcaaaaatcaagaaaaacttgtcatccaaatttttttatgctagactagtgaaaatcaagctctaatggagggaaaagtatggaatcaatatttgtgaaatttgcccagtatccgtctatagaaacggagcgtttattgctcagacctgtaactttggatgatgcggaacaatgtttgactatgcctcggacaagggtaatacacgttacacttttccaaccaatcaaagcttggaagaaaccaagaataacattgctcagttctacttggctaatcccttgggacgttggggaatagaactaaaaagcaatggtcagtttattggaaccattgacttgcacaagattgattctgttcttaagaaggcagctattggctacattatcaataaaaagtattggaatcaaggattaacgacagaagccaatcgtgctgtgattgagctagcttttgagaagatagggatgaataagttgactgcccttcacgataaggctaatcccgcgtcaggaaaggtcatggagaaatcaggcatgcgtttttcccatgcagaaccatatgcttgtatggaccagcatgaaaaaggccgaatcgtgacaagagttcattatgtcttgaccaaggaagactattttgcaaataaataagcagttgaaaagaaatttttcgactgttttttcttcctcttacgaataatctaagagaggagaaaatatggaagcaattatcgagaaaatcaaagagtataaaatcatcgtcatctgtactggtctgggcttgcttgtaggaggatttttcctgctaaaaccagctccacaaacacctgtcaaagagacgaatttgcaggctgaagttgcagctgtttccaaggactcatcgaccgaaaaggaagtgaagaaggaagaaaaggaagaaccccttgaacaagatctaatcacagtagatgtcaaaggtgctgtcaaatcgccagggatttatgacttgcctgtaggtagtcgagtcaatgatgctgttcagaaggctggtggcttgacagagcaagcagacagcaagtcgctcaatctagctcagaaagttagtgatgaggctctggtttacgttcctactaagggagaagaagcagttagtcaacagactggttcggggacagcttcttcaacaagcaaggaaaagaaggtcaatctcaacaaggccagtctggaagaactcaagcaggtcaagggactgggaggaaaacgagctcaggacattattgaccatcgtgaggcaaatggcaagttcaagtcagtagacgagctcaagaaggtctctggcattggtggcaaaacaatagaaaagcttaaagactatgttacagtggattaagaatttctctattcccctaatttacctgagttttctattactttggctttattacgctattttctcagcatcttatcttgctttgttgggctttgtttttctgctagtctgtctctttatccaatttccgtggaaatctgctggtaaagttctaataatttgcggaatctttggattttggtttgtttttcaaaattggcaacagagtcaagcgagtcaaaatctggcggattctgttgaaagggtacggattttgcctgatactattaaggttaatggtgatagtctatcctttcgtggcaagtctaacggtcgtgctttccaagtctattataaactccagtccgaggaggagaaagaagcctttcaagctttaactgacctgcatgagataggactagaagggaagctttcggagccagaagggcagagaaattttggtggctttaattaccaagcctatctgaagactcagggaatttaccagactctcaatatcaaaacaatccagtcacttcaaaagattggcagttgggatataggagaaaacttgtccagtttacgtcgaaaggctgtggtttggattaagacgcactttccagaccctatgggcaattacatgacaggactcttgctgggacatctggacaccgactttgaggagatgaatgagctttattccagtctaggaattatccacctctttgccctatctggcatgcaggtaggttttttcatgaatggatttaagaaacttctcttgcgattgggcttgacccaagaaaagttgaaatggctgacttatcccttttcccttatctatgcgggactaactggattttcagcatcggttattcgcagtctcttgcaaaagctactggctcaacatggggttaagggcttggataattttgccttgacggtgcttgtcctctttattgtcatgccaaactttttcttgacagcaggaggagtcttgtcctgcgcttatgcttttatcctgaccatgaccagcaaagaaggggaggggctcaaggctgttactagtgaaagtctagtcatctccttgggcatattgcccattctatccttctattttgcggaatttcaaccttggtctatccttttgacctttgtcttttcctttctttttgacttggtcttcttaccgctcttgtctatcttatttgtcctttcctttctctatccagtcattcagctgaactttatctttgaatggttagagggcattattcgcttggtctcgcaggtggcaaggagaccacttgtctttggtcaacccaacgcatggcttttaatcttattgttaatttccttggctttggtctatgatttgaggaaaaacattaaaggattaacagtattgagtttattgattacaggtctctttttccttaccaagtatccactggaaaatgaaatcaccatgctggatgtggggcaaggagaaagtattttctacgggatgtaactgggaaaaccattctcatagatgtaggtggtaaggcagaatcttataagaaaatcaaaaaatggcaagaaaagatgacgaccagcaatgcccagcgaaccttgattccctatctcaaaagtcgaggagtagctaagattgaccagctaattttgactaacacggacaaggagcatgttggagatttgtcagagatgaccaaggctttccatgtaggggagattctagtatcaaaagacagtctgaaacagaaggaatttgtggcagaactacaggcgactcaaacaaaggtgcgtagtatgatagtaggggagaacttgcccatttttggaagtcagttagaagttctatctccaaggaaaatgggagatggaggacacgatgataccctagttctgtatgggaaattcttggataagcaatttctcttcacgggaaatttggaggagaaaggagagaaggacttgctgaagcactatccagacttgaaagtaaatgttttgaaagctagccaacatggcaataaaaaatcatcaagtccagcctttctagaaaaactcaaaccagagcttactcttatctcagttggaaagagcaatcgaatgaaactcccccatcaggaaacattgacacgactggaaggtatcaatagcaaagtttatcgaactgaccagcaaggagctatacgttttaaggggttggatagttggaaaatcgaaagtgttcgataggaaggataaatgttgtagattagtgaaataaactaaaaatttgttgcataataatgataaaaatggtataatgaaaacgtattcaatattgaggatataaaatcattaaaaatcagcaaaagttgttttattagttagtttataatctattggtcttcttcagtccagtgtatctgctgtgacagtcactaaaagttacaagtatgattggaatacggtttgggaatatagtaccaactatcacgaccatcagtatgcttggattccgtcatggtctcgttatgacagctattctgagtataaagttggcggaggctggaactacgctcgttatgaggtcataaactattacagcggaggctattaattcttaaagagtgagaaaaaggagggctagatatgttgcagcttactcatgtgaccttaaaaacgcgacaagtcatcttgcaagatgtggatttcacctttaaaaagggtagggtttatggtcttcttgctatcaatggctctggaaagacgaccctgttccgtgccattagcaatttaattcccataagtagtggaaatatcgcagcccctccttctttattttattatgagagtattgaatggctggatggaaacttaagtgggatggactaccttcgtcttatcaaaaacatctggaagtcaggtctgaacttgagggatgaaatcgcctattgggaaatgtctgactatatcagtcttcccattcgcaagtattccttaggcatgaagcaacgcttggtgattgccatgtatttcctcagtcaggccaaatgctggctcatggatgagattacaaatggcttagatgagtattatcgacagaagttttttgataggctagcacaaatcgatagacaagaacagctggttcttttaagttcccactataaggaagagttggttgatgtctgcgatagagtagtaaccattcatcaggggcagatagaagaggtttagtttatgaaagatgttagtctatttttattgaaaaaagttttcaaaagccgcttaaactggattgtcttagctttatttgtatctgtactcggtgttaccttttatttaaatagtcagactgcaaactcacacagcttggagagcaggttggaaagtcgcattgcagccaacgagagggctatcaatgaaaatgaagagaaactctcccaaatgtctgataccagctcggaggaataccagtttgctaaaaataatttagacgtgcaaaaaaatcttttgacgcgaaagacagaaattctgactttattaaaagaagggcgctggaaagaagcctactatttgcagtggcaagatgaagagaagaattatgaatttgtatcaaatgacccgactgctagccctggcttaaaaatgggggttgaccgcgaacggaagatttaccaagccctgtatcccttgaacataaaagcacatactttggagtttccgacccacgggattgatcagattgtctggattttagaggttatcatcccaagtttgtttgtggttgctattatttttatgctaacacaactatttgcagaaagatatcaaaatcatctggacacagctcacttatatcctgtttcaaaagtgacatttgcaatatcctctcttggagttggagtgggatatgtaactgtgctgtttatcggaatctgtggcttttcttttctagtgggaagtctgataagtggttttggacagttagattatccctacccaatttatagcttagtgaatcaagaagtaactattgggaaaatacaagatgtattatttcctggcttgctcttagctttcttagcctttatcgtcattgtggaagttgtgtacttgattgcttactttttcaagcaaaaaatgcctgtcctctttctttcactcattgggattgttggcttattgtttggtatccaaaccattcagcctcttcaaaggattgcacatctgattccctttacttacttgcgttcagtggagattttatctggaagattacctaagcagattgataatgtcgatctaaattggagcatgggaatggtcttacttccttgcctgattatctttttgctattgggaattctatttattgaaagatggggaagttcacagaaaaaagaattttttaatagattctagctttcctataggtagggaaaataagtaaaaactaacatagagagggaatcaacttgattctctctttttgattcgaaaaccaaaccaaaatacaaacacaaacttttcaaaaaataactttttatcttgacaagagctagaaaacttggtatcatataaaagttgagaaaagcagaagtgagagcttctcgccttgtgacattaagttgcctggccctacggatgaaaagtttcgaagaaacgctatcataacgtgcgggcttgtatatttacaagtccgctattgtttttctctaataaaacaaaagaggtgaaaaccatagcaaagcaagacttattcatcaatgatgagattcgtgtacgtgaagttcgcttgattggtcttgaaggagaacagctaggtatcaagccactcagtgaagcgcaagctttggctgataacgctaatgttgacctagtattgattcaaccccaagccaaaccgcctgttgcaaaaattatggactacggtaagttcaaatttgagtaccagaagaagcaaaaagaacaacgtaaaaaacaaagcgttgttactgtgaaagaagttcgtctaagtccgg

SEQ ID NO: 23 - DNA, 7147 bp; double-stranded, linear
ccgctcaacttttgcaatcaaggctaagtagacagcagcaaatttcatattgtataatttctgactcatacttctctctttctatgtgtactagtataaataagaaaaagaaggccgtcaagccttcttttgatttattcttctgcttcatcttctgtaaattgactattgtacaagtcagcgtagaagccaccttgcgccatcagttcctcatagttgccttgctcgatgatatttccatctttcatgaccaagatcaagtctgcatttcggatggttgacaagcggtgggcaatgacaaaggatgtgcgtccttccatcaaacggtccatggctttttggatcaattcctctgtccgtgtgtcaacagaagaagtcgcctcatccaaaatcaaaagcggtgcatccttaagaagggcacgagcaatagtcaatagttgtttttgtcttacagacaaggtcacggtgtcatccaagatggtatcatagccatctggcaaggtcataataaagtggtgaattcccacagccttactagcttccatcattcgttcatcactaatccctatttgattatagatgagattgtctcgaatagttccttcaaagagccaggtatcctgcaagaccattgaaaaggcatcatgcacttctgaacgcgtcatagccttggtatccacaccatcaatgcgaatacttcccttatcaatctcatagaatttcatcaaaagattgacaatggttgtcttaccagccccagtcggcccaacaatggcaaccttttgaccagcatgagctgtcgcagagaagtcatagtcttgaacattgacaccgtccaccagaatttctcctgctgacacgtcgtagaaacgtggaatcagattgaccagagttgatttaccagaacctgttgacccaataaaggccactgtttgaccagtttctgctttaaagctaacatgttcaataactgcctccgaatttgccgcatagcggaaggtcacatccttaaactcgacctgacctttgaagttttcatcagtcagctgcacttgaacagggttttggatagaagaatgcaaatctaaaacttgattaatccgcttagcagagaccatagttcggggaagaacgatgaagagtgctcccatgagaaggaagcccatgacaacctacatggcataagacatgaaaacaatcatgtcactaaagagaggcagacgcgctatcggagcagcgtcgttaatcacataggccccaatccagtaaatcgccacactcaaaccacttgaaatccccatcatgataggattcaaaatagccataagacggttgacaaacaaattcaaacgggtcaattcatcatttactgctgcaaatttttcattttgataatcctctgcattgtaggcacgaacgacacgaatacctgttaaactctcacgagtgatactgttcagtttatctgtcagcccctgaatcaaggactgttttggaaaggctagcgtcatcaaaacggtcgtcatcaggacgttgataatcactgccacaagtacggcccagagccagtattctgaatgacctaaaatcttcccaatagcccagatagccataattgaaccacgcgttaccacttgcaagcccatagtaatcaacatttgaacttgagtaatgtcattggtagtacgcgtcaagaggctaggaattgaaaatttcttaatctctgtctgcgagtaatccaaaactcggttaaaaatatcacttctcagcctactagtataagaagccgccactcgggatgcaaaaaatccaactgcaactacggacaagaaggcaagaaaggacattcccatcatcatgcttgccgactgccacaactcatctaaattagtttcttgactacctagcaaatccgtaattttcgagatataggtcggcacttccaactctagatagaccgaaaagcaagtaaagagaatggctagtaaaatcatcccccattcttttctactaattcttttggctaatttctttattctctcctcctattcccttgatattttgcctgtagttgaccgagaaccttctcaaaaatcagtaattcatcttcatcaatgtcttccatcaactgcttgtctatgcgttcaaaaaaagccttaacctgttgcatctgagaacgtgctttgtccgtcagacgaacaaacttagcccgcttatcaacaggactcgcctccaattccaccaaaccattttgcactatacgcttaaccagattactagcaacaggcttggtaatattgagttcctgctcgatatctttaatcaagaccaagtcttggtttttctcgcgattatccaaaaaacgcacaacctgaccttgcggcccacccataaattcaatgccgcaacgtttggcttccttttgcaccatcaggtgaatttgatgaccaaaacgcttaaagactaacatcggtttatccataatctcccccttctaaataaaaatagttctctggagaataattaaatttctatgagaactattttcttgattaaaaaaatcccaagtgattttctcacttaggatcatgttctataggttaaattaaaacccatctacgttcgtataaatcttttggacgtcttcgtcgtcttcaagaacgctgtaaagtttttcaaaggtttcaaggtcttcgcctgacaattccacttctgactgaggaatcatttccaattcagtcacttggaattcttcaataccagactcacggagggcaacgatagccttgtgaaggtcagttggcgctgtgtaaactgtgattgtaccttcttgtgcttctacgtcatccacatccacatccgcttcgagcaattgctcaaagactgcgtccgcatcttcacctccaaatacaataacacctttgttgtcaaagaggtaagaaacagaacctgaagcgcccatgtttccgccgtttttaccaaaggctgcacggacattggctgctgtacggttgacgttagaagtcaaagtatccacaattagcatagagccatttggcccaaaaccttcgtaacgtccttctgtaaaggtttcgtctgtgtttcctttggctttatcaatcgctttatcgataatgtgttttggcacttgggcttgtttagcacggtcgataacgaatttcaaagctgagtttgattctggatctggatcaccttttttagctgctacatagatttctacaccaaattttgcatatactttagagttagctccatctttagccgttttcttggctacgatattggcccatttacgtcccattaggaatctccttttttcacattttaatctttcttattataacacaagtttttttgattttcactagaggaaatggattttattagcaaatcaagctaggatagcactttacctgctaagatggtcttgcctttctatctttatcaacaggcactcatccacattcaaaaaacaaactagaccattatctgcaaatagaaagtttcagccaagtttgacaaagtcagctcaaattactgtttgaagtttgtagatataagcgacaaaaacaatcatactgcaccttttgttgacagtctactccagacatatcatagttcaagtaaatactttgaaattcaacagttcttataggcgctattgtattctaagaaatcaatagaagagtttctaagcaaacctctaatactcaataaaaatcaaagagcaaactagaaagctagcctcaggttgctcaaaacactgttttgaggttgcggatggggctgacatggtttgaagagattttcgaagagtataatttacgtgttcccaagatggagaagttagactagtacactggcacttctaaaacattgctagcaattgatttgttcatatttaatttcattttttccataaatgggtattagatataaacagcaaaatatttccgatacgtgtcgttcttgaatttccaatcatctaaaacaagtaaaggataatcaatcccctgtatatcaaggaattggctaccctttttacttttttacacattctgtttgatagattcattttaacatcacgagcatactccaatggaaatcgctaggcaagagataaactttcagatatccgcagagagatcatcgcctctttttgtcgcaagcattctcctctcctagtcattttctaccttatcttctacctgaggatagagagttgttccccaaatagaaatcgtccgcttacgcactagtggcaaatcggttttttcataaaccgtacgccaccattcccaggcaagcccggtacactctctaattttgacagagagattacgaacattcccttttaaaggaatactagtggtaaagtgagccgttaaatcctgcccatttctgtcccaagccttaggagtcaagacttccttaccttgatgatcataggataattcattccaagtaatataatattgggcaacataggcaccactatgatccagcagtaaatctccgtttctgtaagctgtaaccttagtctcaacatagtctgtactattttgaaaggtcgcaactacattgtcacgtaaaaaagaagttgtataggaaatcggcaagcctggatgatctgctgtaaagcgactgccttcttgaatcaagtcctctaccatatccaccttgcctgttacaactcgggcacccgaacttgggtcgccccctaaaataaccgccttcacttctgtattgtccaaaatctgtttccactctgtctgaggagctaccttgactccttttatcaaagcttcaaaagcagcctctacttcatcactcttactcgtggtttccaacttgagatagacttggcgcccataagcaacactcgaaatatagaccaaaggacgctctgcagaaattcctctctgttttaaatcctctaccgttacagtatcttgaaacacatctcctggatttttaacagcatctacgctgactgtataataaatctgcttaaaattaacaatctgaatctgcttttcgcctgaatggacagagttaaaatcaatatcaagagaattccctgtcttttcaaagtcagaaccaaacttgaccttgagttgttccatgctgtgagccgtgattttttcatactgcattctagctgggacattattgacctgaccataatcttgatgccacttagccaacaaatcgtttaccgctccgcgaacacttgaattgctggggtcttccacttggagaaagctatcgctacttgccaaaccaggcaaatcaatactataagtcatcggagcacgatcgaccgcaagaagagtgggattattctctaacaaggtctcatccactacgagaagtgctccaggatagaggcgactgtcgttggtagctgttacagaaatatcacttgtatttgtcgacaagctccgcttctttctttcgataacaacaaactcatcgggtagctgattaccctctttgatgaaacgattttcaatactttctccctgatgggtcaagagtttctttttatcgtaattcatagctagtataaagtcatttactgctttatttgccatcttctacctcctaataagttcctggattgagttgcataaactcagacttgttcagcgaaatcagccgtggttggactaagtaatccaaaatttcctcgtacaattcttctgagacattgcgtcgccgtctggctaaataagaagtcggaatgaccgtattatccaacataaataccttatctaagtcaatcaaggttggtcttgtaaaaggattacgagctagatccggctcttctatcataaagttcttgaccaaacgtctggtcaagagagctggtttgaaggtctgatttttaaccaactctttgtttttagtcatgctgttgtcaatacagatatacatatgattcttcacagccaaatcgctactaatagtcggaaaaggcaaataaagagctacaacatctcctctcttaatcaagcaagagcacccccttttctcctaatgtaacatagacaggattgaccaagtcttctgattgactcagaatttccaaagtttgagtttggcgcgctgtcaatttagtagcatcttgtctcttcaatacaaaatgcttgtcgccaataaccttgacaatataatccttctccaaagctgactggtaaatccacatcagatgttgtctgtcctgagaactcaagagagaaggattttcaagcctcccgatagtctgataaaaatcaaaaacaggagctaactcctgccaatctgattggctagttgtcaaggctagaaaaagggctttgcgagctgatacttcttggttagccttgagagttactttcccctccaagttttttagaaatcgggaaactccagaaagcaaatttttctctaactgcgagaaataaaaacctttcgttcccagacataagtctttcatgtcgctttctctagcaaataagagctcaaacatttgatagtaaaagaaaaatatctggcactgggtcgcgctcatcttttccttatcggcttctttttttaaccagagcaagggcgacaggtagctggattgagacatttcctctacctcctactcttttttaactggagcatctgcactagctgccacttcttttgactggatactttcccactggttaatctcctctgagataagaccttcgcatgtcttgacaaatagggcaaaagccttggtctttcctgcatatttctccgtttggcattgatagaggaatttttctttctccaggagttgcgcagttttttggtaagaaatccaattttcctttgcattatacaaattgataatcccctcacacagcaagccgagactggataaggcaaccgaaatcaaacggtagcgatcacctggcataggaatagcacaaaagacagctatgaggaaacctgccacgatttctgttatttttaataccttatagcgcctacgatgttgaacgcttttctttaaaaaatgagctatctgtacgtctaatcgctctgtcaggtacatttcttctggcgtcatattcgtaactcctttcatttactttgataatcaggg

SEQ ID NO: 24 - DNA, 755 bp; double-stranded, linear
ccgcatgggattggtgtccttttgggcaatctctttgaccaaactggaaacatgttttatgcgcctgcctttactgcccttgtcggcggtacgtctatatgatcctagtcgcaaaagttccgcgctttggagccattaccactatcggccttgtcattgccctctttttcttgggaactaaacacggtgctggttccttccttcctggaattatctgtggcctcctagcagatggagtagctcatttaggaaaatacaaggacaaaacaaagaacttcctttctttcattattttcgcctttagtacaacaggaccaatcttgcttatgtggattgcgcccaaagcctatatggctactcttctggcaagaggaaaatcccaagaatatatcgaccgtatcatggtcgctccaaaccctggaactgtccttctatttatcgcaagtattgtcatcggagccctagtgggtgccttgattggacaagccttgagtaaaaaatttgcccagaaaatctgatcagttaaaaagagccacgcggctcttttttatttatggctcaatttcttagtcaagaaatctcccaagaattggattgcaaagataatcaaaatgataataatggttgccaagatggtcacatcgtgattgtagcggttaaatccataagcgatggctacgttaccgataccaccagctccaaccgcaccggccatagctgtttcccaacaagggaatcaaggtcacagtcgtcac

SEQ ID NO: 25 - DNA, 3010 bp; double-stranded, linear
ttcaattggtatctcaatcaacggtcttcacatggtttcaactggtttgactcttgaaaaagcgaaagctgctggttacaacgcaactgaaacaggctttaacgatcttcaaaaaccagaattcatgaaacatgacaaccatgaagtagcaattaagattgtctttgacaaagatagccgtgaaattcttggtgcccaaatggtttcacatgatattgcaattagcatgggaatccacatgttctcacttgctatccaagagcatgtgacaattgataaattggcattgacagacctcttcttcttgccacacttcaacaaaccatacaactacatcacaatggctgcccttacggctgaaaattaaaaatgaatgagctatctggccttaagttaaggtcagatagtttttagctaatttgtccccatacaattatagtttttttatcttgtgcttcattctgttctgacttaaaatgaaaaggtagctaccaatacaaatgatgaggataaaacaaatgactgaaaatcgttatgaactaaataaaaacttggcacagatgctcaagggtggtgttattatggatgtgcagaatcctgaacaggctcgtatcgcagaagctgctggtgcggcagctgtgatggccttggaacgaattccggctgatattcgtgcagctggaggagtttcccgcatgagcgacccaaagatgattaaggaaatccaagaagcggttagtattccagtaatggctaaggtcagaatcgggcattttgttgaagctcagattttagaggctattgaaattgattatatcgacgagagtgaagttctatctccagctgatgaccgtttccatgtggacaagaaagaattccaagttccttttgtctgtggtgctaaggatttgggtgaagccttgcgtcgtatcgctgaaggtgcttccatgattcgtaccaaaggagaaccagggacaggggatatcgtccaagctgttcgtcatatgcgtatgatgaatcaggaaattcgccgcattcaaaacttacgtgaggacgagctttatgttgctgccaaggatttgcaagtccctgtagaattggtccaatatgttcatgaacatggaaaattgccagttgtaaatttcgctgctggaggtgttgcaacgccagcagatgctgcgttaatgatgcaattaggggcagagggggtctttgtcggttcaggtattttcaagtcaggagatcctgttaaacgagcgagtgccattgttaaggctgtgactaacttccgtaatcctcaaatcctagctcaaatctctgaagatttaggagaagccatggttggtattaatgaaaatgaaatccaaattctcatggctgaacgaggaaaatagatgaaaatcggaatattggccttgcaaggggcctttgcagaacatgcaaaagtgctagatcaattaggtgtcgagagtgtagaactcagaaatctagatgattttcagcaagatcagagtgacttgtcgggtttgattttgcctggtggtgagtctacaaccatgggcaagctcttacgtgaccagaacatgctacttcccatccgagaagccattctatctggcttaccagtgtttgggacctgtgcgggcttaattttgctggctaaggaaatcacttctcagaaagagagtcatctaggaactatggatatggtggtcgagcgtaatgcttatgggcgccaattaggaagtttctacacggaagcagaatgtaagggagttggcaagattccaatgacctttatccgtggtccgattatcagtagtgttggtgagggtgtagaaattttagcaacagtgaacaatcaaattgttgcagcccaagaaaaaaatatgttggtaagttcttttcatccagaattgactgatgatgtgcgcttgcaccagtactttatcaatatgtgtaaagaaaaaagttgagattgaatttctcaacttttttacatgtaataaacaatagcgatgtattgaagtgcggacgcagctaggataaagagatgccaaatcatgtggaaataaggttttttcttggcataaaatccagctccaactgtataacagagtccgccagttaccatgagactccagaaaacgggtgtcgtttgactgataatggcaggaatgatagccagaaccaaccagcccataatcaggtaaagagcaaggctaaatttctcattgacctttttagcaaagattttatagagaataccaaagatggtcgttccccattggatgacaataatcagatagccaaaccagttattcatcaaggtcaagacaacgggcgtgtatgagccggcaatggcaacgtaaatcatagaatggtcaatgattcgcaaaacatatttgtgggtcgaaccataggccatagagtgataaatggtggatgataggaacatgagaaagagactgatgacgaaaatggaaacgccgatagaggataaaaatccgtgtgcttcataactatagatggatgaaataggcagcaagataagcatgatgactgcacccacagcatgggtcacgctattagcaatctcctctccaaaactgagttgtttgctgagtttaagactagtgttcattggattacctcctcttgagtatgatcgattaagtctagagtttgatgatagagtttaacggtttggcagctggtttggataatagggttagctgggtcaattccttggttcatgtagtccacaaaagcatcgtagagttggtctgaacttgcttgagtttgtagagtattaagtgtctgggctatttcttgaatagaaaatacagacttgagggttgtgatagcaatcaaacgggcaatctgttggcgttggtatttttttttgtcaggctttgtcaggtaaccatttttcacataattgttgaccatagatgctgttaggcccttgtctttattaggagagataggggcgcagacctgattgaca

SEQ ID NO: 26 - DNA, 15213 bp; double-stranded, linear
cataaatcggtgcaaataacttaatagtgaagtagccatttctttcgtatttacctgaggcatattccctagacgaaagaatattattatcaatcaaatcattgaatgaacgtagtctttcaacttcttctactgttagatttctgacaacatttgttgcatagaccttatttccatcaggatcaggatggtactcatttgtaacttttctaagaagttgttgtttttgattcgtatccaatttaagaattgaatttccttcgagatattccaacatataaacaacgtcaaacatgttgtggacatattgcttcaaatcatctgcattattaaatcttgtagttggatcaagtacttgtaatcgtcgactttctgtactatcagattttgaatgtttcaagatggagttgatggtaatggtcgcatcatctggatggtctggtgcttgtaataatcctttagcaaagaactctggtcccaagccacttcttcgaccatatcctccaagataaatgtcctgatctgagtcatgtgtcatctcatgcgtataagtaatagctccatccttatccaacattcgataacccatataataaactgcatcacctgtagcataagcaccgtgttgattatgcccaactttatttccaacaggtccaaagaaatgttgcattgcaggatttggattatcaaaatctgccacttctgtagctttccctacggtattatcatcgccaaatttataagcatcgtaaagcaaaatatttctataaagtttttcacgtgcattgtcgtctaaaatacgataccaataatcgtagtgatctcgctgacgtttggctgtttcacgcgcattttcttcaacaaaatcattgagagccttgcccgctttatggtcactactgcggtagcgatcataagctccaaatcctagactagacatggtcgagatgacaaatacggatctctctggcaaggtcaggagaggcaagaccatattgcggtatttccatgtggcactcgtgatacgatcataaacaccgatagaatacttggtgccagctaacccttgcttcgttttcacctcttcgatagtggatttttcttcgacaatgtaagccttagtctctgatttaaaccagtcattattgcttgtatttggtaaaaagacttttcggtaatgttccagcgtgctaaacaaatctgtcgttccatgttgactggcaagactgataccataagtatcgacattattcttagctagaagattgttaaagccagatttacccaactcaatcagagtatctaatggtgaagcattccccttaccaaagaagtccaaatggtacagaactaggtctttgacattcacctgaccatagctaaagttataccaccgttccagataggtcaagccaagtagcaaggcttccttgttgcgtttgattttatctacaagataaccttcagtgacggggttagcactagccagtccagcatccgctgacaagagttttttcaaactgtcttccagttgttgttttgttttggcgaactggtcttctagatagagctcagtttgcttgacgtttggagaaatacccagcgtctttctgatggcttctgaatgatagtcaaccttttgtaagtcaggtaagacttgcttgatgatagaggtttggtcatacaggaattggtttggcgtatagagaagtccagtattgcccagactatattctgctaatttggcgaaatcattctggtatttgagatccagcttctcagataaatcatccttgtagtgaagcaagagtttgtttgcagtctgtttgttagaaacaatgtctgtgatgacttggttgtccttcatcatgactgctgacaagagttctttttgatataaaagactgttctcattgaccaggtttccgtatttgacgatggttgccttgttgtagaaaggtagcaatttttcaatgtttttataagtcaagttgcgcttagcttgataataggccaccttagaaaaatcactgtcttttttgccacttgttgaaagtggctccactgttggtaaaatgagaggattgatttctgcttttttgcttgcaatttgagaagcatctagcattgttcctctttcttcaaaggattccttgctgacgacctcatccttgaccaaggtgacattgtagactctgttggccttgctgctgaatgtgtcctttaccttcatttcgttatagtggtaaccagtgatggcatttccgttggttacattaacatcgctgagaacattggtcaaacttccagcatgcctaacatcaccagaagttcgatcccacaaattgcctgccactccagcgactctaccaaagtgcttgacattgttgatatcaccttcagcatagctatcttggatctgtgcatctcggtctactaggcctgcaagtccacccacagtctgatctgaagtatttgtgttagatgaaatggctactgtcgcttttgacttagtaagtaaagccttgtcacctgtcaaatgaccgaccataccaccgatattgtaggcagcagtcgtttcataagtgttgataattcttcccttgaaactgctctctgtgatgcttgattgctcagccttagccagcaaaccaccgataccacgttcaccagccagaacaccatcgacgtgaacttgcttaatttttgtgttattctgagcttcatttgccagtgaaccgatatcatctttccctgaaatagcaacattttttagactcagtttttctactgtagcaccactcaagttttcaaacagaggttttttcaaattatagatagcataattcttgccatctttttcaccgattaaacgaccagtaaaggtgtccttgatataggatctttcatcaggaccaagctccacttcgttagcattcaggctggccgctaaatgataggttccagagggattttggtttatagctttgaccagattactaaaggaagtaaagtttgttgtttcttctgttcccttcttagctagatagaaggtaaaattatctttatatctgctttctatctcctgctgaagcttctctacttttgctgtgattttataaaggattttatcattttttctttcctctgatattgatgctactggtaggtatacatctttgaatgaagaagatttcactttaacaaagtagctatttggattgcttggaacttgctctaacgaaatgtgttgtttataagtaccatttgacaaactgtataactctaggtcggaaacatttcttaattcaagtgttttctctggttcttctacctttttatcagggtctagttcattttcttgtttaatttcttcgtttccatttgaattggatgtgtttgattcggttgaaacatcctcagttgaatttccgtttgatggttctggttctgtttgtccattctctgatgttgtattacctgaattttctggttttgttgcagttccgtttttttctggttgatttgattcttcaactggtggttttgaatcactaggtttattggatacttctccagtattttcgttagctattttcccagagtttgtttgtgtttcttctgcaggttgaactggtttttctgtttcttgatttgaggtaccttctactgtgccttcatttggatttactggaacttcttctacagttttttctgaattttcatttttagagtcattatgttctggtttatttgattctccaactgaggttgtcgaatcactaggattactggacacttccccagtatttttgctagatgtatctggtgatactttctctgaattcgttgttgattcttctgcaggttgaactggattttctgcttcttgaattgaggttccttctgtagtaccttcatttggatttactggtgtttcttctgttggttttactggaacttcttcagttttttctggaccttgttctttggtcttctcaaccggagtttcaggttttacttgctcaatattacccttatattctggaagcggtgctacctgctctggttcacctttatcacttaccacagtatctggcgactctggttgaacctcagtctcacctttgtcggtcacaactgcttcgggtaatgtaggttgaacttctggttcgcctttgtcacttactacagcttcgggcaactcaggctgaattgcgggttcaacaatagctccagactgtacgtccttatgttctacaccagtctcaggttgttcctttataacttgagtttttttagtacctttttcgactattcttggactaggcgcagtcgttgaagttgaaacaatttctcgcgaaacttcttccttgtttacagagaatattctgacgatttcaactttcttacctaatttaccttcttgttttactcttacagttccttcagctaaatcaggattttcttgaatttcttcttgaaaatctatttttgtctccatagtttcctcacgatataagagttcaggtttgttcaattgacctgataaaacttcatcctgtggatttaatgtatttaccccagtcttttcttttggagaaatcttctcctctttcttcgtttctagattcttatgttcggctaattgttcttgagaatctgaagattgtttctcttcttttcttggattgattaattcagtagagaaaggtttttcaactacttgaacttctgtcggcttagttgaagaaacaggtgtttgttcctgaatagcttgtactgttgatggatggtctacaaaattcggtgtaacattataatccaccttttgttgttttgtaggagtggcaactgaactcttttgattacttacttcagactcagaagtcgtttttccctctttgatatatccaatataagtgtaacctgaaatctctttaggaagaggtaatttttctccagaggtcaattcatagtccgtattgtaatttagcaaaagatgattttctaaagcatggactgaaactaagacaccatttcctatccctgcaaccaatactaaatgtaataccgttttattcttaacctttttcttggaaacagcaaaaattaaaattcccatagcagctaagctagcaccagcaactagggcttgcctctcattcttgcttccagtatttggcaattccgccagttgattttgagaatttaacttataaacaagataataagtttcatcatcattctccacgtatgtcggaatatcatagacaagctgcttcttttcttctgatgatagctctgaatctgccacatatttatagtgaactcccgcagtttcttgagcatccacagatgaactagctaatacagacataaaaaataaacttgaaatcgttgcagatacaagtcctactgataattttctaaatgaaaaacgctcttgtttttcaccaaaatacttttccattattcctccttgaaataaaatttatatatgttacaaagacctttattatattagtgtattatctattatctatagaaaaggcagtataccttaattatactcttaatttacaaaaaagtcttaaaattgagatgcgctttcatactttgttttatattatttggaggtacaataacacctaccatgaaatttacacggtaggtgttactcatatcactaatcgttctaaaaatggtttgaggcagttgaggagaattccttctatccagcttccttgtgctgatgagcgatggtcttcctgcaggcttttttttagaaaatctcggacttgttctggtgcgatttcaaattcaaaggctttcattttatagaaaaagtcgatgagatgatctgacaggtattcagttgaaaagggtacttcaccactttttctatattctaataagagtctagaaaatcgagctttttcttcaggaagctcacgaaaataggaattgaggatccaagtctgcttctgttttctttcaattggatcctgactggcaattcgttggtctttttccagctctttttggtattgtttggccttgatagctcgttctgctctatttttaccaaaaagaattttttcccacttgcgttcttcttgagtcagggtctctgtaaagccaaagtaatcttgataagcacgctctgcgggtcccatggctagaaccagattgtctgcatattgcttggcgattttatccctcttcttgcgttctttctctgcctggatacggagttcttgttcgtagtcaattttctccttgcctagcttgacaaggtagagttggtcatccgatttcccaagtaaaaagggtttgatacacttttcaaggacttcttccatccgagcctttttctttggttccgccttggtccaacttcctccctgaaagacttctaggaaaagctggtagtctctctcaggcgcaaattgattgccacgattgggtttgaaaacacctttttcccagagccattttagaagtcgctcgtcaaagttacttttattgaccttgattttttcctttttctgagcttttctggttagattttcaacctttctgagcagtttttcttcctcttccaattgctggtcaagggacaatcgatgaaaatgacgaacacagtcgctaccaattggaaagaggcgttggcctgtgacaccgttaaagagttcataagcgtatttgatggcatttccacagacacaattgctacggccgataccgttaaaaataaaggaaacttcattccattccttggtagcttgttcccaagtatccgctttcgaagcctgtaaaactgcatcgtgcagggattttctaactggaagtgtcatgaggtctcctttctaatactcaataaaaatcaaagagcaaactagaaagctagccgcaatcagctcaaaacactgttttgaggttgtagatagaactgacgaagtcagctcaaaacactgttttgaggttgtggatagaactgacgaagtcagtaaccatatatacagcaaggcgaagctgacgtggtttgaagagattttcaaagagtataagttatacttttacaacttgaacctcgtctttaccgagtaaaatcaagtatttttcaatattttcaatcgaataggctcgtgataaagcctcttcgtatagagctaactgaccacgatagcggtctacgagttgacttggttcatcatagcggtctgtcttgtagtcgaacagaacaattttgttttcgtaaagcagatagccatcaaggataccacggacaacaaagtcttcctgactcttttggtctcgtttgagcatggagaaaggttgctcgcgataaagatggtcggtattagcaagaatttcctgaccgagtactgtgtcaaagaaagcaagaattttatcaagattgatcttgtctctgacagcttggctagtttgaacttgtttgagtgtttctgttaggctagcaagggttagttgctggctgaggtcaattctctgcatgagttcgtgagtagcactaccaatctcagctccagttaccttttctttggttgaaaaatctggcaaatcgaagctgattttcttgcctactgactgaccttgaccagcaatctcgacaccttccatatccataactggttcgtagaatttcttgatttgacttggggtttgaacactaggaagttcaatagctgcgcggtgaagagtattataaacttccacctccttcagcatttccagagcttctttgatggtatctgactgacgattgtctgcttgggagctatcttggagaggactcttggtttccaactctccgatagcttctctggtcaactgatcttcgccaataaaacgataactaaagttgagcttgtccttagtaaacactttactgatagcccaaagccaatcttggaaattccgtgcttgcagtctagtattgctatttagtttcccatttttggctgctgggtattccttggattccagcttttcacgagaacccttgccgacaagatagagctttttctcagcccgcgtcatagcaacatacagcaaacgcatctgctcagaatagcttgctagctgtaattcctcttcgttctgcctataggtcagactaggaatggagagtttgatggttttaggatagtggtcttctactgcccctgtctccatcttggcaatatatttgacaccaagaccattctgacgactgagaatgacttctgacatagagtcttgcttgttgaaatcttgatccatattgaggataaagacgtaaggaaactccagccctttactcttgtggatggtcatgagctctactgcatcttttggcggtgcgacggccacgcttgccaaatcgtgctgggcttctaagacttggtcaatcatacgaataaaacgcgacaaacctttgaaattgctcttttcaaattgatcagcacgcagtgctagggcatagagattggcctgcctagcaggaccattcggcaaagccccaacatagtcataataaaaacggtcgttgtaaatcttccaaatcaagtcatagagagagtgggttttggcatacaagcgccaagaagctaggatatccatgaattgctttagtttttcagctagagctgtgtgaatcaagcctttttgactacttgccattttttgtgcattgaccagtttctcatagagattttcgtggactttatcctctgctttctgaagggacaaacgtgctagctcatcctcatcaaaaccaaacattggagacttcataagggcaaccaaggcgtagtcttgcaggggattgtgaatgacacgaagagtgtctagcatgacttgcacttctagggattggagataattgttttgctctccgtcagttttgacaggaattccgtactcagacagggcgaggagaatctggtcattacgactgcggctggaggtcagaagggcaatttccttaaaggcaacacctttttcttgatgaagtttcagaatctccttgataactaagcgcatttcgcctgttagtttcgtttctgtttgactctcttcttcctcacctgtatcgtccttgtcgtagaggagaaatgctgccttgttgtctggattgggagtcagtttggtattggcaaaaacaagctggtgcttgttatcatagttgatttcgccgacctcttggtccatgagacgttcaaagacatcattggttgctgacagcacttctgaactactacggaaattttccttgaggataatgagcctgccttcttggggattttgcgcatagcgttggaatttctcattgaaaatctgcgggtctgcctgacggaaacgatagatggattgcttgatatctcccaccataaagcgattgtggccattagacaacaattccagcatccgttcttgaatatggttggtatcctgatactcatcgaccatgacttcatggaagcgctcctgataagactcacgaacttgtgggaaattctctaaaatctcaatggtgtaatggctgatatcagcgaattcgaaggcattttcctgtcgttttctctgacgataagcctctacaaaatcgctcatgaaagattggaaggttttagctagtttccaagtgtctccatgataacgttcttgatagtcgagaatcgctatctggtctgataattgtcctagtttagcaaactgggtctttctctcttcgttgtaggcatcagccaggggcttcaaatcagcctacggctggcattagtcagagctcgaccgtttttctccttagagatggcgacaacacgcgcaagcactgcctgataagcctgactatcggactcctgatttagggagccaatttcatccagaattaactgaacattttctaaataggcagcctttgcaaactccttggcatcgttatccagatggtaacggaaaaagctttccaaatcccaaagggcttgtttgatttgctcggtcagtttttctttttcactggtaaaatcagctttctcaaatcctttgaggaaagattcactcagccacttttgaggattactggtggattggaggaagtcatagattttatagacctgctggcgcagaccccgttcgtccttgccacgcccagcaaagtttttcagcaaatgactaaaggtctctttctgtttaccttggtaatgcgcttcaaagacctcatgaaagacttcgttttcgagaataagttgctcgctttggttttgtaaaatacggaaattaggtgcaatatcaagcagataaccatgtttgccaaggaatttttgtgtgaaagaatccatggttccaatggcagcgttgggtaggtctgccaactggcgacccaagtgttgtttgaggtcgacatcatctgtttcttggattttcttgctgatttttttctctaaacgttctttaagttcagttgcagccttgacggtaaaggttgagataaagagttgagaaatttcgacaccacgcgccaattggtccagaatgcgctctgccatgacaaaggtctttccagaaccagccgatgctgagaccaggatattctgggcagaagtgtagatagcttcgatttgctcggcagttttcttctgttccttgctcgaatttgcttctgcttcttgcagtttttgaatctcctcctcacttaaaaagggaataagcttcatcgattcaactcctctcttattttttcaagccaagcttgcttgagtttttctccgaccagacgcttgccatcagctaggtccaacttttctaggaaacgggcttggcccagatggtaattggcttcaaagcctgtaatagcctgatgttgctggacgtatggggcaatgcttctgccattttcagtataaggattgatggcgaaccggcctgctaaaatcttctcagcagctttcttgtaaagataggcattgtagtccagtaggagctgaaattcctcatctgtcagttgattagccttgtttttgttataaaattcgcctaaataactgctttctttttccaagaagagcccttggtatttcatagatttgctggcttctaccactgctcctgccagactttttaccgccatcagagattggacaggttcagccatttccaagtacatggcgccgaaaaagttctgctccccttctctttttagggcagcaagataggttggtaactgagaattgagcccattaaagaaatgaggaaactggaactgagtcagactggatttgtagtctactactcctatcgctccattagctttcaaacggtcaatccggtccaccttgcctcgtacaaagacactgcgtccattgtctaattgaataaaggcttggtcttttccaccaaaatttgcttcttctttgatggtttcgatggctggattgtgtcggagaatatgtccagttgtccgtgcaacatcaagcaaaacttccttggtaaactgggcttccaaactttcttgataaatagcttcaaattcgcgttcttgactggtttcttgaatagcttgttctagacgttggtcaaaggaatcttcattaggcaactgtaaggcgcgttcaaagatacgatgcaagaaattcccgtgactacgggcatcaggatgcaaacgtaattcctcctgcaagcctaaaacgtagcgtaggaaataactgtattcattgcgataaaactctgtcaaacccgacgtagacaggtaaaactcctgtttggcaggatagagagcttgcaaggtgtccttggctaaggtcttgctgcttggactggttgggatagctggattttccagaccttgctgatctagttttttacctatgacacgcgacagaaccttgacaaaagtcaaatcttgctcagtatcgctcatctcaccctgctggtgataggcaaccagactagacaaaagactgtgataggaccccatatcctccttagacagtcctttgtgattcatcctcttctctctccgcctaaatccaaaatggatcaactcttgaagataggcagattccttactttcactttcgttaaaaaggcttggagccgacaagaacaactgcttacgagcagaattgaccaaggaaagcatagtgtagcgatttttcttgagattttcactgctggcaatcagtaattgaacgccttcttcggtcgcttggtttaggttttgcctttcttcatctgtcagaagactggtgttttgagaaatttttggtaaattgtcctgagttagtccaatagcatagacaaagtcagcagtcaatggtgcaatcaaatcgtaactctgcaccagaacagtgtccactgttgctggaatggtacggtattgggacaaactcattccagaatggagcaaggctaggaagtcttccagactaacctgtgaaccagcaaaaacagtcgcaaattgttctaaaacatggcagaaagccttccaaacttcggcttgtctttcctgttctacagcttccaaagtggttgtcaaatcttgtaactgcttggtcacagctccttcttttagaaagacactccatttttgtaggagtttttcagccttttgttttcggctggcaaagagggtttcaagaggtgctaaaattctcaggcggaggacattcaaacgctcaagattaaattttccatggtgggatttggtgaaggtttgctgaaaggctggcaagccattgataccaagatagcggatatattgctcaaaagcatcaatatcagactgactgaggtcagtatacaaatcagttctaagaagattaatcaaatcctcctgacgaaaacggtaacgttttaaagctaaaatagactcgacaaactgagtcaagggatgatgagccatggcttcgcttctaccaagataaaaaggaatctgatactggtcaaaaatggttttgagagataactggtaagaagctacatcccccaagagaatacgaaaatgcttgtagctcaggtctgagttctcatgtaatttctgacgaatactacgggctactagctccaactcctccttttgcgtcaaacaagaccagatttgtaaattttcacggtctttctcatcgacatccaaagcgagttctgaaaagtcataagaagactccaacaaacgagaggccttgtcaaaactatccatcttctcatgagtttgagaacagtcctgagcaggcgtttggtatttagaagccagatgatggagaaattttacgctggcttggtagagattgccctcgctaaaaggactggtataggctttcttactagcataagccccgataacaatctcaacacctttgccgtgaagtaagtccacaacccgctcttcctcagcagaaaaacgagtaaagccgtcaatgaccaaggcgatttgattaaaatcactacttaccttgtcattctcaatagcctcaatcaaatgggacaactgactttcctgggctaactgaccttgattaagataggctgttactttctcaaaaatcaagagtaaatccgccctcttatcctcatctgttaaattctccaagtccaaaaaactcatctgagatttggtcatctcatggtaaagctcaattaactgctggatcaattgaggatcctgcttaatagcgccataaacacgcaagtccttgggatcgagttcggcaaggcatttgtaaaaggccaacccaagaccgatatcatcaagagtagttttagctggtaaatcattcaagaccagatagcgagccatttgagcaaagcgcgtgacggtaatcgaaaaagaagcctgctgggacaagtattccagcacggcgcgttccttttcaaaagaaagagagttgggggcaatgtagaagacccgcttgccagctgcaactagctcttctgcctctcttgttagaatttctgtcaaagaagtccgaatatcagtataaagtaatttcatctcagcctcgttggaatttttcatcaccctatattataccatgattagcctcgtaaatctgttaaaatatttaggccatcctttcttttcttcatcatctgctaaatcttaaatacttagctttacttgtattagatagaataagtctggctactgaaaatcacataataaaaaagcctcggtaacaaggctttgagttttatgattgtttcttaggtacggaatacacttcaatgtgttgtcccagtatcttaatgtcgactggtagattgtctgatttatcgccatcaacatcggactctaattcgatatcagaagaagttttaatattacgtgcctttatatattcaatattcttgatagaatgattgaactatagtaaattgaaactataatagtacaccgtggatgctaaaatatttctagaaattaatttgatttccctaatcaagctattcgtatcttatttcaatctactataataaaatgaaccaaaaatagtacacaatgtggtataatcttcttatggcatattcaatagattttcgtaaaaaagttctctcttattgtgagcgaacaggtagtataacagaagcatcacacgttttccaaatctcacgtaataccatttatggctggttaaagctaaaagagaaaacaggagagctaaaccaccaagtaaaaggaacaaaaccaagaaaagttgatagagatagacttaaaaactatcttactgacaatccagatgcttatttgactgaaatagcttctgactttggctgtcatccaactaccatccactatgcgctcaaagctatgggctacactcgaaaaaaagaaccacacctactatgaacaagacccagaaaaagtagccttatttcttaagaattttaatagtttaaagcacctagcacctgtttagattgacgaaacaggattcgatacttatttttatcgagaatatggtcgctcattaaaaggtcagttaataagaggcaaagtatctggaagaagatatcagaggatttctttggttgcaggtctaacaaatggtgaattaatcgctccaatgacttacgaagagacgatgacgagcgacttttttgaagcttggtttcagaagtttctcttaccaacattaaccacaccatcggttattatagtaaaatgaaataagaatagggggggggggggagggggggggagggaga

SEQ ID NO: 27 - DNA, 6004 bp; double-stranded, linear
ttattacctgaaacattaaatttaattggacatcccgttatcaattttataatatcatcaagatttttattatctgattcaggaattttatctgatataacaacaccattttcaagatagttcattaaattatttgattcactaacattagtgttttgatctccatcaagccaaaaataatggttatcggaatctaaatacgatgagtttaaaatattattacaaattatttgatttgctccaccaggaatatatctcactactaaattctgtttaagattctcactacctgaatgagtgataacaaactctagaatatatttagctagtctatcttcaacataaatcatcttcctagaatgatacacatcacctaattcaaaaaatgcatcctgataatcaatattttcaataacatctaccttttctccgtttttcactaaaagtttcacggcttctctaggaaaatcttttataagttgtgtagaatgtgtagtgataataatttgatgttttttatttaaacactcttgaagtaaaaactctttaaatttatagattgcactcggatgaagtgagatttcaggttcatctattaatattaatgaatttgattgcgcatttactatatcatttactaacaaaataattctagcctcacctgttcctgcaaaagcctcggaatattcttttccagattttttcatccaaatagttttggaagcttttatatcatcaccttttgaatacaacttatgtgttaaaatttgaatgtctgtataagattcatccattatttcactaataatttcacaaactttatcatcaactttaacattatctataaccatttcctttttataacgcgtatagctacttgtattattctttaaaatatcagcaactggcttagatcgtaatcttataaaatcttgtttactacgttgagtagaaatttttttaaaattatagtgatagaaaaataaatcaaaagcagaaacatattctttacaatcacaaaagacaacatttttttcaatgccatcccatctgtctgtcgaagaacttccaatatatttatttttgggtaatctttccatctcatattgtttttgaggagcatatggttcccaataatctaatcctttttttgttccagaacggcctttaagaacttctacatttctagaagctttaatgttataatatgaatagattaaacattgtttcccatccacttcatctatttgatcaacatttgtactaaaccaatattcagacacacttttattggctggagaaccatataaagcttgtaaaattgaagttttatttactccatatctattacagacacctcaggattatttaacttataagttttaacagctacggaatcaatttcaacagcaacttgaacatctatgcctgattttttaaggccacttgtagtgccacctgcaccgttaaataaatcaatagcaacaattttccccatagtattctcctaaagtttctcctttttattataacattatcaaatgtaaaacccaacccgatagggttaggtttttaacatcatttcaccaacttcttcatctcatcaatacgtgcgacggtcgcgtcatatttagcttggtagtcagcttgtttgtcgcattctttttggacgacttctggtttggcgttggctacgaagcgttcgttagagagtttcttaccaaccatgtccagttctttttgccatttagcaagttccttgtcgagacgggccagttcttcttcaacattgaggagatcggccagtggcaggtagatttctgctcctgtgatgacacttgacatagccagttcaggtgcagggatggttgatgcgatttccaagtgttctggatttgtaaagcgtttgatatagttgacattgctgttaaagaaggcttccaagtcgctatcgcttgtcttaacaaggatggtgataggcttgcttggtgctacatttacttccgcacgcgcattccgaacagcacgaatcaagtctttgagactttccacaccagtgtgagccgcaaggtcttcaaaggctagattaacagttgggtatgcagctgtcacgatagaaccttctgagatttgtccaaagatttcctctgtcacgaatggcatgattgggtgaaggagacgaaggatcttgtccagcgtatagaggagaacagatcgagtaatgaccttatcgtcttcattgtcgctgtatagaacttccttggtcaactcaacataccagttggcaaattcttcccagatgaagttgtaaaggatatgaccagccacaccaaactcgaacttatcaaagttttcagtaacttttgcaatggtttcgttgagattgtggagaatccagcggtccgtcacattaccagcctcacctgttgcaacttttgtgacattgtcatgcgccacatccagcgtcaaaccttcattgttcatgaggatatagcgagaaatgttccaaattttgttaataaagttccatgaagcatccattttctcgtaagagaaacgaacgtcttgacctggtgcggaaccgtttgaaaggaaccaacgaagggcatcagcaccgtatttctcgatgacatccattgggtcaatcccgttaccgagagatttagacatcttgcgtccttgctcgtcacggatgagaccgtggataagcacgttttggaatggctgacgaccagtaaattccaaggactggaagatcatacgagacacccagaagaagatgatgtcgtaacctgttaccaaggttgaagttgggaaataacgtttaaagtcttctgagtcgacttcaggccagcccatggttgaaaatggccagagggcagaactgaaccaagtatccaagacgtcttcgtcctgagtccatccgtcaccttctggagcttcttcgccgacatacatttcaccatcagcattgtaccaggcagggatttggtgaccccaccaaagctgacgagagataacccagtcgtggacattttccatccattgaaggaaggtatcgttgaaacgaggtgggtagaattcgaccttgtcctctgtgtcttggttagcaatggcgttcttagccaattggtccatcttgacgaaccattgagtagacaagcgtggctcaactacgacacctgtacgttctgagtgaccaacactgtggacacgtttttcgattttgacaagggcaccgatttcttccaacttagcaacgactgccttacgagcttcaaaacgatccatgcctgaaaattcaaaggcaagctcattcatagttccgtcgtcgttcatgacgttgacttgtggcaagttatgacgttggccaaccaagaagtcatttggatcgtgggcaggtgtgattttcacgacaccagtaccaagctcaggatctgcgtgctcatctccaacgattgggatgagtttattagcgattggaaggatgacgtttttaccaatcaagtccttgtagcgcgggtcttctggattaaccgcaaccgcaacgtccccaaacatagtctcaggacgagttgtagcaacttcaagggcgcgtgaaccatcttccagcatgtaattcatgtggtagaaggcaccttctacatccttgtgaatcacctcaatatcagaaagggctgtgcgagctgctgggtcccagttgatgataaactcaccacgatagatccagcctttcttgtaaaggttcacaaagaccttacgaacagcttttgacaaaccttcatcaagagtgaaacgctcacgagaatagtctacagaaagccccatcttgccccattgttccttgatggtagtggcatattcgtctttccattcccagaccttcgtcaagaaagactcacgacctaggtcataacgcgtaataccctcaccacgtaagcgctcctcaaccttagcctgagtcgcaataccagcgtggtccatacctggaagccaaagggtatcaaagccttgcatgcgtttttgacggatgatgatatcctgcaaagtcgtatcccaagcgtgaccaaggtgaagtttcccagttacgtttggtggtggaatcacgattgaataaggcttagccttttgatcgcctgaaggcttgaaaacatccgcatcaagccatttttggtaacgaccagcctcaacctcggctggattgtatttaggtgaaagttctttagacatgtgtgtgtcctttctctattttgtttattttattttgaatttgcttagcagcttcttctgcagacaaattcgtattatttattttaaagtagtggtgcaactcattcggttgatgttgggaatttaattgaagtgtttcagcggtctctaaaatttctctttcagatacctcaatatgtcgttttaagggtttgtgctttaatcgattctccgttcgatttcgacgtatgcactcttcaagacttgtttccaattcaacaaacagaatctcttgatgaaagttatccaataaatcctgaatttgctttaaatacatcagctggtactgatttgaaaaatcaattacgtctgttaaaattactgatcgctgatttcttgcacttgctccaaggaaagaaaaggtaattccacgaacaaattcccacatctcctcggtataatcctgatagatctctagtgcaaaatcaatggcttgatggttataaaatagggtagcatccgtcagtcgagataattcttgaccaatggtcatttttcctgatgctggagcaccaatgatgaaaagatgcatcaaatcacctcccactcactcctcagcaagccatatctcaaatcatcacagcagttgccttgagcatctttgcggtctcttatgcgagcttcgagggtaaagccaagcttttccgagactcgttgactttgaaggttatatccaaagcaagttagttcaatcttgtgaagaccaagttctttaaaagctagatcaatcaaggaacacgctgcttctggaacataacctcgaccccaatagtctgggtgcaaggtatagccaagctctagcacatcatccgcatgaagatggttgaagtcaacagaaccaatgactttatcggttcctttgacgacaatcccatagccagctgggagattttccttttgagtacgctccggaagaatgtgctccagataataaatctcatcttccaagatcttgactggaggaaaacctgctggataggcgacctctggcaaactagcgtaggtatggatatcctcagcatccaccactgtgcggactcgtaaaacgagacgttctgtttcgattttatctggcagctcagttcttgccatccttcttcctcgcttttttgatgaaactgcccttcatatctacacgcttgtccagatagcgataaacgcgctgatatccatctcccatgaaataggttggggcaaacagttgatttttaaaatgtcccttttcatccaggagttctggggcaacaagtcgctcaagaatcttggcaaagatgtggcaaataccgtcttcctcaacaatcctatctacccgacaatctaaaacaagtggacaggcgtctaaaataggagtctgagttcgttcagaaatttcataatgcactcccaaacgttccaatttctcctgatgactgataaaaccagcctgctccatcgcaagcatagaagtttcatcagaaatattcacagtaaatttttgatactgtttgatctgctctgcggcattctctctcgcaacgactccaatcacaacccaatctcctagactataagaggaactacaggtcgtgatgttatagccaaaattctaatcttgatatcctaaaataaaaacaggaaaaccataatatagtttacttgtgttaaaagattgcttcataacaaccccctttgactaagacgtaaaagaaaagccctgccatctacatgacagggacgaatgtgtttatccgcgggg

SEQ ID NO: 28 - DNA, 5857 bp; double-stranded, linear
tgtagaattcacgacaatgcttcgttgatttctgggttgatttcgtcgcgttctggcaagcgagtcaatgaaccaaaaatagtacacaatgtggtataatccttttatggcatattcaatagattttcgtaaaaaagttctctcttattgtgagcgaacaggtagtataacagaagcatcacacgttttccaaatctcacgtaataccatttatggctggttaaagctaaaagagaaaacaggagagctaaaccaccaagtaaaaggaacaaaaccaagaaaagttgatagagatagacttaaaaactatcttactgacaatccagatgcttatttgactgaaatagcttctgactttggctgtcatccaactaccatccactatgcgctcaaagctatgggctacactcgaaaaaagaaccacacctactatgaacaagacccagaaaaagtagccttatttcttaagaattttaatagtttaaagcacctaacacctgtttagattgacgaaacaggattcgatacttatttttatcgagaatatggtcgctcattaaaaggtcagttaataagaggcaaagtatctggaagaagatatcagaggatttctttggttgcaggtctaacaaatggtgagttaatcgctccaatgacttacgaagagacgatgacgagcgacttttttgaagcttggtttcagaagtttctcttaccaacattaaccacaccatcggttattattatggataatgcaagattccatagaatggggaagctagaactcttgtgtgaagagtttgggtataaacttttacctcttcctccctactcacctgagtacaatcctattgagaaaacatgggctcatatcaaaaagcacctcaaaaaggtattaccaagttgcaataccttttatgaggcttttttgtcttgttcttgtttcaattgactatataaattgtctaagcgaaacaaccgataagaattggcacaaaagcgaccgtatttttgttaccaatacaggaaaaacagttcatagttctatcttgagcaagtctctccagcgagcaaacgaacgccttaaaaaaccaattcccaaacatctgtcccctcacatcttcagacacaccactattagcatcttatcagaaaataaaattcctttaaaaacaatcacggacagggttggtcatcccgactctgaagtcactacttccatctacacccacgtcacaaagaacatgaaagatgaagcaatcaatgtactggataaagttatgaaaaagattttttaaaaagttttgtcccttttttgccctctaaatacaaaaatagcccttcggataaaatccgaggggctagaaacgttgttaaatcaacggccgaacttttgaatttcatggttcgggataaaatagttcactgaactattttattttttaaggttatcataatatcaaatagttcaattaaatacgctaaattactaatatactttttacctttttcattctaaaatgtaaagtacaaacaattacaatatactagagggggagtaaaaaaggtattaaatcgatgagttcagcaggcaagaaaatagcacctttacgggtgctattttttaattaacgccacgttaacttttgattgatgaattttattgtttggcacttctttcatttcacggtaaacatcgatgaaattctttccaacattatttttggagttaactgcatttatttttgtattaataacttttttagtatcgaaagaatggtttaagaaatccataactaactctcctttctcatcctgtaatcaagatttttatcaatgtcaaaatagtattttctatcaatccaaattggtccttctcctttagaaatagcaagtacatctaccggacctcctactgtttcaagagtgttgacaatttttctcttaaatgaagttaattcaataaatgttttagctgtactcgccatttcattaagtggttgcattccaataaggtctattataggatttatataatatttttgctgtatagatgatatattttcaaatatattctcaatttcatcacccaatccatttttctccataactgatgatacttgctctgcgatatatacatttaagttaggatctataccattcataatcgtctcaaccatctctgactgtgcaaaagggattatatgacaagttttatgatgatttatcacactttcattaataactttccaaattaatcgtttagaaaaaattccatataattcaatttgtcttatagatggaaatatctcgtctgtaccataacctgctataactaatccagttatgtttgttgagtcatatccaatgaaaatcgctttatataaagatttagcaataacttcaacctcatcatcagtatgaggaaaggatttaaaaacatcgtctacaatgctttttattaactctaactcagcttcaaaaaattcaaaattactttcagcttctacttttgaaatttctaaactaaaattagttatagcatttaataaaattttattaaaatcatctagagtgatggtttcaccattagaaactcttaaatcagctgtttcttgcgcttcataggcaatgctgtccaaaatacttcttgtacttctgacaatataatttcttaataaatcctcaacttgtagatgtttaaaggaaattaaaaattctattagcttttcaacgtattgggcagtattatctaataaatctgtgccaatagcctgcttaaactcatttaaaattacctcccacggaatttccataaacgaagcgttcccatatatcatgatccccacggaatgttcttttgataaagtgaataattttcgggcgctattaaaaacttttgaatttttcccgtctgataaggttacagcgctatcagaagccaatacaacaccatttttatttaatattccaatttctgctgtcaaaatatcacctaaactttctaaacctgctcatgctctaatggtacaacagctaaggtcttaccaagacttgccaacacttttaatactgtatcaagttgtgggcttgtctttcctgtttccattctagcgataactggctgactaacaccgctcatctcctctagtttcttctgactaatacccttttcatttctagcctcgataagctcactcatgatagccacgcgcatatcactttccaaaatttcctctttgctgaataattcagctcttacatctttccagttactaccaatagcattatttttcattgtctaaacctctttcttttaaatctgcaagttcacgtttagcttgctcaatctctcttttgggtgttttctgtgtccttttcataaaatgatgcagtaaaacaaaactaccatccatccaagcaacaaataaaattctatctctaagtggtctcagctcccaaatttcagcatctaaatgcttaatatatggttcgcctgcgcgtgttccatgttggcttaacaactcaatataatcattaattttattaagcttaattctgctatctttcccttttttactggtaagctctcgcatataatcaaaaacaggctcattgccgtttttatccttgtaaaaatagatattatgcactattaacacctcttcctaataacaattataacctaaaagttattgtttgtaaatacttttaagttattaaaataaaaagcacctagtttcctagatgctagcacaatgacacggattcgcaccgtggctacctctatcaaggtgtactccttctatactatcccttgtgctttagaatattataccacacaatcaactagatacctaccatctcatgatatacccccattttgggcaagggtacaacgctaaaatacaaatcagaatagatattaaaccacttatttaacttatcataagctggtgattgactgataaataatatccgctgacaagctccgataacattcatgtgattgtacacataaacctcttttacagcctctaaaatgtcagcctcacttgtttgtaccctaatatctgttatctgcttgatagttgcgtatttttgataagctagcatatcttgatttttagcagcatcaaacattttacgctcaaggacactatacttaggttgttctttatctcgcatgaaataccacttgagccataaaatcttttctcggtgtattacagaaatacgctcaattttcttctttgtcattgctacctcctaaatcatcaatttaacaattctaaccactcacttttagaaatagttgcatagatcttgttcgatgtatgatacaaaggttctaaatctttttccaccctaatatagttcatcttatcctcatgagtaggaaagtatagtatttccgtttcatcctcgtttaggatacgattgcaccaatcatcaataataactggcacttcccactcacgccattttttaaggttttctaaaagttcattatcactaaatagctcgccatctatttggaaaaattcccctaagtcattgtttccttcaacaataataaactctggcatatttctattacttaataactccttgagttcttgtaactctttgatttcctttagatacttcctcaatttccaacctcaattcttcaatctgccttactactccaaaaatttcatgggtcttataagattgttcaagtatagcctttgctgcttgagttcttataaacgggttgaccttactgtccatcataatatcattgagtacagaaacagcgttagatgatgctaaataaagcatttgagttgttttatccatcatctcatcttgctttatcctcaatgtctttttaaccgctgcaacttttagatacttatgacctgttgcgcgtgatacccctgctttttgacatgctttgtctatcgttggctcggtaagcatggcatctatgaatttaatttgcttggacgtaaggttatcattttcatttcctgccatctattacctcctcattatcaaaataaagggttgcccctttatttccctatgctagataattctgcaattctgcatccattgcctctgaattgccctcaacaatcatttcatgctgtactaaatcaatcttatctccgttaataagtaaaccaccgtggaaataatcaatttttctatcaaggaaatgtactagcttttcaaggcgttgctgttggctgaattgctccatgtcaatttcgatataagcaagggtagtatcattatccataatatcttctaattttctaagagctagaggtttatttttatatttttctaggtattctctcatttctgccactgttaatttgatactagataataaacttagttcagctgcatcatctgctgtaataggctcttcttttgattcatggtttgctagttcagcatttttctctttttctagttgctgatacaatagctgagcagtattttgggaatagttttcgccctcttttttatattttaaaagttcttgctctgcatacactttcccgataatcacttccttataaactaattgcccatcttgagcttttagcttaatactcccatgctctggaatttcaatatacttaattataccattttttgagtataaaacaaagcctttctccatcatttttaataatttatcatccttgttttcagtcatgcttttctcctttatttcattttattataatctgaatacccctagtctatttatttcactaggtttttagggttcgtatgctaaaatactaccctttttgtgtaccttatggctgacttttcaaattggttagtt

SEQ ID NO: 29 - DNA, 10254 bp; double-stranded, linear
aaaatgatagcaggagagttttcccgtccatcagacccagaactgagagccttagctcaggcttctcgccaaaaacaggccgcctttaacaaggaagagaaccccttgaagggagccgaaatcatcaagacttggtttgcctcaaccgggaaaaatctttacatcaacactcgcttgatggtggactacggtgtcaacatccatctaggggaaaatttttattctaattggaacttgaccatgctggatatctgtcccattcgtatcggggacaatgctatgattggtcctaattgtcagtttttgacacccctccatccactagatccacaggaacgcaattcaggtatcgagtacggaaagcctatcacaatcggagataatttctggactggtggtggcgtcattgtccttcctggagtgacactgggaaataatgtcgttgcaggagcaggggcagtaattaccaaatcttttggcgacaacgttgtcctagctggcaatcctgcgcgcgtgattaaggaaatacctgttaaatagaagtaaaaaggaacagctggggttgtttcttttttgtaggtttcatcattttttacccagttcacatttacctactctatctcttagcaagtctgtttcattaagcaagttcaaagcatctcgtaagtgggatgtttttctcctcagttcatcagcttcctccttgacactcggtcagattttgatacaatagtacaaaattagaggaggcaggctatgattcagaaacatgcgattcctattttagagtttgatgacaatcctcaggcggttatcatgcccaatcacgaggggctggacttgcagttgccaaagaagtgtgtttatgcatttttaggtgaggagattgaccgctatgcgagggaagtaggggcgaactgtgttggcgaatttgtttctgccaccaagacctatccagtttatgtcgtgaactacaaggacgaggaggtctgtctggctcaggctcctgttggctccgctccagcagcccagtttatggattggttgattggctatggtgtggagcagattatctctactgggacctgtggtgtcctagctgatatagaggaaaatgcctttctagtccctgttcgcgctctgcgagatgaaggagccagttaccactatgtggcaccttgtcgttatatggaaatgcagccagaggctattgctgctattgaggaagttttggaagacagagggattccttatgaagaagtcatgacctggacgacagacggtttttaccgagaaacggctgaaaaggtggcttatcgtaaggaagaaggctgtgctgttgtggagatggagtgttctgctcttgcggcagtagctcaattgcgtggggttctctggggtgaattgttgttcacagcagattctctagcggacttggaccagtacgacagtcgtgactggggctcggaagcttttaataaggcgctagaactgagtttagcaagtgttcaccacctttagttgtactggcaaaggatttgttttatcataaaatgtctagctcatacttttcaaaaatatgtttaaacgaggtcaccttcctcttgtcctaggcatgttgaggttgggaaaaatctttaaaatcagaaaaacgtatcatatcaggtgatgaaaactttgacactatgcgttttatgtcgataagatttagagtgagatgaaatgatactcttcgaaaatctcttcaaaccaggtcagcttcaccttgccgtaggtatatgttactgacttcgtcagtcttatccggcaacctcaaaacggtgttttgagctgacttcgtcagttctatttgcaacctcaaaacagtgttttgagcaacctgtgactagctttctaatcgatgccttggttttcattgcctataatcaaaaagagaaattttctcctgaaaagcatatagagtagctggcgttaaaagctcctgtcttgcttttttgacctatagtcacatctatcaagtattgttcttgcctaagctatcaataaaaaggtggcattttttaggcttggtgttagtagattttgccttatcctatctaagtcatttcgaactttttatggtacaatggaaacatgttattcaaattatctaaggaaaaaatagagctaggcttatctcgtttatcgccagcccgtcgtatttttttgagttttgccttggtcattttactaggctctcttcttttgagcttgccctttgtccaagttgaaagctcacgagcgacttattttgatcatcttttcactgctgtctctgcagtctgtgtgacgggtctctcaacccttccagtagctcacacctataatatctggggtcaaataatctgtttgctcttgattcagatcggtggtctagggctcatgacctttattggggttttctatatccagagcaagcaaaagcttagtcttcgtagccgtgcaactattcaggatagttttagttatggagaaactcgatctttgagaaagtttgtctattctatttttctcacgacctttttggttgagagcttgggagctattttgcttagttttcgccttattcctcaacttggctggggacgtggtctttttagttccatttttctagcgatctcagccttctgtaatgccggttttgataatttagggagcaccagtttatttgcttttcagaccgatttactggtcaatctggtgattgcaggcttgattattacaggcggccttggttttatggtctggtttgatttggctggtcatgtaggaagaaagaaaaaaggacgtctgcactttcatacgaagcttgtactattattgactataggtttgttgttatttggaacagcaactactctctttcttgagtggaacaatgctggaacgattggcaatctccctgttgccgataaggttttagttagcttttttcaaacagtgacgatgcgaacagctggcttttctacgatagattatactcaggctcatcctgtgactcttttgatttatatcttacagatgtttctaggtggggcacctggaggaacagctgggggactcaagattacgacattttttgtcctcttggtctttgcacgaagtgagcttctaggcttgcctcatgccaatgttgcgagacgaacgatcgcgccgcgaacggttcaaaaatcctttagtgtctttattatctttttgatgagcttcttgataggattgattctgctagggataacagccaaaggcaatcctccctttatccacctcgtatttgaaaccatttcagctcttagtacagttggtgtaacggcaaatctgactcctgaccttgggaaattggctctcagtgttatcatgccacttatgtttatgggacgaattggtcccttgaccttgtttgttagcttggcagattaccatccagaaaagaaagatatgattcactatatgaaagcagatattagtattggttaagaaaggaaagagcatgtcagatcgtacgattggaattttgggcttgggaatttttgggagcagtgtcctagctgccctagccaagcaggatatgaatattatcgctattgatgaccacgcagagcgcatcaatcagtttgagccagttttggcgcgtggagtgattggtgacatcacagatgaagaattattgagatcagcagggattgatacctgcgataccgttgtagtcgcgacaggtgaaaatctggagtcgagtgtgcttgcggttatgcactgtaagagtttgggggtaccgactgttattgctaaggtcaaaagtcagaccgctaagaaagtgctagaaaagattggagctgactcggttatctcgccagagtatgaaatggggcagtctctagcacagaccattcttttccataatagtgttgatgtctttcagttggataaaaatgtgtctatcgtggagatgaaaattcctcagtcttgggcaggtcaaagtctgagtaaattagacctccgtggcaaatacaatctgaatattttgggtttccgagagcaggaaaattccccattggatgttgaatttggaccagatgacctcttgaaagcagatacctatattttggcagtcatcaacaaccagtatttggataccctagtagcattgaattcgtaaagagggatgacccctcttttttgatgcctaagatggcaaatagagacagaagccccttgtcttctagtaaaagttcttcaaaggctggactttatggtaaaatagaaagaagtgacaagagagagtaatactcaatgaaaatcaaagatcaaactaggaaactagctacgggctgctcaaaacactgttttgaggttgcagatagaactgacgaagtcagtaacatctatacggcaaggcgacgttgacgcggtttgaagagattttcgaagagtataagaaaaaatcagtcccctaaaggagtagattatgaagttattgtctatcgcaatttctagctataatgcagcagcctatcttcattactgtgtggagtcgctagtgattggtggtgagcaagttgggattttgattatcaatgacgggtctcaggatcagactcaggaaatcgctgagtgtttagctagcaagtatcctaatatcgttagagccatctatcaggaaaataaatgccatggcggtgcggtcaatcgtggcttggtagaggcttctgggcgctattttaaagtagttgacagtgatgactgggtggatcctcgtgcctacttgaaaattcttgaaaccttgcaggaacttgagagcaaaggtcaagaggtggatgtctttgtgaccaattttgtctatgaaaaggaagggcagtctcgtaagaagagtatgagttacgattcagtcttgcctgttcggcagatttttggctgggaccaggtcggaaatttctccaaaggccagtataccatgatgcactcgctgatttatcggacagatttgttgcgtgctagccagttctaactgcctgaacatactttttatgtcgataatctctttgtctttacgccccttcagcaggtcaagaccatgtactatctgcctgtcgatttctatcgttatttgattgggcgtgaggaccagtctgtcaatgagcaagtgatgattaagtgcattgaccagcaactcaaggtcaatcgactcttgatagaccaacttgatttgtcccaagtgagtcatcccaaaatgcgagaatatctgctgaatcatattgaactcacgacggtgatttccagtaccctgctcaaccgatctggaacagcggagcatctggcaaaaaaacgccaattgtggacctatattcagcagaaaaatccagaagtctttcaggctattcgtaagaccatgttgagccgtttgaccaaacattctgtcttgccagatcgcaaactgtccaatgtcgtctatcaaatcaccaaatctgtttatggatttaattaatataagtgttttataagagggatttaagaaaaattttaactttttcttagtcctttttaatttcaggagattatactagagtcatcaaataaagaaagactctaaggagaatcctatgaaattcaatccaaatcaaagatatactcgttggtctattcgccgtctcagtgtcggtgttgcctcagttgttgtggctagtggcttctttgtcctagttggtcagccaagttctgtacgtgccgatgggctcaatccaaccccaggtcaagtcttacctgaagagacatcgggaacgaaagagggtgacttatcagaaaaaccaggagacaccgttctcactcaagcgaaacctgagggcgttactggaaatacgaattcacttccgacacctacagaaagaactgaagtgagcgaggaaacaagcccttctagtctggatacactttttgaaaaagatgaagaagctcaaaaaaatccagagctaacagatgtcttaaaagaaactgtagatacagctgatgtggatgggacacaagcaagtccagcagaaactactcctgaacaagtaaaaggtggagtgaaagaaaatacaaaagacagcatcgatgttcctgctgcttatcttgaaaaagctgaagggaaaggtcctttcactgccggtgtaaaccaagtaattccttatgaactattcgctggtgatggtatgttaactcgtctattactaaaagcttcggataatgctccttggtctgacaatggtactgctaaaaatcctgctttacctcctcttgaaggattaacaaaagggaaatacttctatgaagtagacttaaatggcaatactgttggtaaacaaggtcaagctttaattgatcaacttcgcgctaatggtactcaaacttataaagctactgttaaagtttacggaaataaagacggtaaagctgacttgactaatctagttgctactaaaaatgtagacatcaacatcaatggattagttgctaaagaaacagttcaaaaagccgttgcagacaacgttaaagacagtatcgatgttccagcagcctacctagaaaaagccaagggtgaaggtccattcacagcaggtgtcaaccatgtgattccatacgaactcttcgcaggtgatggcatgttgactcgtctcttgctcaaggcatctgacaaggcaccatggtcagataacggcgacgctaaaaacccagccctatctccactaggcgaaaacgtgaagaccaaaggtcaatacttctatcaagtagccttggacggaaatgtagctggcaaagaaaaacaagcgctcattgaccagttccgagcaaayggtactcaaacttacagcgctacagtcaatgtctatggtaacaaagacggtaaaccagacttggacaacatcgtagcaactaaaaaagtcactattaacataaacggtttaatttctaaagaaacagttcaaaaagccgttgcagacaacgttaaagacagtatcgatgttccagcagcctacctagaaaaagccaagggtgaaggtccattcacagcaggtgtcaaccatgtgattccatacgaactcttcgcaggtgatggtatgttgactcgtctcttgctcaaggcatctgacaaggcaccatggtcagataacggtgacgctaaaaacccagccctatctccactaggtgaaaacgtgaagaccaaaggtcaatacttctatcaattagccttggacggaaatgtagctggcaaagaaaaacaagcgctcattgaccagttccgagcaaacggtactcaaacttacagcgctacagtcaatgtctatggtaacaaagacggtaaaccagacttggacaacatcgtagcaactaaaaaagtcactattaacataaacggtttaatttctaaagaaacagttcaaaaagccgttgcagacaacgttaaggacagtatcgatgttccagcagcctacctagaaaaggccaagggtgaaggtccattcacagcaggtgtcaaccatgtgattccatacgaactcttcgcaggtgatggcatgttgactcgtctcttgctcaaggcatctgacaaggcaccatggtcagataacggcgacgctaaaaacccagctctatctccactaggtgaaaacgtgaagaccaaaggtcaatacttctatcaagtagccttggacggaaatgtagctggcaaagaaaaacaagcgctcattgaccagttccgagcaaacggtactcaaacttacagcgctacagtcaatgtctatggtaacaaagacggtaaaccagacttggacaacatcgtagcaactaaaaaagtcactattaagataaatgttaaagaaacatcagacacagcaaatggttcattatcaccttctaactctggttctggcgtgactccgatgaatcacaatcatgctacaggtactacagatagcatgcctgctgacaccatgacaagttctaccaacacgatggcaggtgaaaacatggctgcttctgctaacaagatgtctgatacgatgatgtcagaggataaagctatgctaccaaatactggtgagactcaaacatcaatggcaagtattggtttccttgggcttgcgcttgcaggtttactcggtggtctaggtttgaaaaacaaaaaagaagaaaactaatcagctaaggaaataaatgatggatagtgggctgactaagattagtttaacaactcaatcagcaatcaggactttctttcaatagcagattaaaatcatcgtaaaacaataaaaatagtgttatacttaaagcagtatagcactgtttttatcaaaggagagacagatgggaaagacaattttactcgttgacgacgaggtagaaatcacagatattcatcagagatacttaattcaggcaggttatcaggtcttggtagcccatgatggactggaagcgctagagctgttcaagaaaaaaccgattgatttgattatcacagatgtcatgatgcctcggatggatggttatgatttaatcagtgaggttcaatacttatcaccagagcagcctttcctatttattactgctaagaccagtgaacaggacaagatttacggcctgagcttgggagcagatgattttattgctaagccttttagcccacgtgagctggttttgcgtgtccacaatattttgcgccgccttcatcgtgggggcgaaacagagctgatttcccttggcaatctaaaaatgaatcatagtagtcatgaagttcaaataggagaagaaatgctggatttaactgttaaatcatttgaattgctgtggattttagctagtaatccagagcgagttttctccaagacagacctctatgaaaagatctggaaagaagactacgtggatgacaccaataccttgaatgtgcatatccatgctcttcgacaggagctggcaaaatatagtagtgaccaaactcccactattaagacagtttgggggttgggatataagatagagaaaccgagaggacaaacatgaaactaaaaagttatattttggttggatatattatttcaaccctcttaaccattttggttgttttttgggctgttcaaaaaatgctgattgcgaaaggcgagatttactttttgcttgggatgaccatcgttgccagccttgtcggtgctgggattagtctctttctcctattgccagtctttacgtcgttgggcaaactcaaggagcatgccaagcgggtagcggccaaggattttccttcaaatttggaggttcaaggtcctgtagaatttcagcaattagggcaaacttttaatgagatgtcccatgatttgcaggtaagctttgattccttggaagaaagcgaacgagaaaagggcttgatgattgcccagttgtcgcatgatattaagactcctatcacttcgatccaagcgacggtagaagggattttggatgggattatcaaggagtcggagcaagctcattatctagcaaccattggacgccagacggagaggctcaataaactggttgaggagttgaattttttgaccctaaacacagctagaaatcaggtggaaactaccagtaaagacagtatttttctggacaagctcttaattgagtgcatgagtgaatttcagtttttgattgagcaggagagaagagatgtccacttgcaggtaatcccagagtctgcccggattgagggagattatgctaagctttctcgtatcttggtgaatctggtcgataacgcttttaaatattctgctccaggaaccaagctggaagtggtggctaagctggagaaggaccagctttcaatcagtgtgaccgatgaagggcagggtattgccccagaggatttggaaaatattttcaaacgcctttatcgtgtcgaaacttcgcgtaacatgaagacaggtggtcatggattaggacttgcgattgcgcgtgaattggcccatcaattgggtggggaaatcacagtcagcagccagtacggtctaggaagtacctttaccctcgttctcaacctctctggtagtgaaaataaagcctaaaacccctttacaaatccagctattcatggtagaatagattttgtgtgaaatatcagcaggaaagcatgaagctcgtcaacaggtgtcttatgacaagtaaccttggctgtttaggcgaagggcatctgcacgg

SEQ ID NO: 30 - DNA, 9769 bp; double-stranded, linear
ccggcgactatcgataacacttgacttggtagccccacattttggacaacgcatcctttccctccttatcgttttcttttcattataccattttttaagcgattcccaaaacaattcttctttttgcttgacaagttttttgttttgttgtattatttaattaagacaacaaggtaaaagaaaggagactaagatgtcctggacatttgacaacaaaaaacccatctatttacagattatggagaaaatcaagcttcagattgtttcccatacactggaacccaatcaacaacttccaaccgtgaggagctagctagcgaggctggtgtcaatcccaataccatccaaagagccttatcagaccttgaacgagaaggatttgtctacagcaagcgaacaactggacgatttgtgactaaggataaggagctaatcgcccagtcacgcaaacaattatcagaagaagaattggaacacttcgtttcctccatgacccattttggctatgaaaaagaagaactaccaggcgtagtcagtgattatattaaaggagtttaagcctatgtcattactagtatttgaaaatgtatccaaatcatatggagcaacaccagcccttgaaaatgtttctcttgacattccagctggaaaaattgtcggccttcttgggccaaacggctcaggaaaaacaaccctgattaaactaattaatggcctcttacaaccagatcaaggacgtgtcctcatcaacgacatggacccaagcccagcaaccaaggccgttgtagcttatttgcctgatacgacctatctcaatgagcaaatgaaggtcaaagaagccctaacctacttcaagaccttctataaagattgtcagatcttgaacgcgcccatcatctacttgcagacctgggcattgatgaaaatagtcgtctcaagaaactatcaaaaggaaacaaagaaaaggttcaactgattttggttatgagccgtgatgctcgtctctatgttttggacgaacccattggtggggtggatccagcagcccgtgcttatatcctcaataccattatcaacaactactcaccaacttctaccgttttgatttctacccacttgatttctgatatcgagccaatcttggatgaaattgtcttcctaaaagacggaaaagtcgtccgtcaaggaaatgtagatgatattcgctacgagtcaggtgaatccattgaccaactcttccgtcagaatttaaggcctaagcaaaggagattatttatgttttggaatttagttcgctacgaatttaaaaatgttaacaagtggtatttagccctctacgcagccgtgctagtcctttctgccctcatcggaatacagacacaaggctttaaaaatctaccttaccaagaaagtcaggctactatgctactttttctagctacagtctttggtggcttgatgcttacacttgggatttcaaccattttcttgattattaaacgcttcaaaggtagtgtctacgaccgacaaggctatctgactttgaccttgccagtttctgaacaccatatcatcacagccaaactaatcggtgcctttatctggtcattgattagcaccgctgtattggctctaagtgctgttattattctggctttaacagctccagaatggattcctctttcttatgtgattacatttgtagaaacacatctccctcagatctttcttacaggtatatccttcctactaaatactatttcaggaatcctctgcatctacctggctatttccattggacagcttttcaatgaataccgtacagcactcgctgttgcagtctacattggtatccaaatcgtcattggatttattgaacttttcttcaatcttagttctaatttctatgtcaattcactggtaggactcaatgaccatttctatatgggagcaggtatagccattgttgaagaactcatattcatagctatcttttatctcggaacctactacatcttgagaaataaggttaatttgctttaaataatttttacctagatatgtaacatactcatagaacaaaagagaccaggcaaaaagtctttaaaattagaaaacgcatagtatcaggtgttgaatatgtactgccccccaaaagttagattttttctgtctaacttttgggggcagttcataagaaccttggtaatatgcgttttttgtgagctgacttatttcctttcactatatcgcaaaatgaaataagaacggaacgatgggattttggaattcaaatcaatttataagaatgttttagaagtaatattatcctattccagattcagttcactatacaattgagttttcaagcaacctgtttacataatgtgtacataattaggttcgtgattccacccttttcacctttaaaaacctcgctttcgcaaggctcttctatttataagataaggcacgtttaaaggttttccaaatccctaaatcatccgtttgaagaacgagactagcatacatgcgtccgataaatcctgttgctaccaccgcaaaaatcactgtaatagcaagtgaaatccatgcttctgctccccccgcatagtcattaatcgttcgaaacggcataaagaaggtcgaaataaagggaatataagaaccaatcttcaagaggagattgtcaccagctgcacctagagctgtcactccaaaaaaaccacccataatcaaaatcatcaaaggcgacaaggctttccctgagtcctcaggacgagaaaccatagatcctaggaaggctgccaagactacgtacatgaaaagactgatcaaaataaagagcaaggtattcagtgagatagcatctcccaagtgatccaaaataccagactgagccaagaatggcaaatctttaaagagcaaaacggcagccagaccacctacaacatagatcccaatatgcgttaaaatcactagaaacagagccatcatccgcgcatagaaatagtgacttgcccttatgctagaaaaaacgacttccataattttggtgcctttttcactggcaacttcctgagctgttacacccgcataggtaatcagaatcatataaagaaagaatcctaaggcacctgctgcaattgtttgaataaactttttattttccttggcttcatcaatcttttctgtgaattgaattgtctgcgctaagcgtttttcctgctcttgagacaaggaagcagttgaacgattaagctgattttgcagttcattgagtgtacctgtaacctcaaatttaattccattttcaagcgatgtttcgccatgataaactgcctttagaacactatcttcttgatcaatggtcaaataaccttttaatttttcttctttaattgcttctttggcacttgcttcgtctttatagtcgaagttaacaccatttacattcttcagtccttctgctacagatggcactgttgtcactactgccactttattatttttagccatagaagaaccttggagatgcccaattcctacagagattcctaaaaagaggaacggcgaaatcaccataaagaagaaactccatgactcgacatgtcgaagataggtttccttgattacaacccacatatttctcatacttccactcctgattctagtttaaagatttcatcgatagttggcgcttgttggtcaaatgttgcgatatattgaccttgagtcaagattgagaagagttcccttccagcgctctcatcctccaaaatcaatttccaactgccttgtttggtcaagctcacctgtttgacatgaggaagattttccaattcttccttgcttcgttcacttgaaacaaagagacgcgttttcccgtattgattgcggacatcctgaactggtccgtgcaagaccacacggccatctcggatcatcagaatatcgtcacaaagttcctcaacattggtcatgacatggtcagaaaagataatggttgtccgcgctctttttcctgaaaaatgacttgtttgagcaattctgtattaactgggtccaatccactaaaaggctcatccaagataatcaggtctggttcatgaatcagagtaataatgagctgaatcttctgctgatttccttttgacagactcttgattttatctgtcagctttcctttcacttccaacctcttcatccattgagggagtttttctttgacttctttggcatccatgccttttagagtcgccaagtagcgaacttgttcaagaactgtcaatttaggcatgagatgcgttcttcaggcagataaccaatccgagcataggtctcctgacgaatatcctgaccatccagaccgatttctccctgatattctaggaatttcaaaatactatggaaaatcgttgtttttccagcaccattttttccgactagtcccaaaatacgacctggtcgcgcttgaaagtcaataccaaacaaaacttgcttggatccaaaacttttctctagacttcttacttctagcatctttcacctccgaaatttcttgcactcattatactcctttttgatagcctttacaatgttttttgtccatttttagaagactattgctgtgtaaaatatggcctggagcacttttatactcaatgaaaatcaaagagcaaactaggaagctagccgtagactgctcaaagtacagctttgaggttgcagataaaactgacgaagtcgactcaaaacactgttttgaggttgtggatagaactgacgaakcrtaactatatctacggcaaggcgaactgacgtggtttgaagagattttcgaagagtattagtgataaatccattatacagcagcaaacttaatttataccttccgctcctcaactgtctatttttaatcctgaattgttatttgagtaactcctttttcctcgtaaagttttcttcctctaaaacttctggaaaaaggctaatagtttcagacaacatttttataagaaacaagttcatctgtcatttcaagaaggagtaatcctttatctactaatggacggaacagaattcaaccgcttgtccgatatgttttctaaggattatatagtaaaatgaaataagaacaggacaaattgatcaggacagtcaaattgatttctaacaatgttttagaagtagatgtatactattctagtttcaatctgctatatctattatgcacacccctataggatctaatgaaaatcacaacaggctcattcatagatggttacctaagcctaagggaactaagaaaacgactaccaaggaagtcgcattcatcgaaaagtagattaacaactatcctaaaaaatgcttgaactacaagtcccccagagaagacttctggatgactaacttgaacttgaaatttagcaataattaattcactatctaactatatttagtaattatttcagaactgattaatattaaaattaactaacaattcaaaggattcatactagccataaattacgtccatcagagagagactcttactacttttagattttagtctttctagcttcagaatacatctaaactttagggaaaatgactattcgaaagcgcgaatgcctcaaaattatctcagataagctattcgaaacttagaatgcttttaaatttatggaattgcgattattcgaaacctagaatgcatataacctttagttgacagacctattctaagtctcgaagggctatttactttctattccttatcaaaaaagactcattccccctttctcctccaaaatatggtatagtagaaatatactatctatgaggagtttacatgtcacaggataaacaaatgaaagctgtttctccccttctgcagcgagttatcaatatctcatcgattgtcggtggggttgggagtttgattttctgtatttgggcttatcaggctgggattttacaatccaaggaaaccctctctgcctttatccagcaggcaggcatctggggtccacctctctttatctttttacagattttacagactgtcgtccctatcattccaggggccttgacctcggtggctggggtctttatctacgggcacatcatcgggactatctacaactatatcggcatcgtgattggctgtgccattatcttttatctagtgcgcctatacggagctgcctttgtccagtctgtcgtcagcaagcgcacctacgacaagtacatcgactggctagataagggcaatcgttttgaccgcttctttatttttatgatgatttggcccattagcccagctgactttctctgtatgctggctgccctgaccaagatgagcttcaagcgctacatgaccatcatcattctgaccaaaccctttaccctcgtggtttatacctacggtctgacctatattattgactttttctggcaaatgctttgacacgtaaaaaatccgtttggtttcccaagtggatttttaaagcgtagattaactatagcttgatactaaatatactttggtatggaaatcatgcatatttttcgatagtgaggcgaggacttacctagcctttccgccgtgatagaaacacctgaaatctaatggtttcaggtattcggaaactttgagcctagtgtctcaaagtttaggtatggaattttgaagaaagtcgctaccgtccgtaatcacttaaggaaaggctcaaaaatattgttttcaaccacaaaatccgtttggtttcccaagcggattttgtgctttattttgaaacttcttttgcaagaacaaagttcccaagtgtggcagaaccatttcctgcgactgctggcgtcacgatatagtcacgcacatctggtactggtaggtaaccattaagaagagatgtaaatttctcacggacacggtccagcatatgttgttgagccatgacccctccaccaaagacaatcacgtctgggcggaaagtcactgtcgcattaaccgcagcttgagcgatatagtaggcttgaacatcccaaacagggttgttgagttcaatagtttccccacgtacacctgtacgagcttccaaacttggaccagctgcataaccttctagacatcccttatggaaaggacaaacacccttaaactctttttcaatatccattgggtgtctagcaacataataatgacccatttcagggtgacccacaccaccgataaactcaccacgttggatgacgcctgcaccgatacctgtaccgattgtgtagtaaaccaagttttcgatacgaccaccagcattgttacgggcaaccatttcaccgtaagcagagctgtttacgtctgttgtgaagtacattggcacgtttagggcgcgacgaagggcaccaagcaagtctacatttgcccagtttggttttggagtcgtcgtgataaagccataagtttttgagtttttgtcaatatcaatcggcccaaatgaaccaactgcaagaccagcaaggttatcgaattttgagaagaactcaatggttttatcgattgtttcgattggagttgttgttggaaattgtgttttttctacaacgttaaagttttcatcaccgacagcacagacaaactttgtaccgcccgcttccaagcttccatataattttgtcatgataaacctcttgtttttattttctttattatagcatacttcgaaagtctaaatgtctctattttttagattttcctctgtaaatcttactatctaataaaaacgaacaaacatgtcatttgttcgttttcacattagagaggattgattagattttcacttcgatcacagcatcccccttagcaactgaacctgttgcgactggagctactgaagcgtagtcacctgtatttgtaacgataaccattgttgtatcatcaagtccagctgcagcgattttgtttgagtcaaatgttccaagaacatcgccagctttcaccttattaccttgagcaacttttgtttcaaaaccgtcaccgttcatagatacagtatcaataccaacatgaatcaaaacttcagcaccatttcttgttttcaaaccaaaagcgtgccctgttggaaaggcaattgaaacttcagcatcagctggtgcatagaccacgccttggcttggtttcacaacgataccttgtcccatagctccacttgagaagactgggtcattgacatcagcaagagcgacaacatcaccgacgataggagttacaagtgtttcattttgaagagctgctggcgcaacttcttctttttcttcagccacttcagctcgttttgcagctgcagttgcgtctacttcatcttcgtaaccaaacatgtaagtaagagcaaaaccaagggcaaatgatacagctaccataagaaggtattgtggaagttgtccgttaccaacataaagcattgtaccagggatgatggtgataccattaccagtaccagcaagtccaaggatagaagccaatccaccaccgattgcaccagcaatcaatgaaaggaagaatggtttacggaagcgcaagttcaccccgaagatagcaggctctgtaatacctaggaaggcagaaagagcagccgggaaagcaagtgttttcagttttggattttttgttttaacaccaaccgcaacagtagcagcaccttgagctgtcatagcagctgtgatgatagcgttgaatgggttagcatggtcagcagcaagtaattgcacttcaagcaagttgaagatgtggtgcacacctgacacgacgatcaattggtgaaccccaccaatcaagaaaccaccaagaccaaatggcatgctaagaatcgcttttgtagcaataaggatgtagttttcaacaacgtggaaaactggtccaatgacaaagagtccaaggatagacatgaccaaaagtgtcacgaatggtgttaccaagaggtcaatgacatctggaacaacttgcggacagctttttcaaatttagctccgacaaccccgatgatgaaggctggaagaacggaaccttgcaaaccaacaacagggatgaaaccaaagaagttcatcgctgttacttcaccaccttgagcaactgcccaagcgtttggaagtgagccagagacaagcatcataccaagaacgataccaacggcaggatttccaccaaatacacggaaggttgaccacacaaccaaacctggcaagatgatgaaggctgtatctgtcaagatttgtgtgtaagttgcaaagtcacctggaagtggcatttcaagagcgttgaaaagaccacgcacacccatgaagagacctgtcgctacgataactgggatgattggaacgaaaacatcaccaaaagtacggatagcacgttggaaccagttcccttgtttagcaacttctgctttcatgtcatccttagatgatgttggtaatccaagtacaacaacttcatcgtacattttgttaactgtacctgtaccaaagataatttggtattgccctgagttaaagaaagcaccttgaactttttccaagttctcaatcacttctttattgattttctcttcatctttgaccatgacacgtagacgagtcgcacagtgggcaacactattgacattttcacgtccgcccaaggcatcgatgactttttttgcaatttcctgattgttcatttgcaaaaatctccttatataacattttgttcttgtttgaaagcgattttattcgccgg

SEQ ID NO: 31 - DNA, 3149 bp; double-stranded, linear
cgcttgagtgctaattcatagttctattgtatcacttggtcagaaataatcaagaaaaaagtctgactttctcaagataaaaagcctgagaccaactcagactttttaattcttaaaatggcaattcttcctcttccaagaccaaatctgccaaatcttggcctgcattattttcacgcatagcacgttgggcacgactttccaagagttggaatcctgtgacaagtacttcggtcacgtagttcatttggccatttttctcaaagcgacgggtacgcaattctccatcaacggaaatgagactacctttggttgcgtacttgccaaagtttctgctagtctgccccataggaccatattgacaaaatcagcttcacgttcaccgttttggtctttgtaacgacggttcacagcgatagttgctcgcgctaccgacttgtcattgttggttttgtgcaattctggtgtagacgttaaacgtccaatcaagataactttattatacatattttcttcctcctacttatctattcgtaggaaatcaaaaaaagttacagaaatttgtaacttttcgagaaaattttttattttttatgaaccatgaaacctgtcgcctgttgattggccataatggtcatatctgtaatctgaacacgacgaggttgactagtcacatagactactgtatctgcaatatcctgagcttgcaaagcttctattccttggtaaacggacgcagctcgttctttatcaccatgaaaacgcactgtagaaaaatctgtttcgacaattccaggctgaatggtcgtcaccttgatatccgttgcgatggtatcaattcgcagtccatctgaaaaggtcttaactgccgccttggtggctgagtaaacagctgcaccagcataggcataaattcctgcggttgaccccatattgataatatgaccttgattggcttttaccattgctggcaagaaacagcgagtgactgccatcaaacctttgacattggtatccaacatggtcagcatatccaactcttcatagtcttgatagggagctaagccaagagccagtcctgcgttattgaccaggatgtcaatctgacctatcgtttctaaaatatcagagcagacagtctttaccattgtcatatccgtgacatctaggagaaaagtccaaactgtttgatttggaaaagtttctgcaaactccgccttaagagcttctagtctgtctatccgtcgtcctgttagaacgacatcctcaccctgctccagataagcacgcgcaatcgcttcaccgattcctgatgtcgctcctgtaatcacaacattttttgccatcttatttccttctagctggtctatcagatattaacaacttcttaggcagtccagtgtttcgctgggtcgaacggtgttccgacaacttggtcttctgataattcaagcaccccacgtttttgtggagcatttggcagatgcaattcacgaggactgcacatcataccaaaactcttttcaccacgaagttcacctgggaaaatgagattcccttttggcatcatagctccaggaagcgcgacaatggttttcaaccccacacgcgcattgggagctcctgcaacgatttgtacagtcttatcacttgcgactgcaacttggcagatgttgaggtggtcactatctggatgggctaccatctcaacaatttcacctacaacaaacttaggttccttatcattaacaatttcttctgtaaaaccttccgcctgcaactcttggttcaaacgagcgacttgctcatctgtcaaaaagacttgaccgcgctctgcaatttcaaataaacttgaaacttcgaaaatattccaagccactgtttccccattatctttgagaaaaacacgggctaccttgcctttgcgctccacatccagtttggcatctccgctatttttcacgatgaccataaggacatcaccgacatgttctttattatatgtaaaaatcattgtttcctttttctcctatttcagtcctgctaaaaagtcattgatttgttgcttgcttttacggtcgcgattgacaaaacgaccgatttccttgtccttttctagaacaacaaggctaggaattccgtaaacatcccagagtttggccaaatccatatactgatctcggtccattcgaataaaggtgaactctggattggtctcctcaatctctggtaaggcaggataaatataacgacaatcgctacaccagtctgccacaaaaatgaagaccttcttgcccgctttttccactaaagatgctaattcttctaaacttgctggctgtatcataagacttcctcctcatagactaggtcttcattttcatagacaaaggtataatgacggccatcctcaaaaatgacgccaccaaccaagctctccagactgctttcgtaaacttgaacataaagggtcgcaatttcccccatgtcggaaaaatggtctcgcacaatctctgtcaactcttcctgagtcttcatgagcttacggtcatctgcaacttttttcgtagcaagagcaaggcttccgatacctagcagagccaagcctgccatccacatttttttagctttcataccattcattttaacacaaaaaaggcttcaggacaaatgaggaagcagcagaaaagcaagtaaaaagcctcttcctttaaggaaaaggacttcttatactcaatgaaaatcaaagaccaaactaggaagctagccgcaggctgctcaaagcactgctttgaggttgtagatagaactgacgagtcactcaaaacactgttttgaggttgtggatgaagctgacgtggtttgaagagattttcgaagagtattattcttattgccaggcacctaagttgccaacgtagtaactatcaggtgtgtaggtattgcgagcatcttacctgatgaagccagataatactacttgccattgtctttgacccaatcattcgcaatcatggaaccagaagaacttacataataccattctcccttgtcataaacccaagtactgactttcatggttcctgagcaattaaaggcaaaaaaactgtccaataacattcgttttttaaaagcatttgacactacat

SEQ ID NO: 32 - DNA, 10240 bp; double-stranded, linear
ccaaaaattcaacctttaaggggagtccagagagactcacaaggtgtcagataaaagaatggtgcaattttctagaggagactttttgagtgtgctctcttgtgttgtacgattttaactgaggccttgcactagcaaggtcttttctttatctggtccccttaaaatttaaggaggaaaagttatgaatcccacatgtaagaagcgtttgggtgtcattcggttggaaaccatgaaggtggttgcacaagaggaaatcgcgccacaatctttgaattagtcctagaaggagaaatggttgaagccatgcgagcaggccaatttcttcatctgcgtgtaccggacgatgcccatctcttacgtcgtcctatttcaatttcgtctattgacaaggcaaacaagcagtgtcacctcatttatcggattgacggagctgggactgcaattttttcaaccttaagtcagggagacactcttgatgtgatggggcctcagggaaatggttttgacttgtctgaccttgatgagcagaatcaggttctccttgttggtggtgggattggtgttccacccttgcttgaggtggccaaggaattgcatgaacgtggagtgaaagtagtgacagtcctcggttttgctaataaggatgctgttattttgaaaacggaattggctcagtatggtcaggtctttgtaacgacagatgatggttcttatggcatcaagggaaatgtttccgttgttatcaatgatttagacagtcagtttgatgctgtttactcgtgtggggctccaggaatgatgaagtatatcaatcaaacctttgatgatcacccaagagcctatttatctctggaatctcgtatggcttgtgggatgggagcttgctatgcctgtgttctaaaagtaccagaaaacgagacggtcagccaacgcgtctgtgaagatggtcctgttttccgcacaggaacagttgtattataaggagaaaattatgactacaaatcgattacaagtttctctacctggtttggatttgaaaaatccgattattccagcatcaggctgttttggctttggacaagagtatgccaagtactatgatttagaccttttaggttctattatgatcaaggcgacaacccttgaaccacgttttgggaatccaactccaagagtggcagagacgcctgctggtatgctcaatgcaattggcttgcaaaatcctggtttagaggttgttttggctgaaaagctaccttggctggaaagagaatatccaaatcttcctattattgccaatgtagctggtttttcaaaacaagagtatgcagctgtttctcatgggatttccaaggcaactaatgtaaaagctatcgagctcaatatttcttgtcccaatgttgaccactgtaatcatggacttttgattggtcaagatccagatttggcttatgatgtggtgaaagcagctgtggaagcctcagaagtgccagtttatgtcaaattaaccccgagtgtgaccgatatcgttactgtcgcaaaagctgcagaagatgcgggagcaagtggcttgaccatgatcaatactctggttggaatgcgctttgacctcaaaactagaaaaccaatcttggccaatggaacaggtggaatgtctggtccagcagtctttccagtagccctcaaactcatccgccaagttgcccaaacaacagacctgcctatcattggaatgggaggagtggattcggctgaagctgccctagaaatgtatctggctggggcatctgctatcggagttggaacagctaactttaccaatccttatgcctgccctgacatcatcgaaaatttaccaaaagtcatggataaatacggtattagcagtctggaagaactccgtcaggaagtaaaagagtctctgaggtaaactgcaatcaatctgttcttgattttttattagtttgtaatatgaatttaggagaattttggtacaataaaataaataagaacagaggaagaaggttaatgaagaaagtaagatttatttttttagctctgctatttttcttagctagtccagagggtgcaatggctagtgatggtacttggcaaggaaaacagtatctgaaagaagatggcagtcaagcagcaaatgagtgggtttttgatactcattatcaatcttggttctatataaaagcagatgctaactatgctgaaaatgaatggctaaagcaaggtgacgactatttttacctcaaatctggtggctatatggccaaatcagaatgggtagaagacaagggagccttttattatcttgaccaagatggaaagatgaaaagaaatgcttgggtaggaacttcctatgttggtgcaacaggtgccaaagtaatagaagactgggtctatgattctcaatacgatgcttggttttatatcaaagcagatggacagcacgcagagaaagaatggctccaaattaaagggaaggactattatttcaaatccggtggttatctactgacaagtcagtggattaatcaagcttatgtgaatgctagtggtgccaaagtacagcaaggttggctttttgacaaacaataccaatcttggttttacatcaaagaaaatggaaactatgctgataaagaatggattttcgagaatggtcactattattatctaaaatccggtggytacatggcagccaatgaatggatttgggataaggaatcttggttttatctcaaatytgatgggaaaatrgctgaaaaagaatgggtctacgattctcatagtcaagcttggtactacttcaaatccggtggttacatgacagccaatgaatggatttgggataaggaatcttggttttacctcaaatctgatgggaaaatagctgaaaaagaatgggtctacgattctcatagtcaagcttggtactacttcaaatctggtggctacatggcgaaaaatgagacagtagatggttatcagcttggaagcgatggtaaatggcttggaggaaaaactacaaatgaaaatgctgcttactatcaagtagtgcctgttacagccaatgtttatgattcagatggtgaaaagctttcctatatatcgcaaggtagtgtcgtatggctagataaggatagaaaaagtgatgacaagcgcttggctattactatttctggtttgtcaggctatatgaaaacagaagatttacaagcgctagatgctagtaaggactttatcccttattatgagagtgatggccaccgtttttatcactatgtggctcagaatgctagtatcccagtagcttctcatctttctgatatggaagtaggcaagaaatattattcggcagatggcctgcattttgatggttttaagcttgagaatcccttccttttcaaagatttaacagaggctacaaactacagtgctgaagaattggataaggtatttagtttgctaaacattaacaatagccttttggagaacaagggcgctacttttaaggaagccgaagaacattaccatatcaatgctctttatctccttgcccatagtgccctagaaagtaactggggaagaagtaaaattgccaaagataagaataatttctttggcattacagcctatgatacgaccccttacctttctgctaagacatttgatgatgtggataagggaattttaggtgcaaccaagtggattaaggaaaattatatcgataggggaagaactttccttggaaacaaggcttctggtatgaatgtggaatatgcttcagacccttattggggcgaaaaaattgctagtgtgatgatgaaaatcaatgagaagctaggtggcaaagattagtactataagtgaatatgatttgagtgaatagtaagttaaaaatcctgatttcaagtaaaatcaggattttttcatggatgcaatttttttggagtctggtgtgacgcggagggtcttttgtcctgtgtaagtgacaaagccgggttttccaccagttggtttattgagttttttgacttcaatcatatctacctgcaccagattcgacaggcgcccttgagagaagtaggcagctaactctgctgcgtctgtcttgactgcatcagatgggtcaagatttcctgagatgacaacatggcttccaggaatgtccttagcatggaaccaaagttcctccttgcgggccattttaaaggtcaattcctcattttgaagattgtttcgtccgacatagatgatggttttgccatcgcttgctagatattgttctagttttttgcgtttctggattttctcccgttgtcttctgcggataaaacctgtttgaatcaattcttcacggatttcagcgatttcttccagtccagcttggttgaggacggtttctacactttccagatagagaatagtggctttggtttcttcaatcaaatcagtcaagtatttgacagcttctttgagtttctgataccgtttaaaatagcgttgggcattctggttgggagtcagagccttatcaagcgcaatcatgataggttggttggtatagtagttgtctaggataacctggtcttggtcgttaggcacttggtggaggaaggttgtcagcaattctcctttttgacgaaattcttcagcgttgtctgtcgccagtaactctttttcctgttttttgagtttgtgtcggtttttctgaagttcattttcaacacgacgaatcagttcactggcctgctgtttgacgcggtcgcgctcagccttatccttatagtaggtgtccaacaaatcagaaagatttgcaaaaggctctcccacctgatttgcaaaaggaactggactgaaggaagtctcagtcaagcatggcttggtttcttgattgaaaaaatttcggaaagcggaaagtttttcactaaccagtatcctttccaattcatttgccgtatcgcgtcccagaccttgaaagaggctttgaagattttttgctgttagttcttgggtttgcaggatttcaaagagcttttcatccttgatagtaaaaggattgagagattttgtacttggcggagcgatataggtcgatcctggaagtaaggtgcggtagctattttgtgaaaagccgacgtgtttgataacttcgaggattttatgactgcttttatcgaccagtagaatattactgtgtttccccataatttcgataatcaaggtagcctggatatggtctccaatctcgtttttattggaaactgtaatttccacaatacggtcattttccacttgctcaatcgactcaatcagggccccctgcaaatactttctcaaaaccatgataaaggtagaaggttgagctggattttcaaaagtcgtttgggtcagctgaatgcgtccaaaaactggatgggcagaaaggagcaggcgatggctttggcgattgctgcggatttgcaagaccaactcttgttcaaaaggctgattgattttctggatgcgaccattcactaattcgcttcgcaattcctcaactatgtggtgtaaaaaaaatccgtcaaatgacatcgttctctccttgtgattgtattccatagtattatatcaaaaaggtagaataaaatcatggaaatgtggtataataaagccaagtaaagagaaacgagaagcacatgtatattgaaatggtagatgaaactggtcaagtttcaaaagaaatgttgcaacaaacccaagaaattttggaatttgcagcccaaaaattaggaaaagaagacaaggagatggcagtcacttttgtgaccaatgagcgtagtcatgaacttaatctggagtaccgtaacaccgaccgtccgacagatgtcatcagccttgagtataaaccagaattggaaattgcctttgacgaagaggatttgcttgaaaattcagaattggcagagatgatgtctgagtttgatgcctatattggggaattgttcatctctatcgataaggctcatgagcaggccgaagaatatggtcacagctttgagcgtgagatgggcttcttggcagtacacggctttttacatattaacggctatgatcactacactccggaagaagaagcggagatgttcggtttacaagaagaaattttgacagcctatggactcacaagacaataaacgaaaatggaaaaatcgtgacttgatatccagtttagaatttgctttgacaggtatttttactgctatcaaggaagaacgcaatatgcgaaaacacgcagtgacggctctagtggtcatccttgcaggttttgtttttcaggtgtcacgaatcgaatggctctttctcctattgagtattttcttggtagtagcctttgagattatcaactctgctattgaaaatgtggtggatttggccagtcactatcacttttccatgctggctaaaaatgccaaggatatggcggccggcgcggtattagtggtttctcttttcgcagccttaacaggcgcattgatttttctcccacgaatctgggatttattattttaaacagtaagaggaaattatgacttttaaatcaggctttgtagccattttaggacgtcccaatgttgggaagtcaacctttttaaatcacgttatggggcaaaagattgccatcatgagtgacaaggcgcagacaacgcgcaataaaatcatgggaatttacacgactgataaggagcaaattgtctttatcgacacaccagggattcacaagcctaaaacagctctcggagatttcatggttgagtctgcctacagtacccttcgcgaagtggacactgttcttttcatggtgcctgctgatgaagcgcgtggtaagggggacgatatgattatcgagcgtctcaaggctgccaaggttcctgtgattttggtggtgaataaaatcgataaggtccatccagaccagctcttgtctcagattgatgacttccgtaatcaaatggactttaaggaaattgttccaatctcagcccttcagggaaataacgtgtctcgtctagtggatattttgagtgaaaatctggatgaaggtttccaatatttcccgtctgatcaaatcacagaccatccagaacgtttcttggtttcagaaatggttcgcgagaaagtcttgcacctaactcgtgaagagattccgcattctgtagcagtagttgttgactctatgaaacgagacgaagagacagacaaggttcacatccgtgcaaccatcatggtcgagcgcgatagccaaaaagggattatcatcggtaaaggtggcgctatgcttaagaaaatcggtagcatggcccgtcgtgatatcgaactcatgctaggagacaaggtcttcctagaaacctgggtcaaggtcaagaaaaactggcgcgataaaaagctagatttggctgactttggctataatgaaagagaatactaagtagaggtaggctcatgcctgcttcttgtttttacagaaggaggacttatgcctgaattacctgaggttgaaaccgtttgtcgtggcttagaaaaattgattataggaaagaagatttcgagtatagaaattcgctaccccaagatgattaagacggatttggaagagtttcaaagggaattgcctagtcagattatcgagtcaatgggacgtcgtggaaaatatttgcttttttatctgacagacaaggtcttgatttcccatttgcggatggagggcaagtatttttactatccagaccaaggacctgaacgcaagcatgcccatgttttctttcattttgaagatggtggcacgcttgtttatgaggatgttcgcaagtttggaaccatggaactcttggtgcctgaccttttagacgtctactttatttctaaaaaattaggtcctgaaccaagcgaacaagactttgatttacaggtctttcaatctgcccttgccaagtccaaaaagcctatcaaatcccatctcctagaccagaccttggtagctggacttggcaatatctatgtggatgaggttctctggcgagctcaggttcatccagctagaccttcccagactttgacagcagaagaagcgactgccattcatgaccagaccattgctgttttgggccaggctgttgaaaaaggtggctccaccattcggacttataccaatgcctttggggaagatggaagcatgcaggactttcatcaggtctatgataagactggtcaagaatgtgtacgctgtggtaccatcattgagaaaattcaactaggcggacgtggaacccacttttgtccaaactgtcaaaggagggactgatgggaaaaatcatcggaatcactgggggaattgcctctggtaagtcaactgtgacaaattttctaagacagcaaggctttcaagtagtggatgccgacgcagtcgtccaccaactacagaaacctggtggtcgtctgtttgaggctctagtacagcactttgggcaagaaatcattcttgaaaacggagaactcaatcgccctctcctagctagtctcatcttttcaaatcctgatgaacgagaatggtctaagcaaattcaaggggagattatccgtgaggaactggctactttgagagaacagttggctcagacagaagagattttcttcatggatattcccctactttttgagcaggactacagcgattggtttgctgagacttggttggtctatgtggaccgagatgcccaagtggaacgcttaatgaaaagggaccagttgtccaaagatgaagctgagtctcgtctggcagcccagtggcctttagaaaaaaagaaagatttggccagccaggttcttgataataatggcaatcagaaccagcttcttaatcaagtgcatatccttcttgagggaggtaggcaagatgacagagattaactggaaggataatctgcgcattgcctggtttggtaattttctgacaggagccagtatttctttggttgtaccttttatgcccatcttcgtggaaaatctaggtgtagggagtcagcaagtcgctttttatgcaggcttagcaatttctgtctctgctatttccgcggcgctcttttctcctatttggggtattcttgctgacaaatacggccgaaaacccatgatgattcgggcaggtcttgctatgactatcactatgggaggcttggcctttgtcccaaatatctattggttaatctttcttcgtttactaaacggtgtatttgcaggttttgttcctaatgcaacggcactgatagccagtcaggttccaaaggagaaatcaggctctgccttaggtactttgtctacaggcgtagttgcaggtactctaactggtccctttattggtggctttatcgcagaattatttggcattcgtacagttttcttactggttggtagttttctatttttagctgctattttgactatttgctttatcaaggaagattttcaaccagtagccaaggaaaaggctattccaacaaaggaattatttacctcggttaaatatccctatcttttgctcaatctctttttaaccagttttgtcatccaattttcagctcaatcgattggccctattttggctctttatgtacgcgacttagggcagacagagaatcttctttttgtctctggtttgattgtgtccagtatgggcttttccagcatgatgagtgcaggagtcatgggcaagctaggtgacaaggtgggcaatcatcgtctcttggttgtcgcccagttttattcagtcatcatctatctcctctgtgccaatgcctctagcccccttcaactaggactctatcgtttcctctttggattgggaaccggtgccttgattcccggggttaatgccctactcagcaaaatgactcccaaagccggcatttcgagggtctttgccttcaatcaggtattcttttatctgggaggtgttgttggtcccatggcaggttctgcagtagcaggtcaatttggctaccatgctgtcttttatgcgacaagcctttgtgttgcctttagttgtctctttaacctgattcaatttcgaacattattaaaagtaaaggaaatctagtgcgagtaaaaatcaatctcaaatgctcctcttgtggcagtatcaattacctaaccagtaaaaattcaaaaacccatccagacagattga

SEQ ID NO: 33 - DNA, 13206 bp; double-stranded, linear
cgctttatcgtggacgtggtcaagccgagaatttcatcaaggagatgaaggagggattttttggcgataaaacggatagttcaaccttaatcaaaaacgaagttcgtatgatgatgagctgtatcgcctacaatctctatctttttctcaaacatctagctggaggtgacttccaaactttaacaatcaaacgcttccgccatctttttcttcacgtggtgggaaaatgtgttcgaacaggacgcaagcagctcctcaaattgtctagtctctatgcctattccgaattgttttcagcactttattctaggattagaaaagtcaacctgaatcttcctgttccttatgaaccacctagaagaaaagcgtcgttaatgatgcattaaagaacagtcgagatgaaaaaatcgtgtgacgcaccaagggaggagtctgcccttttgaggaaatctagcgaggaaaaacgatactggaacagcagaaagtaaaactgacctcatgaggaggaagaaagtggctcatgaggtcaggggttttgtaagttacatctagttgagagaggtatgaatgatttgggattaatcatttcttgttttaaatcaggagaatagtaacgattttttccttttttgacgaactctattccgtaacgatcaatcaatttaatcatgtacctaatattagaattgtttatcccaaatttatttgaaagcttctctaagctatatccttgttttctaagttcatagatctgaactttatcatcataagttagtttcataataaaaacaccccaaaagttagattttttctgtctaacttttggggggcagttcattcaacacctgatactatgcgtttttcttatttgaaatactttttactcaacctctttatactcaatgaaaatcaaagtgcaaactagaaagctagcctcaggctgctcaaaacagtgttttgaggttgcagatggaagctgacgtggtttgaagagattttcgaagagtattacttaatcttcttgatactttgactaagaataaatcctacaatcatccctaccatattttgcataaaattcggtagaatttctgggagggctgctgcccagccattcatcaaagcagaacccaaggcgtagcctcctaccatggcaatagttgctaaaataaggcctaaccactgactttttcctttaaatcctgcgaaaaatccctgcaagccatggttgaccaagctaaagaacatccactgagggtagcctgataagaggtcaatcaagaaacttgctagtcctccgactaccgctccttcacgactaccaaagtaaaaggccgcaaagaagacaccagcatctaaaagagttagaattcctgtaggtgttgggatttttaagaaataacctagaaccacagaaagggcggttaatagggatacaagggcgattttagttgtttttgtttgcttcatattgtcttactccatactgatctgcttgtgcaatagcacgataaacgaaagccttagagctttctactgctggcaaaagtttatcacctttaaccaggtgactggcaatgctagagscaaaggtacaacstgcaccagcattttggccttggataactggattttctaggatagtaaaggtctgtccatcataaaagacatccacagccttgtcctgactaagacgattgcctcccttgataatgactgtggcgctcctaaatcatgcaatttctgcgctgcagttttcatgtcttccaaggttttaatttcctgaccggataataattctgcttctgggagattaggcgtaatcacactgacataagggaaaaagcgaatcaactcttggcagagctcactgacagctacatcatgcgtttccttgcagaccaagacaggatccaacaccacaggtactcctgggcgttgtttgataaagtccaaggccttctcagccacgctgacagtagggagaagaccaatcttaattcccccaaattccacatcacgcaagctatctaattcatgttgaaaaatggtatcatcagttggaaagacttcaaatcctttttctgtcaaggctgtcaaacaagtcactgctacaaacccatgcaagccgttcaaggtataggtagccaaatcagctgacagtccaccaccactaaaaatatcatttccagaaagtgctaaaatacgattattcttcataacgaatctcctttaaatacaaaccatttggtgctgcagtgggacctgcaagttgcctgtccttcttctccaagatgagatcaatctgctctactggcatgcggttgttaccgattttgagaagagtccccaccatattgcgaatctgtttatacaagaaaccatttcctgaaaaggtaaaggtcaaaaattgtcctgtctcatcgactattaaactagcttctgtgatggtgcgaaccttatcctctacactagtcccagaggctgtaaaaccggtaaaatcatgggttccctctagctttttgattgcaatctgcattcgttccacatcgagtgggtagggaaagtgggtggcatagtgacggcgcatcggatttttgggacgtcctctatccacagtaaactcataggtcttgctatgcttggcataacggcaatgaaaatcatctgccacaagctcaatcgaaatcacatcaatatcttcaggagactgggtatccaaggcaaaacggagtttctcctcatccatctgataaggcaggtcaaaatgaatcacctgtcccagggcatgaaccccactatctgtcctaccagcaccgtgaacagtaatggcttgccctttatttaatctggtcaaggttttttcaatttcttcctgaacgctacgcgcatgaggctggcgctgaaagccagcaaaggcataaccatcataggaaatagttgctttatatctcgtcatagcctctattttatcaagaaattagtctgtaaacaaggacctaaaacaaatattgtatgggtataaaaatctcatactcttcgaaaatctcttcaaaccacgtcagtttccatctgcaacctcaacacactattttgagcaacctgcggctagctttctatagtagattgaaataagatatgaacaactctattaggaaagtcaaattaatttctagaaatattttagcagctacagcgtactattccaaactcaatcaactatagtttgctctttgattttcattgagtatcaaaagaaaaacttaggaatcaatcctaagctctcttctgaagtaggtacatgacaaagatagagattacaatcaaccaacctcctaagatactaaagaccaacatcccattgtgagttagtaagccaattgcacctagaacgaatggggtcgtaaaggctccgaaactacagcctaatacagcaaatgaagttgcttgattgaggagtttagctggaattcgttcagagacaagttgaaagaccgtcgtcaagactacactataggcaaatccagccagaacacttcctgctactaccacccacaaggatgaagacaaggcaatcacgatttgccccaagccaaaggtaataccagaccagaggagcagtttctctttaaagatagaaatcaagaaagaaaaactcaccccagccacaatcccgatcaactgcatgatactaagaacaaaactagataactgggcatcccccaatcctctttccaccatcaaacttggaatacggatggtaatagctgtattggtacaaactacaactgccgcttcgatagctaaggtaaaaatcaagcctttcatttctcgagttaaacgacttgcttccttcgctcttttcttgacttctttctttgattttccataagggacaaagagcagataaaggggcagcaccaaaaatccagcactataggctagaaagatagctgtccaaccaaaggccaacaactgaccgacggccaaggtaatgagagaagctccaacgacctctgcagaagcgcgtagccctaacatctgaattcgcctttttccttggtagcgttcactgataatagaaatggccttggcattgatcatcccaagacccaaaccaaagagaagccgtgttccaaagacaaagggataggcttggtaccagaagggagctgtaccgctcaatgataaaatcagcaagcccaaactaatctgtaagcgctcaggaaatattttttctaagaaaccatttagcagtaacatcatcatgattccaaaggaaggcaagctcaccaagagctcaatttgttccttagaataaccctgataatagtcaaacatggctggtagggcactcgaaatggaaaaggaggtaatcaaaacgagggagagagccaaaatgctggcccgttctaaaaattgtttcatgaaatctctttctatatttctcttaatcttctacttttttgatagttatcaaataagcaagaaaagaagaagcctcattggtttgtagactccttcttaaattcgaaaatgaatcccttgtatcttatactcaatgaaaatcaaagagcaaactaggaagctagccgcaggttgttcaaaacagtgttttgaggttgcagatggaaactgacgtggtttgaagagattttcgaagagtattaggatgactttctcttgatttgcttgataaagtagaaaataaatcctgctaccatataggcaacaaagataatcagacaccacttaaacacaacattccaacccttgttcacattcaaaaagaagtaagggaaaggattatccttggcatttggaatattgagttttagaaccaagccattaaaaagagcaaacatcatatacagaaagggtaaaatggtccacactgctggatcccaaatcttgtattgaccctgtttgtcaaaaaagagggtatccgctaaaaaccagatgggaacgatatagtggcaaaggaaattttctagggtatagaaattagtcgcaatgggcgccaagaggaaatggtaaatcacacaggtaatcatgatactcatggtgaccccaccttttaagcgcaagagacttggcctttgccaattttcacctacacggctcataacctttagaagataaagggtaaaaatagttaccaagaggttggacagaaccgtgtaatagagaagcatcccaaaaccaccatgcttagtaatttcaagataaactcccgtaaaagccgctagaaacaagaagatacggctataaaatacaagtttatagtgttttgacatgcttaaatcttcctcacaaactctgatttaagtttcatggcaccaaaaccatcaatcttacagtcgatattgtggtcgccttctacgatgcggatatttttcacgcgcgtcccttgtttcaaatcttttggcgcaccttttactttcaagtccttgatgagagttactgtatcaccatcagccaatttatttccgttggcatcgatagcgacaagaccttcttctacttctgcaacttcagcaggattccactcatgagcacactctgggcaaaccagtagggcaccgtcttcgtagacatactctgagttacattttggacaatttggtaaattgttcatggtttctccttatcatcattcactattctttgaaaatcaaaatttctcgaacagcaactattataccctaaaatcagcattttgacaaatttagaaaaaaaccgatatcaatctatcggcttttctacatttacattcttttttcagcttctgctttgattttttcaactacttcttgaatgttcaaaccagttgtatcaaggtagacagcatcctctgcttgtttgagaggagaagtctcacgatgactatccttgtagtcacgcgcagcaatttccttttttagggtttcaaggtctgtttcaattcccttggcaatattttccttgtaacgacgctctgctctctcatcaacagaagctactaggaaaattttcaattctgcttgtggcaatacaacagttccaatatcgcgaccatccatgacaatcccgccttgctgggcaatttcttgttggagagaaaccagtttctcacgcacttgaggaattgctgcaatagcagaaacatgattggtcacttcattttcacggataggatgggtaatatccacatctcctacaaaaacaagctggtctccagtttctgaacgtccaaagctgattggatgctggtccaacaaggctagaagggcttcgacttcttcaactcctaattggttcttaagagccatataggtcgctgcacgatacatagctcctgtatcaaggtaggtgaatccaaaatccttagcaataatctttgcgaccgtactcttaccgctggaagcaggaccatcaatagcaatttgaattgttttcatatcggctcctattttatttttataacatcacctggattagcaaaccaagatcctgtagccatgtgcccaggattcaaggcctctaactgagcaatggagattcctgcacgagcggcaatagctgcttccccttctcctgcgagaactttaatcgttccttcaggattagcagcttcttctgaactactagaagtagattctggctctgaactctgctcaggctgagaactacttgaagatgagatttgtactacactggcatcagaatcatgaaagccttttaaggctgctgtgcgattactcccccccgatgatagatagatgagaacgatgaccatcaccaccacaattacaaagaaaatactagctaggatcgtcaaaatacgattagccatcctatcagcccctccgtggtttcgatgccgacgctctgctcttgattcttcttgatcatagatatcttcttgccacggttcttttgccataccttactccttgtttttttttacttttcttattacaatataaatatgaacatgaaaatcacacttatacctgaacgatgtatcgcctgtgggctttgccaaacttattctgatttatttgattaccacgataatggaatcgtgcgtttttacgatgaccctgaccaactggaaaaagaaatttctcctagtcaggatatcttagaggctgttaaaaattgcccaactcgcgccctgattggaaaccaggaagcctaaatcaatggcgataatccactccctctagtttagcacatttccatgtaaaattatagtcttttcactttatttttttctgtaaaatcaggaaggtcacttttttctttgataagataaagtggtctttttttagtctctaaataaatcttactgatatacttgccgagaatcccaatggtcaagagttgaatgcctccaagaaagagaataacagccatcagagaggtccaaccagatgtcggattgcccaaaatgagggtccgaaccacaacaaaaaaggtcatcagcagagaaagaaaacaagataggagaccagctacaaaggctataatcaagggaaaatctgaaaaattaataatcccttcaatggagtagaaaaagagttgcctaaaactccaacttgtcttgccagcctgcctttcgacatttggatagtccaaatagtaggttttgaaacccacccaggcgaagagcccctttgaaaaacgattggactcggtcaagcttaaaatggcatcgactacagaccttctcatcatacgaaaatcacggacacccgacggcagagctactgggctgattttttgcatgaggcgataaaagagaacagcacagaaactgcgaaagaagggttctccctcccgactagttctccgtgtcccaacgcagtccaagtctacatttttgtctaatacatttttcatctcaaacaacatactaggaggatcttggaggtctgcatccatcaccaccaccaaatctcctgtcgcatattgcaagcctgcataaagggctgcttctttgccaaaatttcgagagaaagaaatataatggactgccggattttgctcccgataggcctttaagagttccaaggtcccatcacttgatccatcatcgacaaagacatactcgatttctgtttccaaatctggaagtaaagcttccagagcctgataaaaaagaggaagtacttcctcttcgtttaaacaagggacgatgattgaaatcatcatcttagtcttcaaatccatttggatgcttgctttgccaacgccatgcgtcttcacacatttgggtgatgtcgagttctgcttcccaaccgagttctgctttagcttttgccgggtctgagtagcaggcagcgatatcacctgggcgacgttctacgatgcggtaaggaataggacggcccaccgctttttccatgttttggataatttcaagaactgagtaacctttaccagttccaaggttataaacgtttagtcctgaacctttttggatttttttcaaagctgcaacgtgacccttagccaaatcgacaacgtggatatagtcacgaacacctgttccatcttccgtatcgtaatcgtctccaaacacttgcacttgctctaattttccaacggctacttgagtcacatatggcaagagattgtttggaataccgtttggattttctcccaaatcaccactctcatgggctccgattgggttaaagtaacgaagcaagacaacattccattctgagtctgctttgtaaatatcagtcaaaatttcctctagcatgagcttagtacgaccgtatgggttggtcactgaaagtgggaaatcttccaagatgggcactgtgtgcggatccccgtaaactgtcgcagaagaactgaagatgatgtttttacagttgttttcttccatggctttcaaaaggctgacagttccagcgatattgttgtcatagtaggcaagagggatacgtgttgattcgccaacagccttcaaaccagcaaagtgaatgacaccagtcggttcttcctgcttgaaaatatctctgagggtatctgtgtcacgaatatctgcctcatagaaaggaatctcaactcctgtgattccttcaacaacttctaaactcttacgattgctattgacaagattatccaccacaacaacttgatgacctgcttggatcaattcaataacagtgtgggttccaataaaaccggcaccaccagttaccaaaatcttttcttgcatcttttttcctcgattctcagattattttttcttattttaccatttttgacagggaatgtcatttgccatcctaaactacctgataaaatttcagtaaaatgcttatactcttcgaaaatccaattcaaactacgtcaacgtcgccttgccatgggtatggttactgacttcgtcagttctatccacaacctcaaaacagtgttttgagctgacttcgtcagttctatccacaacctcaaagcagtgctttgagtaacccgcggctagtttcctagtttgttctttgatttttattgagtattattcgctttttactcgtttgacatagttttcaattgggtaatttagagggtccaaggtcaactccttgtcttggatcagttgggctagatggtaaccaatgataggaccagttgtgaggcctgatgaacctagtccactggctgcatagacaccagttaagtcaggcacctgcccaaagaaaggagagaaatcactggtgtaggcacggattccaacacgctcagattttgaagtagcttcagccaaaatcagatagtgagtcaaggtggcctcctccatttgttggagcaaggtttcatctaccgtcaaatcaaatcccatgtcattttcgtgggtagcgcctaaggataatttcccacctgcaaagggaatcaaatcccactccccttctggcatgacaacagggtaatcttccatgtcttgggcaagctgataatctcgtagttgtcctttttgaggacggacatccacttcataacctaaaggctctaacatgtcccccaaccaagctcccgtcgccaaaataacctgctcaaactcctcttcaccaatctggtagcctgatgctaacggtgtcagagtcactttttctttgaccagcttgacatgactgacttccagcaaacgagtcactaaaagttggccatctactctcgctccaccagaagcatagagcaggcggtcaaatccctgcaaaccagggaataattcattagctgaggcttggttcagaatggctaattgccctatcaagggagattcttctctgcgctggagggccagttgataaagttcttccaaattggattcatcctttttcaagagaaagactcccgaacgctggtaaaagtcgatttcttgtcctgatttctctaaatcagctaataaatccacataaaaatcagcccccaagcgcgccatcttgtaccaggctttattacggcgtttggaaaaccaaggactgataattcctgctgcggccttggtggcttgaccttgctcatggtcaaaaacggtcacctctaggtcactttctctcgagaggtagtaggcagctgttgctcccacaattcctgctccaataatggcaacttttttcattgtcttcactttctaactagatatgatggaaaggattggttgatgcctgactaggcaagatatcaatagaccaccccttatcttccttccattgactaagaagtgctgcgattttttctacaaaaatcacttcgatatagtgacctgggtccaatgcaagcaacccatcagatagcatatcctgagcagtatggtagtagatatcaccagtgatatagacatctgccccctttgccaaagcatccttatagaaagactgcccgcttccaccacaaattgctactcttgaaataggcttctgcaaatcatcctcttgataatgcaccattcgaaggctatctaggtcaaagacttgcttgacctgttgggccaattcccaaaatgtctgaggctgaatattcccaatacgtccaattccacgttctggacctgtttcctgcagataagtcgtctcctcgattcctagcatctgacaaaaccagtcattgagcccattttcaacgatatcaatattggtatggctgacataaactgcgatatcatgcttaatcaggtcgatgtaaatctgattttgcggacggctggcaagcaagtccttgataggacgaaagataggcgcgtgcttgacgataatcaagtccacacccttttcaatggcctctgccactgtctcttcacgaatatcgagggcaaccatgaccctttggatacccttgtctaaagtgccaatttgcagaccacggctgtctccctccatagaaaattcctgagggcaaaaggcttcataagcttggatcacttcacttgctaacatggagcacctccttgatagcttgaatcttatctactagaacttgacgttcttccagatttttttctgggatttgtccgagggcgaactctagcttctcagcttctttttgccatttttggacaaatactggactgacttctttggacaagaagggaccaaagcgaacatcactggctgatagcttcatttgtcctgcttccaccaccaaaatctcataaaactttccagcttcttctaagatgctttctgctacaatctggaatccatgatcctgtagccagatacgcaagtcgtcttcacgattattgggctggaggatcaaacgctctacattagctaacttccccaaaccttcttctaaaatcctagcaatcaaacgaccacccatgccagcaatggtaatgacagacacttggtcagtctcttcaaaagctgccaagccattggctaaacggacttggattttctcctttaggccgtgagcctcaacatttttaaccgcagactgatagggaccttccaccacctcacctgcaatagcgcttttgatttggcctctctcaaccaactcgataggcagataagcatggtcacttcccacatctagtaaaatagccccctgtgacacaaaggaagctaccaattctaatctctttgaaatcatcttctctcactttccaaaactctattacctcttattataccacatttcaatcttcaacttcccagtaatataagcacctctggcgaaagaagtttcaatgtcctaaagtaataagtgaatccaattgaaagattttaaacaatttgcaaaaatgtcaaaaaataaaaaataaacagtttattcagaaaattcttgacatataaaaacacatggtagaatataattagaaagttagaaaaaataaaagtttgactaaaatttgtatttgaaggtggtgttcagataagaaatttagtcagacgaaccacgaatttgctctatgctttctggaatttatcataacaggaggatacagtcatggaacaaacattgtttgaattagaactacttccagaggaagatatcattgtcacaggtctccctaagtattgttcttttacttgtttaattacaggtcgctagttatattttatataaaataagtagctttacttacggaataggctagtgctgtgtctctagcctattttaataattaggagtttgttatggatttattagagaaagaatgtttaaaatgtgataaaaatttccaacagggtgatatttggaattactattatttatcagataagatgcctgcacaagggtggaaaatacacataagctcccaaataaaagacgctgtaaatatttttaagattgtgtataaactatcccaactaaataattgtagctttaaagttgttaaaaatttagaggaattaaaaaaaattaattcccctagggaaatgagccctactgctaacaaatttataactctatatcctaagtcagaatctgaagctaagagtatgatttgtaatcttacgaatagactgtcagaatttaaggctccaaaaatactatctgactatcaatgtggaatgcattctccagttcattatagatatggggcttttttaaaaaaacaagcttatgatgaaaaaaataaaaaagtcatctatttattgctagatgaaaaaaggaagaactatgtagaagataagagacaaaatttccctagtcttcctagctggaaaatggatttattttcagaagaag

SEQ ID NO: 34 - DNA, 13104 bp; double-stranded, linear
ccggatccagcgaaaaatatgctctttgatgctgtaagtggtcaaaaagatgctaaaacagctgctaacgatgctgtaacattgatcaaagaaacaatcaaacaaaaatttggtgaataaaaaatttgttcaaggggggtggaaatcaaatccccctttgaatttatcaatagagacacaaataatttagctttcttataaaaaagtagtatcctatgaaaggagttaatatggaaaagcaacaacctagtaaagcagccctgctgtctatcattcctgggttaggacagatttacaataaacaaaaagccaaaggttttatcttccttggtgtaaccatcgtatttgtcctttacttcctagcacttgcaacccctgaattgagcaacctcatcactcttggtgacaaaccaggtcgtgataattccctctttatgctgattcgtggtgccttccatctaatctttgtaatcgtttatgtactcttttatttctcaaatatcaaagatgcacatacgattgcaaaacgcattaacaatggaattccagttccacgcacactcaaagacatgatcaaagggatttatgaaaatggcttcccttacctcttgatcattccatcttatgttgccatgaccttcgcgattatcttcccagttatcgtaaccttgatgatcgcctttaccaactacgacttccaacacttgccaccaaacaagttgttggactgggttggtttgaccaactttacaaacatttggagcttgagtaccttccgttctgcctttggttctgttctttcttggactatcatttgggctttggcagcttctactttacaaatcgtaattggtatcttcacagctatcattgccaaccaaccatttatcaaaggaaaacgtatctttggtgttattttccttcttccttgggctgtcccagccttcatcactatcttgacattctcaaacatgtttaacgatagtgtcggtgctatcaacactcaagtattgccaatcttggctaaattccttcctttccttgatggagctcttattccttggaaaacagacccaacttggactaagattgccttgattatgatgcaaggttggctcggattcccatacatctacgttctgaccttgggtatcttgcaatctattcctaacgacctttacgaagcagcttatattgacggtgccaacgcttggcaaaaattccgcaacatcactttcccaatgattttggctgttgcggcacctactttgattagccaatacaccttcaactttaacaacttctctatcatgtacctcttcaatggtggaggacctggtagtgtcggaggtggagctggttcaaccgatatcttgatctcatggatctaccgtttgacaacaggtacatctcctcaatactcaatggcggcagctgttaccttgattatctctatcattgtcatctcaatctctatgatcgcattcaagaaactacacgcatttgatatggaggacgtctaagatgaataactcaattaaactcaaacgtagactgactcaaagccttacttacctttacctgattggtctatcaattgtaattatctatccactgttgattaccattatgtcagcctttaaagcaggtaacgtctcagcctttaaactagatactaatatcgacctcaattttgataactttaaaggcctcttcactgaaaccttgtacggtacttggtacctcaacactttgattatcgccttaattaccatggctgttcaaacaagtatcatcgtacttgctggttatgcttacagccgttacaacttcttggctcgtaaacaaagtttggtcttcttcttgatcatccaaatggtgccaactatggccgctttgacagccttcttcgttatggcgcttatgttgaacgcccttaaccacaactggttcctcatcttcctctacgttggtggtggtatcccgatgaatgcttggctcatgaaaggctacttcgatacagtgccaatgtctttagacgaatctgcaaaactagacggtgcaggacacttccgccgcttctggcaaattgttctaccacttgttcgcccaatggttgccgtacaagctctctgggccttcatgggacctttcggggactacatcctctctagtttcttgcttcgtgagaaagaatactttactgttgccgtaggtctccaaaccttcgttaacaatgcgaaaaacttgaagattgcctacttctcagcaggtgctatcctcatcgcccttccaatctgtattctcttcttcttcctacaaaagaactttgtttcaggacttacaagtggtggcgacaagggataatttatccccgccaccctttttcattttatactcttcgaaaatctcttcaaaccacgtcagctttatctccaacctcaaagttgtgctttgagcaacctgtggctagtttgcactttgattttcattgattattagcaattgtcactgtaaataatatccttgtagcaagcaatttttctcctagacttgaaataaagcgcatttctctatataataatactcatatagaaaacaccttttagaaagatacctatgcttccatatccattttcctatttttcaagtatttggggggttcgtaagcccctgtccaaacgtttcgagctcaactggtttcaacttctctttaccagtatcttccttatcagcttgtctatggtacccattgctatccaaaacagctcccaggagacctatccgctagaaacttttatcgataatgtctatgaacctctgacagataaggttgtccaggatctctctgaacatgctacaattgtcgatggcacattaacttatactggaacagctagtcaagccccttctgttgtgattggtccaagtcaaatcaaggaattacctaaggacttgcaactgcatttcgatacaaatgagctagtcatcagcaaggaaagcaaggaactgacccgcatctcttaccgagccattcagactgagagtttcaaaagcaaagacagcttgacccaagcaatttctaaagactggtaccaacaaaatcgtgtctatatcagcctcttcctagttctcggtgcgagcttcctctttggtttgaatttctttatcgtctctcttggagctagctttctcctttatatcaccaaaagatcacgcctcttttcatttaatacctttaaagagtgctaccattttatcttgaactgtttaggattgccgactctgattacacttattttgggattatttggccaaaatatgacaaccctgattactgtacaaaatattctttttgttctgtatctggtcactatcttttataaaacacatttccgtgatccaaattaccataaataggagatttttatgcccgttacgattaaagacgtggccaaggctgctggtgtttcgccttcaaccgtaacccgtgttattcaaaataaatcaaccattagcgacgaaacaaaaaaacgtgttcgcaaagctatgaaggaactcaactaccacccaaacctcaacgctcgtagcttggtaagcagctatactcaggttatcggattagttcttcctgatgactcagacgccttctaccagaatcctttctttccatcggttctacgtggcatctctcaagtcgcatctgaaaaccactatgccattcagatagcaacagggaaagatgagaaggagcgtctcaacgctatttcacaaatggtctacggcaagcgtgtagatgggctaatttttctctatgcccaagaagaagaccctctcgtaaaactcgtcgcagaagaacagttccccttccttatcttaggtaaatctctatctcctttcatcccacttgtcgacaacgacaatgttcaagctggttttgatgcgactgaatatttcatcaaaaaaggctgcaaacgcattgcctttatcggaggaagtaaaaagctcttcgtgaccaaagaccgtttaacaggctatgaacaggcgcttaaacattacaaacttaccactgacaacaatcgcatctactttgccgacgagtttctggaagaaaagggctataaatttagcaagcgattattcaagcacgatccacaaattgatgctatcatcacaaccgatagcctcctagctgaaggtgtttgtaactatattgccaaacaccagctggatgtccctgttctcagctttgactcggttaatcccaagctcaacttggcagcctatgtcgatatcaatagtttagagcttggtcgtgtttcccttgaaactattctccagattattaatgataataaaaacaataaacaaatttgttaccgtcaattgatcgcccacaaaattatcgaaaaataagagactgggcaaaaagtcgttaaaagcaaaaacgcatactatcaggtattgaaaaaacttgatactatgcgttttattgtgggaagatttacttccttttctactgaaattgagtcttttcccaagatctttttatactcaatgaaaatcaaagtgcaaactaggaagctagccgcaggttgctcaaaacactgttttgaggttgtagatgaaactgacgaagtcagtaaccatacctacggcaaggtgaagctgacgtggtttgaagagattttcgaagagtattaatcactaattatctatctcaacaaatcttcctagaatatgaacattttccgagacagagacaaaggagcttggatccacttgtgtcataatctgtttaaattcattaaactctgcacgtgtaatgacagtgattaaaactgcctttctctcgtgattataggttccttctgcatcgtggatcatggttgctccgcggtgcaattttttatggattttttcaattaccttctctggatgatttgtcacaatcatggcctgcatacgcttttgcttagtaaagactgcgtctgtcacacggctagagacaaagatggtaatcatagaataaagagcgtatttccaaccaaaggtcaaacctgctatcagcatgatagttccatttaccaagaaagaaatactaccgacattcttacccgttttcttacgaatagtcaggctgacgatatccgtcccaccactggagatattgtttcgaagagcaaaaccaatccccaaacccataacaacacccccaaaaagggaattgataatgggatcctctgtcaaggttgccacagggacaaactggataaagaaggaactcatagataccgtgataaaggtaaagacggtgaacttatggccaatctgataccaagctaagaccatcaaagggaagttaatggcgtagaagcttagcgaaatcggaatatgaaaaccaaaccagtgattactcaaggcagagataatctgtgccagacctgttgcaccactcgaatacacatgccctggttggaaaaagaaattaactgctactgctgataaaaaaccatagaccagagaggccgaaatcttctcatcatacttttctcgagagatactttgtaagacacgtaaaatttttatctgataagcaaagcggcgcagataatagcgccaccgcttaattcgttttgtttgtttcatcttcttctacttgtaagctgagttcctctagttgtttgagagcgactgttgatggagcttgtgtcattgggtcagttgccttgttgttcttaggaaaggcaatgacttcacggatattttcttctccagcaagcaacatgacaaaacggtcaagcccgatagccaaaccaccgtgtggtgggaaaccatagtccatggcttcaagaaggaaaccaaactggtcattggcttcttcagttgagaaaccaagagccttgaacatgcgttcttgaaggtctttttggttgatacgaaggctaccaccaccaagctcataaccgttcaagacgatatcgtaagcaatggcacgaaccttagccaaatcaccttctaattcatgagcagtctcttcctgtggaagtgtgaaaggatggtgggcgctcatgtagcggccttcttcttcagaccattcaaacatcggccagtcaaccacccaaaggaagttgaacttatcattatcaatcaagccaagctctttagcaatacgtccacgaagggcacccagtgttgcattagccacttcaagcgtatccgccacaaagagaaccaagtccttatcttcaagaacaagcgctgttgtcaattcttcttggataccagtcaagaacttggcaactggtccgtttaattctccatcaaccaccttgacccaagcaagacctttggcaccatactgtttggctacttccgtcatcttgtcgatgtctttacgtgaatagttgtccgcagctcctgtgaccacaatcgcttttacagcaggtgcttctgaaaagactttaaagtctacacctcggaccacttctgtcaagtcctgaagcaacatgtcaaaacgagtatctggcttgtcagaaccgtaaagagccatagcatcatcgtatttcatacgagggaatggtagcgttacttcgatgccttttgtttccttcatcacgcgcgcgatcaagctttctgtaatatcttggatttcttgctcagtaaggaaggacgtttccaagtcgacctgagtaaattcaggctggcggtctccacgcaagtcctcgtcacggaaacatttaacgatttggtagtaacggtcaaaaccagcattcatcaagagctgtttcgtgatttgtggactttgaggaagagcgtaaaaatgccccttattaacacgagacggcactaaataatcacgcgccccttcaggcgttgacttagaaaggaatggtgtctccacgtcgataaactccaactcatccaagtagttgcggatagagtgggtcaccttggcacgaagtttaagattttccaacatttctggacgacgaaggtcaaggtaacggtaacgcaaacgtgtatcgtcatttgcctcaatgccatccttaatctcaaatggtgttgtcttagctgtgttaagcacaataagagctgtcacgtttaactcaaccgcaccagttggcaacttatcattggcttgtcacgcgcagcgacctgaccagtcacctcaataacaaattcgctacgaaggctttcagctgttgccataacctctgcagatactttttcagggttgataaccaactgcatgattccttcacggtcacgaagatcgataaagatcaaaccaccaaggtcacgacgacggccaacccatcctttcaaggttatttcttgtccgatgtgttcctcacgaacacgaccagcatacatactacgtttcattatttctctcctcttttattctgttactattttaccataaaagcgcagctcttcatgaaaatcatcagaaaagtttgccagtctttaaaagtcaggtgaaagccctaaaaattagcgctaatactcttcgaaaatctcttcaaaccacgtcagcgtcgccttaccgtatgtatggttactgacttcgtcagtttcatctacaacctcaaaaccatgttttgagctgacttcgtcagttctatccacaacctcaaaacagtgttttgagcaacctgcggctagcttcctagtttgctctttgattttcattgagtataatacaaaaatccgatgaacttcaccggactcttttattttgaatttttgcctgctttacgcttttcagcgatttcggctgcctttcgaggcaagacaatttccgttatgtaagccgtcccaaaacgcagtacacctgcaataggagcaaagacaactgctagatagttatagaagaaatcgcctttgaaggcataagctagcgctccaatgatgaaaaatagaacgactgcctgaatcactgctaataaaattactcgtttcatgtgacctcctgactctattatagcatgagaatcatcaaaaagccgactaaattattcaaagcgtgaagagaaatactgtagaccagaccttttctgctaatgtaagccaaacccaaactaaaaccaaggctaaaatagacaaaaaattgttgcacatcacctggaaaatgaatcaaggcaaatagaagactagataccagaagaaaaatcagggttcgtttactattgtcctgcttaggaaagagatagcgtgctaacatccctctaaaaacaatctcttccgtcaaaggagcaaaaataaccacagcaaagaatgagaaaagtggttgagacaaggtcaagtctgtcgctatttgctgatttactgaaggatcatctggcaagaagaattgaacgaccagagataagaaccaaaccaagacaggaagccaaataaatcgattaaagccgctcttctcaatatgaacaggagccttctgataccatttgtaaatgccgtacacatatactccagccaaggccacatagagtagagtaacagcatagggtgaagcgcctaaagcaagcgacgcagtcgcgagcccctgaataaagccatagataaataaaaaggatagaagggctagaagaatccagccaaggtttttaagtaatttcatagataactcctttatttgaaataacgttttaccataggtaactgcatcacattgatataaacatggatggctcctacaagcaagaaagctagtaactgaatctctcctgtcaagaaagaaatgataataagaaaaatatataaggctggtaagacatattggtgtaattggaataaaattcgaaaactctgttccaaattagcctgacgctccccttcatcataagaatttatatagttcaagacatcctttggtgtagcgaaaaattccaaatcaaactgacgaacaatcgcaatggttttaaaaagagatttttgagcgactaagaataccacaaagagtaagaaagaaaggaaaaatgtttgagggtttgtatgcaatataatcacctcacttaatgaaataaaaatagccaatggaatcgctacacctgtaatattaaaagcaatggttccaaactcaagattccgatacatttgcacataataggtttcattcagatcgtcatccatttcctcttgatacaaagaatgaaattttctgcttttctttaagaaattgaaagtcaaaaacatactaatgaaacctatcagtaaacaaatagctgatatccatggcatcaaggcttttacatctaaaataatttcgtgggattcgacacgtgccttaaacatccctacaaacatgcccaagaaccccccaagacaatagacatcaaaaataacaatctacgtttctttttcatattcattctcctttttcacttgctagatttttggatttcttttcaatccattcaattactgggatgagagcaaagtagacccaaacaaattggtcgctttgatagggattaaaccagcttaggtccatcccaatcagtagaaatacgctgactaataaagctatgaccactacataataaatcactttatacttgttcatcactcgtcctcctccaaacgaaataccgattcgactgtttcgttgaaaatttgagatattttcagggcaatgataatggatggggtgtactcatcccgttctagtaggctaatggtctgtctggaaacccctgccagtttggctaggtcggtttgattgagaccatcgcgagctcgaagctcttttagacgattttttagttgcatgttacacacctactctccgtcaaattcaacggtttggatatcctcaatacgttgcaacttgaatttttcttttcccgtattatctacacgtcgtagctttacccattcctcatcaacatccacaacttcccagttatctggcccaatatacactcccgttataattggttcctttccaatcatttcttgtaataatctcgacatttctgcgtttcctttctcttttcgctcaagtcttttgattttattctctagtttcttgatttttttagaattattagaataaaagaaaatcataaatagtataaatcctagtacccacattataactcctttctgcttcctatttcttaacttgaattcattgtaacatatctttttctttttgacaagtatagttgtcaaaaaaattatgatttttgtcattttgcaaaagaaaaaggtcaggagtaggttcctgaccactttatctatcattaatactcttctaaaatctcttcaaaccacgtcagcttcaccttgccgtaggtatggttactgacttcgtcagtttcatctacaacctcaaaaccatgttttgagctgacttcgtcagttctatccacaacctcaaaaccatgttttgagctgacttcgtcagttctatccacaacctcaaaaccatgttttgagctgacttcgtcagttctatccacaacctcaaaacagtgttttgagcaacctgcggctagcttcctagtttgctctttgatttttattgagtataaaatcctagtttttcaaagatttctgagaagttttggctgattgtctcaagtgacacttgcacttcttctcgggtttggttgttcttgaccgtcacttgtccgctttcgacttcgctctctcctagggtgatgagggtcttagccgcaaagacatcggctgacttgaactgagcttttagtttacggttgaggtaatcacgctctgctttgaaaccttgttggcgaagagcctgtaccaattccaaggccttgatatttgccccttcgcccaagactgcgatatagacatctagggcgttttcgatagggagggtcacaccttgcttttcaaggatgagaagcaggcgctctacaccaagtccaaaaccaaatccagcagtttcagggcctccaaagtaagcaaccaaaccatcgtagcgaccacccgcacagacggtcaggtcattgccctcaatctctgtgataaactcgaaaatggtgtggttgtagtagtccagaccacgcaccatattggtatcgatgatgtaatctactccaagattttccaacatctgacgcacagcatcaaaatgagcttggctttcttcatcaagaaagtccaagatagacggcgcattctctactgccaccttgtcttctttttccttagagtccaagacacgaagaggattttcctccaagcgacgttggctatccttagacaaggtctccttgagcggtgtcaaatagtcaatcaaggcttggcggtaggctgcacggctctcaggatttccaagagtgttgaggtgcaatttgacaccttgaataccgatttccttcaaaaaatgggctgccatagcgattgtttccacatcggtagctggattgctagagccaaaacactcaacaccaatctggtggaattggcgcaagcgccctgcctgtggacgctcataacggaacataggtcccatgtagtagaacttgcttggcttttgcacttctggggcgaaaagtttattttccacataggaacggacaacgggtgcagttccttctggacggagggtaatatgacggtcacccttgtcataaaaatcgtacatttccttggttacgatatccgttgtatctccgacagagcgactgataacctcgtaatgctcaaaaataggcgtgcgcacttctgcatagttgtagcgtttgaaaatctcacgggcaaagccctcaacgtactgccacttagcagactcagcaggtaaaatatcctgcgttccttttggtttttgtaatttcatagggaatcctctttaaacttaatagtcttattttaccataaatagagggattaaaacagtaagaaaaaaattaggatttagatatcatttttgagattaagaattgtcaaaaaaatagctagcaaggaaagaccaacaaatagcatccaagtcaactgtatattccatacggctactagtgaaaaacaagctgttcccacaggtatggataaggtaaacaatagacctaaaaaattactagtacgagctagaacctctggagctagatttttcatgagcatggcactaatctttggttgaactttaccagacacatacagagtaaagaagagaaatagcaaaccaagcacgacttgattgaataaattagccaaaccaactagactaagtcctacggtctcccacatcatcaatctaggcaaggactgcttcccaaaataatcattgcccgtaaggctactgatgatgactgatactaaaacacagaattgattgataaatagtgcctctgtataagaaaaattcaagagagaatggctcaaaaagaagatattataaattccacccaaagcgccacccaaggaattaataagcaagacagcaaagagcataaaaccaaagtttttctgtccacttttaagaaaaacgagacgtaaatttcggtaaattgttaggaactggtctttgatagaaagcttctcattttttaagttttcaccatcagcagatgacattgacaggctcaatttgctttttcctaaaaagaggatagtggctgatactaggaaaaagcaggcattgattcccgcaacgagagaaaaattgttgaccgatagagctaagagccagactccgaaagcttgaccaccaatagctgaaatataggtgatgaactgtgaaaaagaataagcctccatcagatcatcttcagctactttttccttaataagaggcatacgcaggccacctgcaaaatcactgatgatatcactaatgacattgatcaaacacaggctagaaaaggcaaagagactagcttgctgaacaactagggctgctagaaaaaatagaaccgcctgaaacaaaccgctatagaccatccatttgaccttgtccctcgtgtaatctgcccgaatccctgcaaaaactgtaaagagggtcggaagaatcatgacaatattcgccatagcaacagcaaaagatgcttgtgacaaggtcgatgcatagacgataaagaccaggttgaaaatcgaaacaccaaaagcattgaagaagcgtgg

SEQ ID NO: 35 - DNA, 19250 bp; double-stranded, linear
ccgggcaaatagttttgaacttttcatcattttctcctttaaaactttctctccattatagactcttttcagaaagttgtcaacagaattttcagaatttttgaaaattatttttcaaacaacatctttgcaaaaaatatgaatatcgtaagcgcgtcataacaaggtatctatcattcatggagctcctcctgtatactattagtaaagtaaatattggaggatattttaatgccacaacctattgttcctgtagagattccacaatctcgtcgttttgattctaaaaagagaaatgatattctrcttaaaattcgtattggcaagcttgaagtaagtttttttcaatctctcaatctcgaaatgatagaacagcttttggataaggtgttgctctatgacaattcatctatctagcctagggcaggtctatctcgtgtgtgggaaaactgatatgagacaaggaatcgattcactggcttatctcgttaaaacccactttgaattggatcctttctccggtcaaatctttctcttttgtggtggacgtaaagaccgctttaaagtcctttactgggatggtcaaggattttggctactatataaacgctttgagaacggcagactgacttggcccagtacagaaaaggatgtcaaagctctcgcacctgaacaagtagattggctgatgaaaggcttttctatcactccaaaaatatagtagattgaaactagaatagtacacctctgcttctaaaacattgttagaaatcgattttactgtcctgatcgatttgtcctgttattatttcattttactataaatccatcagaaagtcgtgatttctattgaaatgaggactttctttttatactcatctgctttcaaaaagcactctagtccatctccgattaacgatggactttatcacctccttctccagtccttgtataacatcttgaagttgattcatgacatcttccaaagttcgaaaggctttattcttaaatccacgtttacgaatctctttccacacttgttcaatggggttcatctctggtgtgtatggaggaataaatgcaaagccaatattagtcggaatctttaaggtacttgatttatgccatatagcattgtccataacgagtaaaagataatcatctggataagcttgtgaaagctcctattcctaaagcccctttataacctcttgcgagagagactattgactcagcccttacttcatgcggatgaaacctcctatcgggttctagagagtgatagccatctgacctactattggacttttttgtcaggtaaagcagagaaacaagggattacgctttaccaccatgatcagtgtcgaagtggttcagtagtacaagaattcctaggagattattctggctatgttcattgtgatatgttgcggcagtaacttaggactttagtcctctagttctgcctatgcgatagcagtccaaggtttaggagtaaggcgacgctaagcttggtaaactgcgaacagctagaagcttatcgtcaactggaagaagctgcacttgttggatgttgggcgcatgtgagaaggaagttttttgaagtgccccccaagcaagcagataaatcatccttaggagctaaaggtttagcctattgtgatcagttattttccttggaaagagactgggaggctttgccagctgatgaacggctacagaaacgtcaagaacatctccaacccctactggaagacttctttgcttggtgccgtcgtcagtcagttttatcgggttcaaaactaggaagggcaattgaatacagcctcaagtatgaagaaacctttaagaccattttaaaagacggacatctggtcctttccaataatctagctgaacgcgccattaaatcattggttatgggacggagtaaaagagtccagtggactcttttagcctaagctcagtttaaaaaaacgagggtggttatttttaaaaaagcgagggtggttattttctcaaagttttgaaggagctaaagcaagagctattattatgagtttgttggaaacagctaaacgtcatcaattatagtgcgttgaatctataacagtacgcatcgactgctaaaatatttctataaatcaattttcctttcctaatcgatttgttcatatcttattacaatccattataaatagcgagaaatatctatcctatcttctagaatgtcttccaaacgaggaaactctcgtaaacaaagaggttttagaggcctatttaccgtggactaaagttgtacaagaaaagtgcaaataagaaatctccagattaggaactatatatgagttctctagtctggagatttttcaatagacttcgttattgggcggttactttcgaaactttgaaaacttcaaaaaacggatttttatcgctctgaacatcaaaaaagaaaggacgaaatttgtcctttctcaagcttagcttttcttcaacccactacagttgacaaagagccctttattctatcaaacatgaagcgcaaaaacaagccaaaaatccgatagaatggctatccctcgactatcaagtaagacatttccatcaaatacgttcaattttactcttgttctactaagaattaatcatctcgttttgatttattaaaaatatacaattcagcttttcctccaaactattttatccactatccctgtatagctctgtattatcttaacaactttagtagagacattttcctcaacataatccggaaccggtaatccaaaatcctcatcttgtgccaagctaacagcagtttcaactgcttgaagaagagaattttcatcaatgcctgccaaaataaatcctgccttatctaaggactcaggacgttctgtacttgtacgaatacatacagcgggaaaaggataaccttgactagtaaagaaactactttcttccggtaaagttcccgaatcagatactacaacaaatgcattcatctgtaaacaattatagtcatggaatcctagtggctcatgctgaatcacacgtttatctagtttaaaaccgctctcttgtagccttttctttgatctaggatggcaagaatataagattggcatattatacttttcagctaattgattaattgctgtaaagagagaaataaaatttttatctgtatcaatattttcctcacggtgagctgaaagtaagatataacctccttttttcaatcccaaacgttcatggatatctgaagactcaatagcagataaatttttatgtaacacttctgccataggagaaccagttacatatgtgcgctctttaggtaaaccacactcatgtaaatacttacgtgcatgttcagagtatgctaagttaacatctgaaataacatcaacaatccgacgattagtctcttccggtaggcactcatctttacagcgattgccagcctccatatgaaaaattggaatatgtaaacgcttggcagcaatagctgataaacaagaatttgtatcccctaaaatcaataaagcatctggtttaatttgattcatcaatttgtatgaagtattaataatattccctacagtagcaccaagatcatctccaacagcatccatgtatacgtccggagtgtctaaccctaaattatcaaagaaaataccatttaaattgtaatcatagttttgtccagtatgtgccaaaataacatcaaaatactttcgacatttagtgataacactacttagacgtataatctctggacgtgttcccacaataatcaataacttaagtttgccattatctttaaagtgaatatcactataatctgtcttaattttcatttatttctccacttgttcaaaaaaagtatctggatgtctaggatcaaatgactcattagcccacatgacagtaattagattttctgtatcagaaagattaataatattatgtgcatagcccggtatcatatgtattgcttcaatcttatcgcccgacacttcaaagttcagaataggatactcttgaccgttttcatccagccctatcctacgctcttgtattaaagcacgaccagaaacaaccatgaaaaattcccacttagaatgatgccaatgttgccctttggtaatgccaggtttagaaatattaacagaaaattgacccgtattttctgtttttaataattccgtaaaactacctcgttcatctatattcatttttagaggaaacttaaacttatctactggtaaataagataggtaggtagaatacaatttctttttaaacgatccctgaggaatttcaggcataactaaactatcaggctgttttttaaatgtttctaatagagagacaatctctcctaaggttgcacgatgagtcgttggtacgtagcagtagtttcctgatgggctaggtaagatttgtaatccatctagattacaacgatgaggatttccttccaatgcagttagacactcttgtatcaaatcatcaatatacagcaactccaattctacacttggatcatttacttgaataggtaaatcgtgagctagattataacagaaagttgctacagcagaattgtagttaggacggcaccacttcccataaagattcgggaaacggtaaactaagacaggtgctcccgttttctttccatattcaaagaagagttcttcccctgctagcttagattgtccatatatagagtttgaaaatcggccttctaaactagcttgagtagaacttgagagtagaacaggacaagtgttttcatacttttctaaaatctccaataatctacttgaaaaaccgtaatttccctccatgaattcatcaggattctgtggacgattgacaccagctaaatggaatacgaaatcggccttcttacaatattcatctaataaaatcggatctgtatcacgatcatactgaaaaatctctccaatctctaaattaggacgagtcctatctcgtccatctttcaaagcttccagagtacagataagattttttcctacaaatcctttcgctcctgtgattaaaatatttttaatcatgccccctccttattttatatgctgttttaatagttaactctctcgacaatacatgatacattatatatccttgataattttaatgtatcttaaaagattttacatctcttcgtctgctaccatatcacgaattgctgtctgtatttcatctaattctagcaactttcttttaacttgctctacatccatcaaatcggtattattactattgaattctgtcaacaaatttctattcgtactaccatctttgaaatacttatcatagttaagattacgattatcactaggaactctataaaaatcacccaaatcaattgcatttgcgcactcttcgttagttaatagtgtttcataccttttttctccgtgtctaatacctataatcttaatatcttgttctgaggcaaaaatttctgatacagccttagccaacacttcaatcgtacatgctggtgctttctgaactagtatatctccagatttcccttcttcaaatgcaaataaaaccaagtctactgcttcttccaatgtcatcacaaaacgtgtcatgctaggttcagtaattgtaagagcatttccttgcttaatttgctcaatccaaagaggaacgacagatccacggctacacagaacattcccatagcgagtcacacatatctttgtatgctcaggatttaccgtcctggacttagcaacagcaatcttttccatcatagccttggatgttcccatagcattgacaggataagccgccttatctgtagaaagacagataacttgctttacaccagcttcgatagccgcagtgaggacattctccgttcccaaaatgttagtttttaccgcttctacagggaaaaattcacaagaaggtacttgtttaagagcagcagcgtgaaaaacataatccacaccatgcatagcattttttaccgaagctaagtcacgcacatctccaaggtaaaaacggattttcccagccacttctggtacttttacctgaaactcatgacgcatatcatcttgtttcttttcatctcgcgaaaatatacgaatctctgagacatctgtttctaaaaaacgcttgagaaccgcattcccaaatgaacctgtccctcctgtaattaggagagtttttcctgtaaattgtgacatatattacacttctccttctagtatgtctgcaattttcttacaagccgttccatctccatatggatttgaagcttgactcattgcttgataaactgaatcattttctaataattctttaaaatgcctataaatattattttcatcagcacctacaagtttcaaagtccctgcttcaattccctctggacgttcagttgtatctctcataaccaaaacaggttttcctaaacttggagcctcttcctgaataccaccactatctgttaaaattaaataacttcttgataaaaaattgtgaaaatctaatacttctaaaggttcgatcatcttgatacgttcacagccacttagttcttcctcagcaatttggcgaacacgaggattcatatggataggataaatagccttgacatctgaatattcttcaataatccttctaattgctctaaacatatgtctcatcggttcaccaagattttcacgacgatgagctgtaattagaataaacctgctttctcctatccattctaactcaggatgcgtatagtcctcttgaattgtagtttgtaaagcatcaatcgccgtattacctgtcacaaatatgctctctggagtttttccttctcttaaaagattatcttttgaaagttgtgttggtgtaaaatgatactgagccaaaaccccaactgcttgacgattaaactcttcaggatatggtgaatagatatcgtaagtgcgcaaaccagcttcaacatgaccaattggaatctgtaaataaaaggccgccagtgaactagcgaaggtcgtacttgtatccccatgaactaacaccaaatcaggtttttctgactctaaaatagccttcattccttccaaaatgccaatggtcacatcaaataaagtttgtttatctttcataatagacaaatcaaaatcgggaataatcccaaatgtgtccaagacctgatccaacatttgacggtgttggcccgtaacgcaaactaatgtttcaatattcttacgtgttcttaactctttgaccaaaggacacatcttgatggcttctggacgagttccaaatactacaactacttttttcatatatttacttactcctaacaaataatgaacggttcttaaaataaattagataacggctaatccataacaccacctcagacatacttgaacaaatagctaatgttactaaactaaaattatcagacaagataaatattcctaatcccaaagtttggacaatcgaagctaatatagttgtcattgtagtttctttcactttatcaatagctcctaagacaggccatccgtaaatcatagaataaaaactagcaacaaaagcgggtaataagtacttaagaaaatctgctgaaacggtatatttttcaccaccaattatagaaagaatttgatttgaaaagaataaaactatcaaaactccaaagataataggaataaacataatccgattaatactcttaaccgattgtatatctttagtacgtatcatatgcggatataaactattcgctataggattatacaatgattttgctgctgaaagcagttgcattgctatcccccaaaaggctatctcttgactttgtaaataaaaacccgaaatgactgtcgtaaagacgccaaaaatagtagttgcaaaattggataaaaaataaatagaggattcctttaaatctttaacccaaacagacagataagaaaatgataatttaattccataataatgaaggaatctataagaaactactgcagcaactaaattcccaattccttccaatataggaatccataaaatagaagaatcatcttttactacaataaatgtcaaaattgtaatgatagttttagaaataatataaggaattgcaactgcatgcatcttttcaattccacgaaataaaaagtcaaagataaaaatattggtcactgtagctaacaaataaaaaactgaaaaaagaatattctctctcattattgggatttgccacatcaatatggtgtaaattagaatcgaaatgatagataaaaatattttttcaactagagtatctccaactatccttccaatctttgagggagtagtacaagcatttacaatattttttgtagctgatatcatgaaaccaaaatcaatcaccagttgaacataagctattaacgctttaacataaataaccattccatacgcgtctagcgaaagcacccttgtcaaatacgggagtgttaataaaggaaatagtaatttaacaatattcagaatatagagagaacttgtattttttataaatgaaattctatcaactttcacgaactagtccttccaaaaaaagatctaaatagtccaaactacttctcgctttcaacaccaattctgaaggtattgttatcggttttagatgaaaagtttcaagtttctttacaatactattaacacttgaatcaaataaagattcacaacgttgtaactctccaattgctccataataacgtgctgttttttctggatggcatgcaatggcaatcacagatttattaaaacatgttgccactaccccaacatgtaatttacaagttaaaaccacatctaccattttcaacaatgatgtcatttctgcaggagaatgatacttgaattgaaaacaatcctcagttctaactaattttctaaattcctgataataagcatcttcataaggtagaatggaatccgaagttactacaacataatagttaggattgttttctagaaaaagactaattgattccgcaaatttttcaagagcttttttggaatgattatagtgaacaagaattatcttcttatctttagcttctcttttcaattgacacagctgctctgttttttcttctcttaatttacttgaaataattaaatcaaaggtttcatgcactggagccgaaggcgacaaatgcttcaaagaatcaaatgattctcgatcacgaactgtaataaattgagcatgattaataattctctttataccataattcatcaaagaatcgttattaggccctgcaccaatacctaatactcctataggctttttaaaatatgaagcccaaattcccaaaggtaaaaatcgtttaaattggattaaattatcacgaaaacgtgcattatgcccttccccaaaatatcctcccgggatatacaaaatagcatctgcttgttttttagtaaaactttgtttttggcgatattctttcaagtacatttgaaagaaatctgatggattataaaaagaaacttcatatcctttagattctaataaatcatagacaatctcaccgtaaagataatcaccgtaattacttgaaccataatccgttgcaccatgtaacataatttttttcaccactattttttcaacctcctaaaaataaatatcataatcaaactatacataataggacgataaacatctattgaactacttctcactaaaagcaatagttgagaaattaccgaaaaataaataacttttgagattttacttgtttgaaaagctctgaaatttaatcgccatccactaaatattcccaaaacaaaactccaaaaaacaccaccatagtaaccaaagttccaaaataattcttccacaaaagaagagcctacaggtaaccccaaaaatttattaataacaaccgtcgctgatgctttatcaaaaaaatcaccaactaaccatccaataggaaaaattgataggatagtgcgtagaaatgtcatcccatattcatatggaatgctactaggcacaacagttacagcagaagctactgttaggctggtcagtcccgactctgaaaatacttcccctagtatattctttacaaaatctaatgaagaaaaggaatcaaataagtatatacctatagtattcaagtcgaaacggtgccccctaataacaactaatacatttaatagaaatacagttactattaaaaatacaagtactcttttcttcgaaaaagtaatccctaaagattgtgtgtatactaaaaccaacgccaagattgaaaacacctggattttacgacttcctgttaggatcattatcaaaattaggtaaaacaacattacccaaaaaatagtacgctttataactcgggacagcttatctgaataaaacaaggagaacacaccaggaagcataagtactcctaaatcatctattattcctgaactagctgcctctgaatatgctgaatagctattcgccgctctaactgctagtactgttttagaatcagttattaccctagaaataaagcccactcctgttaaaatcctacccgcattgtacaaaattttctcttcattttcctgataattttgtacttctgaatgataatgtacctttccatcactataaaaaaataaatagcctacagaataacaaaacaaaatccaaattataaaaatatatgaatgaaataattcttcattattatagaagttactagggctccacagcagagttgtttgaaaccccatatactcattgaaaattaatccaaacataaaaaaataagataaaatcagataccatacagaaaaatcatatatactaactttttgtaaaataaaaccagtaatttgaaaaataattagaaagcaaacccatataaatatagacggaacataattagatataagaaaaccattattccaattatcgagagtccagaacaagtaacagaaagcaaatataaaacttaatgtcactagtgtcactctacaaatatactttgtctgcatctatatctcctttattacacacatttcttgataacgattcaataatttactagcttgataacaaatatcatagagtccatctgtcatactgttatttatttcaaaacgattgcattcctcagatgttaaagacagtactttatctttccatagcaacacagactcttcgttgataggtaagtaactaatgtttttggtcacatctacttcttgcgtcactgtatctgacgataaaatttgtaatcccgatgcctgagcctctactagagaaacaggcaacccctcatatttagacggaagcaaaaaaacatccatcgcagataataaatcagaaatatcagtccttctccctaaaaatagcacatatggggtcagatttagttctaaagctttctgttttaatttctgctcatcctcaccattaccaactaggagtaaaataacatttggtttgattaaaatgagttcttttaaaacgttaaataaataactttggtttttttgatctgataggcgagctatatttcctaatacgaacttatttgacacatctaattctctacgacatttttctctaacatctgacaaaaattgatactttttcaaatcaattgcattaaaaataatttcaatttttccgtctttatacgctttctctccatataaccacttagccgaatcttccccacatgcaaaccaatgagttgctaagatttttaccaaaattgttactaatttacgcaatactttttgaaaactgttttctgttacataagccatatgactatgaataattctaattttacaaccaattattttagataagatcagaccaattgcagatttatagccatggcaatgaactatatcataatctcctttctttattattctagcaagagagagaaactgatgtagaggctttttccttaatagaggcacatgataaacctttgcacccaattctttcattttatcctctaaaaatccttgttcttttccaggcacaataaaatcaaattgaattttttttctatcaatgtgagaataatagttgaatagaaaactttctactccaccactatctagtgttgtaaatagatgtaatactttaatcattcttcttccttaagcttaagattcgcttctctaattctatttctgttttttgtttttctaaactaattctgtccatgaagttatcacaattcttaattagctgtttcctgtcaaggttttgaatatacaaagccaaacaatctttttccgattcatccttcataggtaaaacgaaaccaaaaccattctctattgacactttttccatataagtatcttcacaaactaaaataggtttatacaacaatgcagcaaagtagagtttattagacaaagcatagtctagtaagggagtgtgattcccgtataaattcaaaacaacatctgtattcttataaaaagacatggtatctttaggctggaatgtgtccaccaagttaacattgctgatatttttttcttgacaaaattcccttaattctcctgcattagtacctataaaattcaactgaaatcgactgtcatttgcaaaaaaatcgattatttttttattttgttcttgaaaacgaattaaaccaatgtaggaaagttgaattggaaacgtactattattttttaactgctttacctcgtttaattctatcatattgggtaggttatgggtagtaaaatactctcccattggtaaaaaaaatttatagccgtctgaagaaacgatattcattaaagaatttttcaccaattgtttctgaaccaaacgataaaccaaaaatttttcataactgtaatcacgaatatcataaatatatctatttttaaatgaaaagagaagaaaatctactaaaatgaaagacacaatactatgtaacggcaatatcatatcataatcattttcttttagcttctttttaatttcttttctgaattttacataacctaatatcttacttaattttcctttaccagaaaaagaaatacgatagtagttttgttttgtaataatctcgttaatattcttatcccaatatataacatcgtaactaatagacagtttcttcaataattctttataaaaattgaagtaaggagttagatatatattatcagatagtataaacagtactctcattaaattattctttcttactttccctctctaaacatgtctccagttcgagcataaactgctcttttgaaaagtgattttcatagtaacaacgagctttctttcctaactctctttgtctcttaatagataacatactaaatttacaaatattttttgccaattgttttacatctcgttcgggactaacatatccacaatttgcttcttctacaattattttagcatctcctgaaattgcacctataattggtttgcctgccgccatataagaktgtaccttcccaggtatagtacgagaaactatcgagtctcctattaaagaaactaacatagcatctgattttttatagaaggatggcatttcctccaaagaacgtcttccatagaaggaaatattctttaactccaattcatgagctaatgctttcatgcttaacaattccgtaccatctccaacaaaatgaaaatgaattttcttgggtaaattggtattcttctctatcaaactggcagctttcaaaatagtttccaaattttgtgctttgccaatattaccagcaaaagttaggtcaacactttctttattaactatagattcatcagggataaaaagatcttctgcatattgtggcaaatatgtaatcttttgttcggatatgtcaaattgcttcacaaaataatttttaaatgatggactagtgacaaatatataatcactagctcggtaaactttttttgagataaatttaaacagcttgaaaatcaagccatcttgtttcactccacctacggttaaactatctggccaaacatccatacaatatagaaacatcggtttcttatatttttttttataagccataccagcccatgccatcataactggagacaattggttaacgaatacacagtcaaaattcgatccatctttcgttttatacctccccaataaaactcctaaagtagaactaattgcaaagctaaaataattcaacaatcgaaatacaacacttttttttctagggattgtataagaacgatatatcgtaacaccttctataatctcacgtctttttttattatgacgataatctgcatatatcttcccttcagggtaattaggaatcccagccaaaacagagacttcatgcccttttcgaactaaatcttcacaaatatctgacaacctgaatggttctggcttataatgttggcaaacaaatagtattttcattgtccaatttaactttctttcttaccactaccctctacaataccttttcgtttcagtacgtaaggtattgtcttaactatacatctaatatccattatcaaagacagatgtttaacatagtagccatctaactccgtcttcatctcaacagacaaagtatcacgcccgttaatttgtgcccatccagttaaccctggcaagatatcatttgctccatacttatctctctctgcaatcaaatctagttcatttatacccgctggtctaggacctacaatactcatattaccaacaagaatattaaacaattgtggtagttcatccaaagatgtttttcgcaagaaagcccctacttttgtaatcyattgctctggattatataagtttcgaggcgccacatttttaggtgcatctattttcatagacctaaatttcaaaatatagaagtattctttatgaataccaaagcgtttttgcttaaatataaccggaccttctgaatcaagtttaatcgcaattgcaattatcataaaaaccggacacaatattattatccctattaaagataataatatatcacctaatcgttttattataccgtacataaacaacctccaactataaattctatttccatttttcattctatttccatttgacaaattaaatcaggcagtacatgcaactacagaaactcaatatatatttggtcactcaatgattttcagaaatataattcttttatcctctacgtcagataaaacttttctccatctaaacaaaatttatttgtttcagtaatatatgagttctcaataatgaattagaaggtccagttcaattattcttccaaatagaccgaatattatttgaagacatatcggtttctgaaattgcaatcagtacataagctaataaactgataagtatgctctgtaagaatgccagagttatattgtagtccccttccatactatattcattttattttttaccataatttccataggaaccgtaaactccatacttattaaccgagatatccaatttatttaaaacaactcctaggaacagtttccctgtttgttttaattgttgtttcgctttttggatatcacgtttattcgcctcacctgttgctgttaccaagatggacgcatcacacttttgagtgataattgccgcatcaataacaattccaataggcggtgtatcaataatgatataatcaaaatatttacgcaatgtttcaatcatatcattaaaatttttactttgtaacaaggctgtagggtttggtgatacagatcccgattgaactacaaataaattttcaatatttgtatcacataaaccgtgagataaatcagctgtcccagataaaaattctgttagccctgtaattttttcacgagatttaaaaactcctaacataactgaatttcgagtatcgccatcgatcaaaagagttttatagcctgcacgcgcaaacgaccatgctatatttatggaagtagttgtttttccttccccagggttaacagaagtaacggaaattacttttagtttatctccgctcaactgtatatttgtacacaaggcattgtaatattcttctgccttcttaatgaactccagttttttttgtgctatttctaatgtcggcatccttctctcctatttcaacttacccaagtttggcacaactcccaaaagtgtcatctgcaatgtattttcgatatcttccggacgtttcacacgagtatccaaaagttcaagatgaagaactataacactagttccaatcacccctgccaaaaaaccaattagtgtattgcgtttaatatttggcgaagacggggatatcgccggccttgcctcctccagtgttgtcacgtcagaaacacgagtaatactgataattttttgagcagctacttctctcaaagagttagcgatacggcttgcctcttcaggaactcgatcattaactgaaatagagacaatacgggtatcaactggtactgtcactttaattttattagccaaaccttttggcgtcaaatctagtttcaaatcagaaacaacttcctccaaaacatcctgcgaaaggataatctcacggtagtcttttaccagataagttcctgcctgcaaatcctgatttgtcaaccccggcttgtctccttgattgcgattcactacgtaaattcgcgtggtactcgtatattctggcttaacaataaaagtgctatatgcaaaagcccccgcacctgtcacaagtgccactattaaaatcattagcttgcgtttccacaagcttttaactaattgaaatacatcgatttctatcgtattttgttctttcatcatttctcctaaattagttgatccattacaatttttcgaggattgtctataaaaagttcctgagccttcgcttctccgtatttttgggtaacaaggtcatatgcttctgccatatgaggaggtctaccgtctagattgtgcatatcacttgcaatgacatgaaccaaatcctgctctaaaaaatactgagctctttttttcatgaatttataacgttcgccaaaaagtttgggtttgaggacatgtgaactatttacttgcgtgtaacagcccatatcgatcagttctcgaacgcgtttttcattattttcaagagcatcatagcgctcaatgtgggcaatgactggagtaattcccaacatcaagatcttgctcaaggcgctatgaatatcgcgataaggagtgttcatactaaactctatcaaggcataacgactatcattgagggtcggaatccgctttttttccagcttatccagaacatctggtgtgtaataaatttcagccccgtaagcaatgaccaagtcactcgccacttccttagctatttcccgaacctgaagaaagttttctgctatcttctcttccggagtttcaaacatgcccttgcgacggtgagaggtagaaacaatggttcgcaccccctgtctgtaggattctgccaagagagccttgctttcctctcttgacttgggaccgtcatctacatcaaaaacgatatgcgaatggatgtctatcatttcatctaccctccatcacatcctgtatagctgctttaactacagctaaactactatcatctatttccatcacatagaggttactgtctggcattgcataagaaggaagatccatccgacctgtcccttttaaatcttgagaatttactttataattccctccactttctaactgagcattgaccaaatttatcatggtctcaagtggcatatttgtttggatagaatcttgcaagctattaatgatcgtactataatttttcagcacttcggttgacgttaatttttgaaggatagccacaatcaccttttgttgatggcgcccgcggtcacgatcgccatctgctagggagtagcgctcacgaacaaaaccgagagcctgttctgaatcaagatgaacattgcctgcagggtaatactttccattcgtatgggcagtaaattcttgatcattataaacatcaattccacccaacaaatcaatcaatttcaaaaacgaagtgaagttcaatcgcacatagtaattgatatccactccatagagattttctaaggtgtgaatggacgaatcaactccataaatgcccgcatgagtcaatttatctttttgattatttccaccatctgcgattggtacataggcatcacgtggcgttgtggtcaagaggattttcttggtatctcgattgacagtcatcaggatgttgacatctgatcgcgacaccgaactaataggaccataggtgtcaattccactaacatagatattgaaagactgactcttagacgtcttaggagcttctacttttttagtgaatcccttagtataaatcttttttatcttcgatgcgtagtctggatactctgactcgatgatgttttcaaagacactatttaggacaatggccttagtctcccctgcaatcaaactcttgtaagctgccaagtaagacgaactctggttgaccgtcaaatcggtattctgacttgacttgatatcagctagtaatttctgaatattttcattattagtcccagtcggtgctgtcacactcgtcagttgcgtaacattttcgatctcactatctgctaaaacagcgacactgattgaatattctgagtaattagaagtcgcatttaaacgattggtcagtccaacaaactgctgtactgcaaagagcgacacagagctgacaaggatagagaacaccaacagaaaaatagtaaacttttcagcttttttatagataatcaagagtagccctaccaaggcaactagtaggactaacgcagttaccactagattaagatatctaaaagcaaggatattgtacttaaagattaagaacaataaaaaacaaactaacaataaataaatagtcagcaaaactatattaacacttcgcttcactttctgtgaacgtgattttttaaaacgtctactcatgattaatacctatacattgaacattatacgattatatcacttttttacggtaatgtctacacctttatttttactatctgcatctttaagtatcttagtagacttcccgcgaaacaaaaatatagtaaaatgaaataagaacagaacaaatcgttcaggacagtcaaatcgatttctaacaatgttttagaagcagaggtg

SEQ ID NO: 36 - DNA, 21706 bp; double-stranded, linear
aaagttgaaagactgctagctgtttttgataccaatcgtttccaactacagagcaaacagtatacaaagtttgtttttggatgtaagcttcttgatggacaattccaagaaaatcaagaaattgctgaccttcaattttttgccattgaccaactgccgaacttatctgaaaaacgcattaccaaggagcaaatagagcttctttggcaggtttatcaaggtcatagggggcaatatcttgactaagaagatgattatcgtatttctaaatccatttttaacaactagcatggtataataatatgcaggaaaattttgaattatgaggaagactagatgaatttatgggatattttctttacgactcaggcaaccgagccgcccaaatttgaccttttttggtatgttagcctatttacgctcttagccttaaccttttatacagcccatcgctatcgtgaaaagaaggtttaccaacgatttttccaaatcttgcagactgttcagttaatccttctttatggttggtactgggtcaatcatatgccactgtcagaaagcctacccttttaccattgccgtatggctatgtttgtggtactcttgcttcctggtcaatccaaatataaacaatactttgcattattgggaacatttgggacattagcagcctttgtttatccagtgccagatgcttacccttttccacatatcaccattctatcctttatctttggtcatttagcactcttggggaactctctagtttatctattgagacagtataatgcgcgattgctggatgtgaagggaatttttctcatgacctttgccctaaatgccttgatttttgtggtcaatttggtgacaggtggcgattacggatttttgacaaaaccgccattggttggggatcacggtctagtagctaattatttacttgtttcaattgtgctggtagctactatcagtttgactaagaaaatcttagaattctttttagctcaagaagcagaaaaaatgattgcaaaggaagcttaacacagagctttcttttttgctcttagagagtttttacaagcagcttataaaataagaatttctgaatagacaaactcaaaaaatggctgggaaatttaggaaaaaagcaagcacgattaaattttttgtgttataatattttgtgaatagctatgcctatgtttagctatggaataatacgaagtgcgaaacttggaagatagagaggaagcgatgtaatggctagagaaggcttttttacaggtctagatattggaacaagctctgtcaaggtgcttgtggccgagcagagaaatggtgaattaaatgtaattggcgtgagtaatgccaaaagtaaaggtgtaaaggatggaattattgttgatattgatgcagcagcaactgctatcaagtcagccatttcccaagcggaagaaaaggcaggcatttcgattaaatcagtgaatgtcggcttgcctggtaatcttttgcaggtagaaccaactcaggggatgattccagtaacatctgatactaaggaaattacggatcaagatgttgaaaatgttgtcaaatcagctttgacaaagagtatgacacctgaccgtgaagtcattacctttattcctgaagaatttattgtggatggtttccaagggattcgtgacccacgtggcatgatgggggttcgccttgaaatgcgtggtttgctttatacaggacctcgtactatcttgcacaatttgcgtaagacggttgagcgtgcaggtgttcaggttgaaaatgttatcatttcaccactagcaatggttcagtctgttttgaacgaaggggaacgtgaatttggtgctacagtgattgatatgggggcaggtcaaacgactgtcgctacaatccgtaatcaagaactccagttcacacatattctccaagaaggtggagattatgtaactaaagatatctccaaggttttgaaaacctctcgcaaattagcggaaggcttgaaactgaattacggggaagcctatccgcctcttgcaagcaaagaaaccttccaagtagaggttattggagaagtagaagcagtcgaagtgacggaagcctacttgtcagaaattatttctgcacgaatcaagcacatccttgaacaaatcaagcaagaattagatagaaggcgtctattggacctccctggtggtattgtcttaatcggtgggaatgccattttaccaggtatggttgagcttgctcaggaagtctttggcgtccgtgtcaagctttatgttccaaatcaagttggtatccgtaatccagcctttgcgcatgtgattagtttatcagaatttgcgggtcaattaacagaagttaatcttttggctcagggagcgataaaaggtgagaatgacttaagtcatcagccaattagttttggtgggatgctgcaaaaaacagctcagtttgtacaatcaacgcctgttcaaccagctcctgctccagaagtagagccggtggcgcctacagaaccaatggcggatttccaacaagcttcacaaaataaaccgaaattagcagatcgtttccgtggattgatcggaagcatgtttgacgaataaagaggaaaaataaattatgacattttcatttgatacagctgctgctcaaggggcagtgattaaagtaattggtgtcggtggaggtggtggcaatgccatcaaccgtatggtcgacgaaggtgttacaggcgtagaatttatcgcagcaaacacagatgtacaagcattgagtagtacaaaagctgagactgttattcagttgggacctaaattgactcgtggtttgggtgcaggaggtcaacctgaggttggtcgtaaagccgctgaagaaagcgaagaaacactgacggaagctattagtggtgccgatatggtcttcatcactgctggtatgggaggaggctctggaactggagctgctcctgttattgctcgtatcgccaaagatttaggtgcgcttacagttggtgttgtaacacgtccctttggttttgaaggaagtaagcgtggacaatttgctgtagaaggaatcaatcaacttcgtgagcatgtagacactctattgattatctcaaacaacaatttgcttgaaattgttgataagaaaacaccgcttttggaggctcttagcgaagcggataacgttcttcgtcaaggtgttcaagggattaccgatttgattaccaatccaggattgattaaccttgactttgccgatgtgaaaacggtaatggcaaacaaagggaatgctcttatgggtattggtatcggtagtggagaagaacgtgtggtagaagcggcacgtaaggcaatctattcaccacttcttgaaacaactattgacggtgctgaggatgttatcgtcaacgttactggtggtcttgacttaaccttgattgaggcagaagaggcttcacaaattgtgaaccaggcagcaggtcaaggagtgaacatctggctcggtacttcaattgatgaaagtatgcgtgatgaaattcgtgtaacagttgttgcaacgggtgttcgtcaagaccgcgtagaaaaggttgtggctccacaagctagatctgctactaactaccgtgagacagtgaaaccagctcattcacatggctttgatcgtcattttgatatggcagaaacagttgaattgccaaaacaaaatccacgtcgtttggaaccaactcaggcatctgcttttggtgattgggatcttcgccgtgaatcgattgttcgtacaacagattcagtcgtttctccagtcgagcgctttgaagccccaatttcacaagatgaagatgaattggatacacctccatttttcaaaaatcgttaagtaaatgaatgtaaaagaaaatacagaacttgtttttcgagaagttgcagaggctagtctgagtgctcatcgagagagtggttcggtctctgtcattgcagttaccaagtatgtagatgtaccgacagcggaagccttgcttccgctaggtgtccatcatatcggtgaaaatcgtgtagataagtttctggaaaaatatgaagctttaaaagatcgagatgtgacttggcatttgattggtaccttgcaaagacgtaaggtgaaagatgtcattcaatacgttgattatttccatgcattggactcagtaaagctagcaggggaaattcaaaaaagaagtgaccgagtcatcaagtgtttccttcaagtaaatatttctaaagaagaaagcaaacacggtttttcgagagaggaactgctggaaatcttgccagagttagccagactagataagattgaatatgttggtttaatgacgatggcaccttttgaggctagcagtgagcagttgaaagagattttcaaggcggcccaagatttacaaagagaaattcaagagaaacaaattccaaatatgcctatgaccgagttaagtatgggaatgagtcgtgattataaagaagcgattcaattcggttccacttttgttcgtataggtacatcattttttaagtaggagagaaccatgtctttaaaagatagattcgatagatttatagattattttacggaggatgaggattcaagtctcccttatgaaaaaagagatgagcctgtgtttacttcagtaaattcttcacaggaaccggctctcccaatgaatcaaccttcacagtcggctggcacaaaagagaacaatatcaccagacttcatgcaagacaacaggaattggcaaatcagagtcagcgtgcaacggataaggtcattatagatgttcgttatcctagaaaatatgaggatgcaacagaaattgttgatttattggcaggaaacgaaagtatcttgattgattttcagtatatgacagaggtgcaggctcgtcgttgtttggactatttggatggagcttgtcatgttttagctggaaatttgaaaaaggtagcttctaccatgtatttgttgacaccagtgaacgttattgtaaatgttgaagatatccgtttaccagatgaagatcaacagggtgagttcggttttgatatgaagcgaaatagagtacgataatgatttttttaattcgtatgatttataatgcagtggatatttactccctgattttggtagccttcgctgtcatgtcttggtttccaggtgcctacgaatccagtttaggtcgttggattgtagcgttggtgaaaccagtgcttgctcccttgcaacgcctgcctttacagatagcgggtcttgatttatctgtttgggttgcgattgttttggttcgatttttaggagaaaacctagtgcgttttctggcgatgataggatgaataaagggatttatcagcatttctccatagaagatcgtccatttcttgacaagggaatggaatggataaagaaggtagaagatagctatgctccttttttaactccttttatcaatcctcatcaggagaagctattaaagattttggccaaaacctatggtcttgcttgtagcagtagtggggaattcgtctcgagtgagtatgttcgagttttattatacccagattatttccaaccagagttttcagattttgaaatatctctccaggaaattgtgtattccaataaatttgaacatttaacgcatgctaagattttagggacagtcatcaatcaattagggattgaacggaaactttttggagatatcctagtagatgaagaacgggcgcagattatgattaatcagcagtttcttcttctctttcaagatggactaaagaaaattggtcgtatacctgtttcgctggaggaacgtcctttcaccgagaaaatagataagctagaacagtatcgagaactggatttatctgtgtctagttttcgattagatgttcttttatcaaatgttttgaaactatctaggaatcaagcaaaccagttgattgaaaagaaacttgtccaagtaaattatcatgtggtagacaaatcagattacactgttcaagttggagacttgattagtgtgagaaaatttggtcgcttgagattacttcaagataagggacaaacgaaaaaagagaagaaaaaaataaccgtccagttattattaagtaagtgaggaatagaatgccaattacatcattagaaataaaggacaagacttttggaactcgattcagaggttttgatccagaagaagtcgatgaatttttagatattgtggttcgtgattacgaagatcttgtgcgtgcgaatcatgataaaaatttgcgtattaagagtttagaagagcgtttgtcttactttgatgaaataaaagattcattgagccagtctgtattgattgctcaggatacagctgagagagtgaaacaggcggcgcatgaacgttcaaacaatatcattcatcaagcagagcaagatgcgcaacgcttgttggaagaagctaaatataaggcaaacgagattcttcgtcaagcaactgataatgctaagaaagtcgctgttgaaacagaagaattgaagaacaagagccgtgtcttccaccaacgtctcaaatctacaattgagagtcagttggctattgttgaatcttcagattgggaagatattctccgtccaacagctacttatcttcaaaccagtgatgaagcctttaaagaagtggttagcgaagtacttggagaaccgattccagctccaattgaagaagaaccaattgatatgacacgtcagttctctcaagcagaaatggcagaattacaagctcgtattgaggtagccgataaagaattgtctgaatttgaagctcagattaaacaggaagtggaagctccaactcctgtagtgagtcctcaagttgaagaagagcctctgctcatccagttggcccaatgtatgaagaaccagaagtagctccaatgcatccgataggtccaacaccagctacagaaactgttgattcaataccgggatttgaagcaccgcaagaatctgttacaattttataagaaatattctgagaacaatatcttatccttatatttccagcgagcaggagatggtgtgagtcctgtaatccctattgataagattatcctctcaaaaactcaagtctgaagctagtaagatttgacgtttcccacgttacgggataagagggagaaagactaaatctttttccgaataaaggtggtaccacgattttcgtcctttttggaagtcgtggtttttaatttgttattatttataaaggagataccatgaaactcaaagacacccttaatcttgggaaaactgaattcccaatgcgtgcaggccttcctaccaaagagccagtttggcaaaaggaatgggaagatgcaaaactttatcaacgtcgtcaagaattgaaccaaggaaaacctcatttcaccttgcatgatggccctccatacgctaacggaaatatccacgttggacatgctatgaacaagatttcaaaagatatcattgttcgttctaagtctatgtcaggattttacgcaccatttattcctggttgggatactcatggtctgccaatcgagcaagtcttgtcaaaacaaggtgtcaaacgtaaagaaatggacttggttgagtacttgaaactttgccgtgagtacgctctttctcaagtagataaacaacgtgaagattttaaacgtttgggtgtttctggtgactgggaaaatccatatgtgaccttgactcctgactatgaagcagctcaaattcgtgtatttggtgagatggctaataagggttatatctaccgtggtgctaagccagtttactggtcatggtcatctgagtcagcacttgctgaagcagagattgaataccatgacttggtttcaacttccctttactatgccaacaaggtaaaagatggcaaaggagttctagatacagatacttatatcgttgtctggacaacgactccatttaccatcacagcttctcgtggtttgacggttggtgcagatattgattacgttttggttcaacctgctggtgaagctcgtaagtttgtcgttgctgctgaattattgactagcttgtctgagaaatttggctgggctgatgttcaagttttggaaacttaccgtggccaagaactcaaccacatcgtaacagaacacccatgggatacagctgtagaagagttggtaattcttggtgaccacgttacgactgactctggtacaggtattgtccatacagcccctggttttggtgaggacgattacaatgttggtattgctaataatcttgaagtcgcagtgactgttgatgaacgtggtatcatgatgaagaatgctggtcctgaatttgaaggtcaattctatgaaaaggtagttccaactgttattgaaaaacttggtaacctccttcttgcccaagaagaaatctctcactcatatccatttgactggcgtactaagaaaccaatcatctggcgtgcagttccacaatggtttgcctcagtttctaaattccgtcaagaaatcttggacgaaattgaaaaagtgaaattccactcagaatggggtaaagtccgtctttacaatatgatccgtgaccgtggtgactgggttatctctcgtcaacgtgcttggggtgttccacttcctatcttctacgctgaagatggtacagctatcatggtagctgaaactattgaacacgtagctcaactttttgaagaatatggttcaagcatttggtgggaacgtgatgccaaagacctcttgccagaaggatttactcatccaggttcaccaaacggcgagttcaaaaaagaaactgatatcatggacgtttggtttgactcaggttcatcatggaatggagtggtggtaaaccgtcctgaattgacttacccagccgacctttacctagaaggttctgaccaataccgtggttggtttaactcatcacttatcacatctgttgccaaccatggcgtagcaccttacaaacaaatcttgtcacaaggttttgcccttgatggtaaaggtgagaagatgtctaaatctcttggaaatactattgctccaagcgatgttgaaaaacaattcggtgctgaaatcttgcgtctctgggtaacaagtgttgactcaagcaatgacgtgcgtatctctatggatatcttgagccaagtttctgaaacttaccgtaagattcgtaacactcttcgtttcttgattgccaatacatctgactttaacccagctcaagatacagtcgcttacgatgagcttcgttcagttgataagtacatgacgattcgctttaaccagcttgtcaagaccattcgtgatgcctatgcagactttgaattcttgacgatctacaaggccttggtgaactttatcaacgttgacttgtcagccttctaccttgattttgccaaagatgttgtttacattgaaggtgccaaatcactggaacgccgtcaaatgcagactgtcttctatgacattcttgtcaaaatcaccaaactcttgacaccaatccttcctcacactgcggaagaaatctggtcatatcttgagtttgaaacagaagacttcgtccaattgtcagaattaccagaagttcaaacttttgctaaccaagaagaaatcttggatacatgggcagccttcatggactttcgtggacaagcacaaaaagccttggaagaagctcgtaatgcaaaagttatcggtaaatcacttgaagcacacttgacagtttatccaaatgaagttgtgaaaactctactcgaagcagtaaacagcaatgtagcacaacttttgatcgtgtctgagttgaccatcgcagaaggaccagctccggaagctgcccttagcttcgaagatgtagccttcacagttgaacgtgctactggtgaagtatgtgaccgttgccgtcgtatcgacccaacaacagcagaacgcagctaccaggcagttatctgtgaccactgtgcaagcatcgtagaagaaaactttgcggaagcagtcgcagaaggatttgaagagaaataagattgaaaagtctaggcaaaattcaatttgagaagaaaagacaactaattttatagtctattaaacgcattgtatcacgtttttgaatacctgatatgatgcgttttttatttattttaaaaatttgcgaggtatgactttttatactcaacaagaatcaaagagaaacttagcaagctaacagtagtaagataaaataggaatttgatattagggataagattggtaaatagtgtaatatttttacaacaataaatttatatagttatttctggtttctgaaaagtattatattttatttcatattatacaaatttttattttataatatcagaacatactttttttaaaagcaaatatgatacaattttatttgaaaaaaataaaaaaggagattttattataaaattaaaaagacttgctttaattagtggtatcgtcggtcttgtgggaggaattttacttcttattggtccttttgtcttgttgggaatagcggtaaacacagctgctacaactcttaatggaggagctactgcaggggctttttcaggtgtagccttactcttgaatgccttgaagattgcaaatcttgttcttggtatcattgctattgtttactataaaggagataagcgtgtaggtgcagctccgtctgtactaatgattgtttctggtggagttagtctcattctattccgttcttaggatgggttggggggatttttgctattatcggaggatctctattcctttcaacattgaagaaattcaaatcagaagaataaaaggtattttagcatgaaaagaacaaaaaagtttatcggtataggagtagctctattatctctttctcttctagttgcatgtggaacataaagttcaaagaatacttcaacaagtaatgatgagaagacagtagcaacatccaatagttcaaaagaaacaatcactttcgatacaccggttgtaacagacgatgcgattgaatcaatacgcacttatgcagattatatagatctttataaaaatatttttgatgattattttactaaagctgaggaaggtttcaaaggcatagctatggaaaataatgactcgtttactaaactaaaagagtcaactcaaaaattattcgatgcgcagaaaaaaaggttaaataatgaagatagaatagaaacaaccaaaaacaatgtgattgccaaacattgtcaaacagtcctttcctttttggttttgactagcttttttgtgaaaaattgtgtaaaatagaatagataaacgaggggaaacctcggaaaatttaaaggagaatccatctaatggtaaaattggtttttgctcgccacggtgagtctgaatggaacaaagctaaccttttcactggttgggctgatgttgatttgtctgaaaaaggtacacaacaagcgattgacgctggtaaattgatcaaagaagctggtatcgaatttgaccaagcttacacttcagtattgaaacgtgctatcaaaacaactaacttggctcttgaagcttctgaccaattgtgggttccagttgaaaaatcatggcgcttgaacgaacgtcactacggtggtttgactggtaaaaacaaagctgaagctgctgaacaatttggtgatgagcaagttcacatctggcgtcgttcatacgatgtattgcctccaaacatggaccgtgatgatgagcactcagctcacacagaccgtcgttacgcttcacttgacgactcagttatcccagatgctgaaaacttgaaagtgactttggaacgtgctcttccattctgggaagataaaatcgctccagctcttaaagatggtaaaaacgtattcgtaggagctcacggtaactcaatccgtgcccttgtaaaacacatcaaaggtttgtcagatgacgagatcatggacgtggaaatccctaacttcccaccattggtattcgaattcgacgaaaaattgaacgtcgtttctgaatactaccttggaaaataaaaaattgtaagtctagaattgatttctaggctttttatgttagtatggaagtatgataaggaataaaaaacaagattatgtactggcctacaagcaaccagcttcaaccacttacatgggttgggaagaagaagctttaccgataggcaatggttctttaggagcaaaagtatttggccttataggggctgaacggattcaatttaatgaaaaaagtctctggtctggaggtccacttcctgatagttcagattatcagggtggaaatcttcaggatcagtatgtttttttagctgagattcggcaggctttggagaagagagattacaatctggctaaggaactggctgagcagcacctaattgggccaaaaacgagtcaatatgggacctatctgtcttttggggatattcacattgagttcagccagcaaggtacgactttgtctcaggtgacggactatcagagacagctgaatattagtaaggcacttgcgacgacttcttatgtctataagggaacgcgatttgaacgtaaagcttttgcgagttttccagatgatctcttggttcaatgttttactaaggaagggttggaaactctagattttactatagaactatccttgacctgtgatttggcttctgatggaaagtatgagcaggaaaaatctgattacaaggagtgtaagttggatattactgattctcatatcttgatgaagggaagagttaaggataatgatctgcggtttgctagttatctagcttgggaaacggatggagatattagagtttggtcagatagggttcagatatcaggagccagttatgccaatctcttcttggccgctaagacggattttgcccaaaatcctgctagcaattatcgcaagaaactagatttagagcaacaggtgatagacttggtggacacagctaaagaaaagggctatacccaattgaaatcaaggcatatcgaggactaccaagccttattccagcgtgttcaattggatttggaagctgatgttgacgcatccactacagatgatttgttaaaaaattataagccacaagaagggcaggctttggaggagctgttcttccagtatggacggtatttattgattagttcgtccagagactgcccagatgctctaccagctaacctacagggagtctggaatgcggtcgacaatcctccttggaattcggactatcacttaaatgtcaatctgcagctgaattattggccagcctatgttaccaatctcctagagacggtctttccagtcatcaactatgtagatgatttgcgtgtctatggtcgtctagcggctgtaaagtatgcaggaatcgtctctcagaaaggtgaggagaatggttggttggttcatactcaagcgactccctttggttggacggcacctggttgggattactattggggttggtcaccagctgccaatgcgtggatgatgcaaaccgtttatgaagcctatttattttatagggaccaagactatctcagggagaaaatttatcccatgttgagggaaacggttcgtttttggaatgcctttttacataaggatcagcaggcgcagcgttgggtgtcttctccgtcttattccccagaacatgggccgatttcgattggcaatacctatgaccaatctctgatttggcagttatttcatgattttattcaggctgctcaggaattgggactggatgaggacttgttgactgaggttaaggagaagtctgatttactaaatcctttgcaaatcactcaatctggtcgaatcagggagtggtatgaggaggaagagcagtattttcaaaatgagaaagtggaggcccagcatcggcacgcttcccatctagtgggactctatcctggcaatctctttagctacaagggacaagagtatattgaagcggcgcgtgctagcctcaatgatcgtggagatggcggcacaggctggtccaaggctaataagatcaatctctgggcgcgtttgggagatggcaatcgagcccataaattattggcagagcagttaaagacatccaccttgcaaaatctttggtgtagccatcctccttttcagatagatggtaattttggtgctactagtggcatggcagaaatgttactccagtctcatgcagcttatctggtacctctagctgccctacctgatgcttggtcaacaggttctgtttcaggcttaatggcacgtggacattttgaagtgagcatgagctgggaagataaaaaactcttacagttgaccattttatcaaggagtggaggagatttgcgagtttcttatccagatattgagaagagtgtgattaaaatgaatcaagaaaaaataaaagcgaaatgcatggggaaagattgtatttcggtggcaacagcagaaggtgatcttgttcaattttatttttaagaagatgttataaggcagtaatttgaaactgccttttaataaggatttaagaatataagcagttttcaactagttgaaaaaacgttataatgataataggaagtaatactcaatgaaaatcaaagagcacaaactaggaagctagccgcaggttgctcaaaacagtgttttgaggttgcagatggaagctgacgtggtttgaagagagattttcgaggagtataatttgtttgatagagggtgggtctgatggcttatattgagatgaaacactgttacaagcgttatcaggttggggacacggagattgtggccaattgtgatgtgaattttgagattgaaaagggggagctggttattatccttggtgcttcaggtgcaggcaagtcaacagttcttaaccttcttgggggaatggataccaatgatgaaggggaaatctggattgatggtgttaatattgcggattatagttcccaccagcgcaccaattaccgtagaaatgatgtggggtttgtttttcagttttataatctagtttctaatctgacagctaaggaaaatgtggaactggcttctgaaattgtgacagatgccttgaatcctgatcaggccttgacagatgtaggtctggctcatcgtctcaataactttccagcccagctttctggaggggagcaacagcgagtctccattgcacgcgcggtagccaaaaatcctaaaattctcctttgtgatgaaccgactggagccttggattatcagacgggcaagcaggttttgaaaattctccaagacatgtctcgtcaaaagggagcgacggtgatcatcgtgactcataatggagctttggcgcccattgctgatcgcgtgattcaaatgcacgatgccagtgtcaaggatgtggtgctcaaccagcatcctcaggatattgacagtttggagtactagcatgatcaagcgaaaaacttattggaaggacttagttcagtccttcacaggctccaaggggcgttttttatccatcttgatcctgatgatgttgggatctctagccttagtaggcctcaaagtaaccagtcccaacatggaggcgacagctaatgcttatttaacaactgctcaaaccttggatttggcagtcatgtctaactatggcttggatcaagcagaccaagaagaactaaaacagacggagggcgcagaggtcgagtttggctatttgacagatgtgactatggataatgggcaggatgccattcggctgtactccaaaccagagcgaatttcaacctttcagctaagaaagggacgacttcctcagtcagacaaggaaatcgctttggccactcatttgcaaggccaatacagcgtgggacaggagattagttttaaagaaaaagaagagggtcattcctctttaaaagaccatacttataccattactggttttgtggattcggctgaaatcctctcccagcgagatatgggctacgcaggaagtggaagtgggactctgacagcctatggggtgattttacctagtcaatttgatcagaaagtctacaatatagctcgtttgaaatatcaagatttagcgggtttaaatgccttttcatcagcttatgaagaaaaatccaagcaacatcaagaagagcttgaacaaattttatcagataatggcaaggtacgtctgcaacttttgaaaaaagaaggacaagagtctctagacaaggggcaagagacccttgacaaggctcagactaatttgcaggaaggcaagcgtcgtttagcagctgctcaagctcgtatacaggctcaagaaagtcaactagccttgtttcctcaagttcagagagagcaggctagtgctcaacttacccaagccaagcaggaattgggcaaggaagaggacaaactaaagcaagctgaacaaaatctagcccaagaaaaggaaaaattagaaaaacatcagcaagtcttggatgatttggcggagccaaggtatcaggtttataatcgtcagaccatgccaggtggtcagggctatcttatgtatagcaatgcttcatccagtattcgagcagtgggcaatatctttcctgtggtactttatgccgtagcagccatggtgacctttacgaccatgactcgctttgtagacgaagagcgaactcatgcagggatttttaaggccttgggttatcgtagtaaggatattatcgccaagtttctcctttatggactagtagctgggactgtcggaacggctctaggtagtatacttggtcattatttgctagccagtgtaatttcaagtgtcattacaaaaggcatggtggtgggagaaactcagattcagttctattggacctatagcttactagcttttgtcttgagcttgttggcgagtgtgttaccagcctatctggtggcttggagggaacttcatgacgaagcagcccagcttctacttcctaaacctcctgtcaaaggagctaaaatcttattggagcgtatcggttttatctggcgtcgtctcagttttactcataaggtaacagcccgcaacatctttcgttataagcagagaatgttgatgacaatctttggtgtggcaggttctgtagctctgctctttgcaggtttgggaatccaatcttctgtagcaggagttccgtctaaacagtttcaacaaatccaacagtatcagatgcttgtctctgaaaatcctagtgcgaccaatcaggacaaggtagagctagcagaagtgttgaaagggcaggagatactagcctaccagaaaatctattctaaagcgctatacaaggatttcaaaggcaaagctggtcttcaaaacattactcttatgatgatagagaaggaagatttgactccctttatccatcttcaacatcatcagcaggagctgacattaaaagatggcatcgttattacagctaaactcgcccagctggcaggtgtcaaggttgggcagactttagaaattgaaggtaaggaactaaaggtcgttgctattactgagaactacgttggtcactttatttatatgagtcaggctagctatgagcaactttacggacagctaccccaagccaacacttatctggtctcattaagggataccagtgcaactagtatcgaaagtcaggcgggcttgcttatgaatcaatctgcggtgtccagcgttgtccaaaatgcttcagccattcgactcttcgactctatcgctagctcactcaatcagaccatgaccatcttggtcatcgtatcggttctattagctattgtcatcctttacaatctgaccaatatcaacgtagctgagagaatccgtgaactctccactatcaaggttcttggttttcataataatgaagtcaccctctacatttaccgtgagacgattgtgctgtcccttgtgggaatcgtacttggtctgatagctggtttctatttacaccaatttttgattcaaatgatttcgcctgcgactattctcttttatccgcaggtaggctgggaagtctatgtaatcccagtggcagcagtaagcatcattttgaccttgcttggtttcttcgtcaattattatctgagaaaggttgatatgttagaagccctgaaatctgtagagtaaggtagttatttttagctgattgaacttctatttactaatattcaaaaatcctccgtttcaaagagcagggaactctttgtgacagaggattttttctatagggctttagcagctgcaattgcggcttcgaagtttggctcagaattgatattatccacgtattcaacgtagcgaatcgtattgtcagtatcgaggacaaagactgcgcgtgctaataggtgccattcgttgatcaagagggcataatcgcgcccgaaagaatggtcaaagtagtctgaaagcataatggcattgtcaaggccttcagcaccgcaccaacgtttttgagcaaaaggtaggtccattgaaacagtcaatacgaccgtgttgtccagtccagccaattcttcattaaaacgacgtgtttgagttgagcagatgcctgtatcgatagaaggaacgacactcaagacttttttcttgccatcaaaatcagccagagattttttagaaagatctgttgtagtaagagaaaaatcaagcgccttgtcgccgacttgtagttgtttacctgtaaagctcacaggatttccgagaaaagttaccataggatactccaatcttttttcttccattttagctgaaacagtcggaattttccaatgatttgaccggaaatatgggcatagaaaaaacgccagctcatgtgagaatgacgtttttcataggtttattttgccaatccttcagcaatcttgtcaaggttgtatttcatcatgctgtagtagctgtcgccttctttaccttgttctgcgatagagtcagtaaagatttgagcgtagattgggatgtttgtgtcttgagaaacagttttcattggacggtcatccacacttgattctacaaagagtgatggaacttttgtttggcgaagtttttcaaccaaggtcttgatttgttcaggagttccttcttcttcagtattgatttcccagatgtaagcacttgggacaccataggctttagagaagtatttgaatgctccttcgctggttacaatgagtttcttttcagcagggatcttattaaatttatccttactttctttatcaagtttgtctaacttatcagtatattctttgagatttttttcatagaattctttattgttagggtctttggcgctcaattgtttggcgatatttttagcaaaaataataccgttttcaaggttaagccaagcgtgtgggtcttcttttcctttttcattttgaccttcaaggtagataacatcaacgccgtcgctgactgcgaagtagtctttgttttcagttttcttggcattttctaccaattttgtaaaccaagcattgccacctgtttcaaggttgataccgttatagaaaatcaaattagcctcagaagttttcttaacgtcttcaggaagtggttcgtattcgtgtgggtcttgcccaatcggaacgatactatgaaggtcaattttgtcaccagcaatatttttagtaatatcagcgatgattgagtttgtagcaacaacttttagtttttgaccagaagttgtatctttttttccgctagcacatgctacaagaatgattgcagaaagaaagagaacgagtaatgtacctaattttttcattagatcctccaatttattagggctttgccccttattttaacaaatgtttatttttcagtttcaaatatcgttgtttgggagcgataaagaagctaatgagaaagaaactagcagctgtaagcacgatactagaacctgccgcaacattaaaactatagccaataaagagtcccaaaactgaagcagtagctccgaaggttgaggaaaggaaaatcatacttttcagactattagcatacagataagcagttgcagctggggtaatcagcatggctacaatcaggatagttccgacactttgcatggctgtcacagacacgagagtcaggagtaccatgagaaggtagtgatagaaattgacaggcattcccatggctttagccaagagttcatcaaaggaagttatcaagagttgcttgaagaaaatccagattaacaagaggatagctgcccccacacccatagtaataaacatatccgtatcttggacggccaggatattaccaaaaaggatatggaaaaggtcagttgaacttttagcgacaccaatcaagatgataccgagggctaagaaagaagaaaaggtaatgccgatggcggtatcgcttttgataatcgagtttcctttgatgtaggtaatgatgatggcagctagcaatccaaagacaatggctccgataaagaagtcaaggcccaagatgaaggatagggctacacctggtaagacagcatgtgaaatggcatctcccatgagtgacatcccgcgtagaataatgaaacatcccacagctccagctacaatcccgacgacaatagctgttatcaaggcattttgtaggaaatggaatttttgcaatccatcgataaattctgcaatcataggtcacctccattgaaaaagagttgattaccgtaagcttcttttagattggtttcggtaaaagtttcttttgttggaccaaaggcaatcacttctcgattgacaagtaagacttgatcgaagtagtggggaatcttgctgaggtcgtggtgaacgatgagaaccgtcttcccagcttttttcaaatctctcagcgtattcatgatgatttcctcactgacagagtcaatcccagcaaagggttcatccaagaggatatagtcggcttcctgcaccaaacatctggcaatcaagacccgctggaattgacctccagacagttgactaatttgacgttcagcgtagtcagctaggccgacgatttcaagggcctcttgcactttcttccaatgtttagcctttaaacttcgaaagagaggaatagagggaaatagtcctaacgagacgcattccttgaccttgatgggaaagttgtagtcgatattgattttttgttcgacataggcaattcggtgtaaggattttttaacttccttgtcatcgagaaatgcctgaccttgatgtgggataattcccaacataccttttaatagtgttgatttcccagcgccgtttggaccaatgatgccggtaattgttggtccatggagcactagtgaaatatccttaagtgccaacgtttctttgtaggagacactgaggttttcgatacgtatcataaacttgtattcctcctgtctcttaatatacattaaaaaaaaaattaagtcaagttaatttttgaaaaaattaaaataataactgaaaaatagattctaaagataactttcaggataaatttctaaattataaaacgcatagtatcaagtgtaaaaaacttggaattatgcgttttatcatggaaagattttttataatagctaaaaaataa

SEQ ID NO: 37 - DNA, 6171 bp; double-stranded, linear
gatccccaggaaaaaccgaggttttcccaatcaatcgttactgtcatattccactccttattctaaaaacctatttcttatattctacactatttttctaaaatagcaagtatattttgtaattttcagaaaatttctccaataaaaaccaactcttagaactgattcttcatttcacttatttatcttcagtaactacttcctgaagataagcgtcaaaaacttcttcatctgaaatcgtgtcagaaatgaagcttccattgctagtgcgttctgacaagttcaagtcttgcaatcggctttcatagattgttcctttattggattggacaagcagagtttggtcgttcacatccacttccgtactgaagaaatcgccaacaaatccttgctctgcaactgctcctgccaagaagacacgatgcggtttgtttttcaactcacgcaagacttgtaatcctcgtttggcacggctggttgctagaatttcctcaatggaaacacgtttcaagcttccacgctgggtcaagaggtagaaggacgaagtattacagataaagccagattggaggacatcatcttctttcaaattcatagccttgacacctgctgccttagcaccgacaaccggaacctcttcgatattgaaacgcagggcataaccattttgactaaccaagacaacatcatctagtttaatcggagccactgctacaatctgatctgtatcgtctttgagcttagcatacttgacagacttagatctataggtccgccatggagtgaattcttttcgctctacccgtttgatttgaccaaggcgagtcactgcaaagtaggttgtcgcatcgtcaaactgatccagtacttccacataaaggatttcttcattcgtttcaaagtttgtgatggtttggctcagatgctctccgatgtccttccaacgaatatctgccaactcatggattggtctgtagatgacatttccaagacttgtgaacatcaagaggtgctgggttgtcttggcagattgaacaaaaatcaaacggtcatcatcacgcttgccaatttcttccaaggtggaagccgcaaaggaacgtggactggtacgcttgatgtaacctgccttggtcacgctgacgtaggtatcttcctcagcgataagactagctgtatcaatctcaattgctttcgcagtgtcttctaaagaactcaaacgaggagttgcaaatttcttcttgacctcacgaagttctttcttcatgagattgtacatagtcctttcatcaccgataatagccgccagcatagcaatcttctcacgaagctctgcttcttcttcctgcaagacaaccacatcggtattggtcaaacggtacagttgcaaagttacgatagcctcagcctgttcttccgtaaaatcatagctaactttgaggttttccttggcgtccgccttattctcagaagcacggataagagcaatgacttcatccaaaatcgaaatcacacgaatcaaaccttcgacgatatggagacgtttctcagccttttctttgtcaaagcgtgaacgcgccaaaatcacttctcgacggtgagcgatatagctagacaggattggaacaatcccaacctgacgaggtgtgaaattgtcaatcgccaccatattaaagttgtagttgatttgtaggtcggtgtacttaaataagtagttgagaacaagctcagtattagcgtctttcttaagttcgatagcgatacgaagaccatcacggtcagactcatcacgaacctcagcaatcccagctaccttgttattaacacgaacatcatcgattttcttgactagattggccttattgatttcataaggaatctcaataataacgatttgttccttaccaccttttagcttttcaatttcagtcttggaacgaacaaccacgcgccctttcccagtctcataagctttcttgatttcatcacgaccctgaataatagcccctgtagggaagtctggtccaggcaagaattccatgagtttatcaatctttgcagttgggtggtcaatcatgtaaactgcagcatctatgacctcagctaaattatggggaggaatgtctgtggcataaccagccgaaatcccagtcgaaccattgaccaagaggtttggaaaggctgctggcaagaccgttggttctttctccgtatcgtcaaagttccatgcaaaaggaactgtctttttctcgatatcctgaagaaggtagcctgcaatttcagacaaacgtgcctcagtataacgcatagccgcaggaggatctccgtccatagaaccgttattaccgtgcatttcaactagaatctcacgatttttccagttctgtgacatacgaaccatggcatcatagatagaagaatccccgtgtgggtggaaattccccatgatgttcccgactgacttggccgacttacggtagctcttgtcaaaagtattgctatccttattcatagaataaagaatacggcgctgaaccggcttcaacccatcacgaatatctggcaaagcccggtcttgaataatgtacttggagtagcgaccaaagcgctctcccatgatgtcctccagggacatgttttgaatgttagacataagatacaaagcccataaaataccaagtgaaaatagaaaattcttgaagtaagcaaactcacaagagaatttatctttttcacacagtatctagggcgtgttcaactcctttcaaagaatgtagagtaggtttttatgcagtaaaagatattttacgggaattcctcccgtgttcagttacgataagtaaccaaactatcctgtttgtatttttcaatatgaaaatctggttttccaaaattagtcttagtttgtgtcttagccgctcccttaagcgcctctttgagataagcactcatagcagattcttcattaataatcctgcaattttttcaaaccaagattttcaaactgctttttcacatagtcattcacatccgactctaatttccagtttactaacatattattttctttcattaaaacactgtcgtttcttctagcgtaaacttgacattatcttcaatccatttacggcgtggttctaccttatctcccatgagaacattgacgcggcgttcggcgcgcgctaaatcttcaattgtgacacggatgagggtacgtgtttctgggttcatggttgtttcccagagctggtccgcattcatctcaccaagtcctttgtatcgttggagggtagcgcctttaccgaactgtttacggagttcttctagttctccgtccgtccaagcgtaggccacttcttctttcttgcctttacctttggacatcttgtaaagaggtgggagggcaatatagacatgacctgcctcgactagcggacgcatgtaacggtagaaaaatgtcaagagcaaggtctggatatgggcaccgtcggtatccgcatcggtcatgataatgatcttatcatagttggcatcttcaatagagaagtctgctccaacacccgcaccaatggtataaatcatggtattgatctcttcatttttgaggatatccgccatcttggccttggctgtattgacaaccttaccacgaagaggtagaatagcctggaacttgcggtcacgaccttgtttggcagaaccaccggcagagtccccctcaactagatagagttcattcttagcaggattcttagattgggctggggtcaatttcccagacaacaagcccttatctttcttgtttttcttcccatttcggctctcatcacgcgccttacgtgctgcttcacgagcatcacgggccttgatagccttgcggatgaggttagaagctaattccccattttccataaggaaaaaggtcaacttatcagccactattccatccacaactgggcgagctagggggcttcctagtttatccttggtctgtccttcaaactgcaagtgttcttcaggaactaagatagaaagaacggccgctagtccctcacgatagtctgaaccttcaaggtttttatctttttccttgagaagacctgttttacgtgcatagtcattcatgaccttggtaatggcagacttgagtcctgtctcgtgcgttccaccgtccttggtgcgaacgttattgacaaaagatagaatgttatctgagaatccgtcattgtactggagggctacttccacttgaaaaccattgtcttccccttcaaagtaaagaactggcgtcaagatttccttatcttcgttgagataagaaacaaaatcttgtactccattctcatagtggaactcaatcgcttcatttgttcgcttgtccgttaaagacaaggtcacatttttcaagagaaaggctgattcattaaggcgctctgaaatggtattgtacttgaaatctgtcgtagaaaatatagtcgcgtcaggcataaaagtaactttggtgcctgttttagacttgggtgctgtaccgattttcttcaaagtcgtgacaggttttccaccattttcgaaacgttgcttgtaaactgcgccatcacgggtaatttcaacttctaaccagctagaaagggcgttaacaacggaagaacccactccgtgaagtccacctgatgtcttatagccaccttgaccgaatttccctccggcatgaagaatggtaaagataacctcaacagttggaattcccatagcgtgcatacctgtcggcatcccacgtccatggtcttgaaccgttagactaccgtctttattgatagttacatcaatacgatcaccaaacccagacaaggcttcatcgactgcattatcaacgatttcccaaactaggtgatgaagaccagcgccatcggtcgatccaatatacatccctggacgttttcggaccgcatccaacccttctagcacctgaatagcatcatcattataattgttaatattgatttccttttttgacacaaggaacctcctattcgttcatctttactattctacaggttttccaaggattttgcaaaatttttctttctccgatgtgacaatttcagcagagattctctgcttttctttcccaattcatgatataataggagtatgattacaatagttttattaatcctagcctatctgctgggttcgattccatctggtctctggattggacaagtattctttcaaatcaatctacgcgagcatggttctggtaacactggaacgaccaacaccttccgcattttaggtaagaaagctggtatggcaacctttgtgattgactttttcaaaggaaccctagcaacgctgcttccgattatttttcatctacaaggcgtttctcctctcatctttggacttttggctgttatcggccataccttccctatctttgcaggatttaaaggtggtaaggctgtcgcaaccagtgctggagtgattttcggatttgcgcctatcttctgtctctaccttgcgattatcttctttggagctctctatcttggcagtatgatttcactgtctagtgtcacagcatcgattgcggctgttatcggggttctgctctttccactttttggttttatcctgagtaactatgactctctcttcatcgctattatcttagcacttgctagtttgattatcattcgtcataaggacaatatagctcgtatcaaaaataaaactgaaaatttggtcccttggggattgaacctaacccatcaagatcctaaaaaataaaatgccagttctgtactgcccccaaacagttagacaaataatttatccaaaggatttagttctgtactgcacaggactaagtccttttagttttaccttaattcgtttgttgttgtagtaatcaatatagtctataatggcttgttccaattgattaagtgatttaaatgttttctcatagccataaaacatttcggattttaaaatgccaaagaaagattccatcctaccgttgtcttggctgttgcccttacgtgacatggatgcttgaattcccttactctctaggaaccgatgataagaatcgtgttggtattgccagccttggtcactatggagaatcgtattctcgtagtgcttctctgtgaatgcctgttccaa

SEQ ID NO: 38 - DNA, 18475 bp; double-stranded, linear
tattacaaataaaaaaacggaggagtgctttatgaaagcctatacttatgttaaaccaggacttgcttcttttgttgatgtagacaaaccagttattcgcaagccaacagacgctattgtgcgtattgtaaaaaccactatttgtggaacagacctccatattatcaaaggggatgttcctacttgccaaagtggtaccattcttggccacgaagggattgggattgttgaagaagttggggaaggagtttccaacttcaaaaaaggtgacaaggtcttgatttcttgcgtctgtgcctgtggtaaatgctactactgtaaaaaaggaatttatgctcactgtgaagacgaagggggctggattttcggtcacttgattgatggtatgcaggctgaatatctacgtgtccctcatgcagataatactctttaccatactccagaagacttgtcagatgaagctttggttatgctgtcagacattctgcctactggatatgaaattggtgtcttaaaagggaaagtagaacctggttgcagcgtagccattattggttcaggtccagttggattggctgctcttttaacagcccaattctattcaccagctaaattgattatggtagacctagacgataaccgcttggaaactgccctatcattcggtgcgactcataaggttaattcttcagaccctgaaaaagccattaaagaaatttatgatttgacagatggtcgtggtgtggatgtcgctatcgaagctgttggtattcctgcaacatttgatttctgtcaaaagattatcggtgtagacggaacggttgccaactgtggtgtgcatggtaaaccagttgaattcgatttagataaactttggattcgcaacatcaatgtaacaactggtttggtatctacaaatacgactccacaattgttgaaagcacttgaaagtcataagattgaaccggaaaaattggtaactcactatttcaaactcagtgaaattgaaaaagcctacgaagtcttcagtaaggcagcagaccaccatgccattaaggtcattatcgaaaacgatatctcagaagcctaagtagtaaaaatatttttgtacataagtaaatagaaattcagtcatccatcagatggctggattttttatcaaaaaattaagaaatgagcatatttctttccttgtctggcggaattggttataatatacggtacaaaggaatgaatgaatatgtatcgtgttatagaaatgtacggagattttgaaccgtggtggttcttagaaggttgggaagaagatattgtagcaagtagaaaatttgaccagtattatgatgctctcaaatactacaaaacttgctggtttagattggaacaagaatcgcctctttataaaagtagaagcgacttgatgaccattttttgggacccggaagaccaacgctggtgtgatgaatgtgatgagtatttacaacaataccattctttggctcttttgcaggatgagcaggttatcccagacgaaaaactacgctcaggctatgaaaaacaaaccagtcaggaaaggaatcgttcttgccgtatgaaattaaaatagagaaaagtaacttttttggagttgctttttttatttttctaactctttgcgaatagtataggtgaggaggtaagtatggttcaagaaattgcacaagaaatcattcgttcagctcggaaaaaagggacgcaggatatctattttgtccctaagttagacgcctatgagcttcatatgagggtaggagacgagcgctgtaaaattggtagctatgattttgaaaagtttgcagccgttatcagtcactttaagtttgtggcgggtatgaatgtgggagaaaaaagacgtagtcaactgggttcctgtgattatgcctatgaccataagatagcgtctctacgtttatctactgtaggcgattatcgggggcatgagagtttggttatccgtttgttgcacgatgaggagcaggacctgcatttttggtttcaggatattgaagaattaggcaagcagtacaggcaacggggactctatctttttgctggtccggttgggagtggtaagacgaccttgatgcatgaattgtccaagtcactctttaaaggacagcaagttatgtccatcgaagatcctgtcgaaatcaagcaggacgacatgcttcagttgcagttgaacgaagcaatcggcctaacctatgaaaatctaatcaaactttccttgcgtcatcgaccagatctcttgattatcggagaaattcgtgacagcgagacggcgcgtgcagtggtcagagctagtttgacaggtgcgacagtcttttcaaccattcacgccaagagtatccgaggtgtttatgagcgtctgctggagttgggtgtgagtgaagaagaattggcagttgttctgcaaggagtctgctaccagagattaatcgggggaggaggaatcgttgactttgcaagcagagattatcaagaacaccaagcagccaagtggaatgagcaaattgaccagcttcttaaagatggacatatcacaagtcttcaggctgagacggaaaaaattagctacagctaagcaaaaaaatatcatcaccctatttaacaatctcttttctagcggttttcatctggtggagactatctcctttttagataggagtgctttgttggacaagcagtgtgtgacccagatgcgtgtgggcttgtctcaggggaaatcattctcagaaatgatggaaagtttgggatgttcaagtgctattgtcactcagttatccctagctgaagttcatggcaatctccacctgagtttgggaaagatagaagaatatctggacaatctggctaaggtcaagaaaaaattgattgaagtagcgacctatcccttgattttgctgggttttcttctcttaattatgctggggctacggaattacctgctcccacaactggatagtagcaatattgccacccaaattatcggtaatctgccccaaatttttctaggcatggtagggcttgtttccgtgcttgcccttttagcactcactttttataaaagaagttctaagatgagtgtcttttctatcttagcacgccttccctttattggaatctttgtgcagacctacttgacagcctattatgcacgtgaatgggggaatatgatttcacagggaatggagttgacgcagatttttcaaatgatgcaggaacaaggttcccagctctttaaagaagtcggtcaagatctggctcaaaccctgaaaaatggccgtgaattttctcagacgataggaacctatcctttctttaggaaggaattgagtctcatcatagagtatggggaagttaagtccaagctgggtagtgagttggaaatctatgctgaaaaaacttgggaagccttttttacccgagtcaaccgcaccatgaatttggtgcagccactggtttttatctttgtggcactgattatcgttttactttatgcggcaatgctcatgcccatgtatcaaaatatggaggtaaatttttaaaatgaaaaaaatgatgacattcttgaaaaaagctaaggttaaagcttttacattggtggagatgttggtggtcttgctgattatcagcgtgcttttcttgctctttgtacctaatctgaccaagcaaaaagaagcagtcaatgacaaaggaaaagcagctgttgttaaggtggtggaaagccaggcagaactttatagcttagaaaagaatgaagatgctagcctaagaaagttacaagcagatggacgcatcacggaagaacaggctaaagcttataaagaatacaatgataaaaatggaggagcaaatcgtaaagtcaatgattaaggcctttaccatgctggaaagtctcttggttttgggacttgtgagtatccttgccttgggcttgtccggctctgtccagtccactttttcagcggtagaggaacagattttctttatggagtttgaagaactctatcgggaaacccaaaaacgcagtgtagccagtcagcaaaagactagtctgaacttagatgggcagacgcttagcaatggcagtcaaaagttgccagtccctaaaggaattcaggccccatcaggccaaagtattacatttgaccgagctgggggcaattcgtccctggctaaggttgaatttcagaccagtaaaggagcgattcgctatcaattatatctaggaaatggaaaaattaaacgcattaaggaaacaaaaaattagggcagtgattttactggaagcagtagtcgctctagctatctttgccagcattgcgaccctccttttgggacaaattcaaaaaaataggcaagaggaagcaaaaatcttgcaaaaggaagaagtcttgagggtagctaagatggccctgcagacggggcaaaatcaggtaagcatcaacggagttgagattcaggtattttctagtgaaaaaggattggaggtctaccatggttcagaacagttgttggcaatcaaagagccataaggtcaaggcttttaccttgttagaatccctgcttgccctcattgtcatcagtgggggattactcctttttcaagctatgagtcagctcctcatttcagaagttcgctaccagcaacaaagcgagcaaaaggagtggctcttgtttgtggaccaacttgaggtagaattagaccgttcgcagttcgaaaaagtagaaggcaatcgcctatacatgaagcaagatggcaaggacatcgccatcggtaagtcaaagtcagatgatttccgtaaaacgaatgctcgtggtcgaggttatcagcctatggtttatggactcaaatctgtacggattacagaggacaatcaactggttcgctttcatttccagttccaaaaaggcttagaaagggagttcatctatcgtgtggaaaaagaaaaaagttaaggcaggtgttctcctctacgcagtcaccatagcagccatctttagtcttttgttgcaattttatttgaaccgacaagtcgcccactatcaagactatgctttgaataaagaaaaattggttgcttttgctatggctaaacgaaccaaagataaggttgagcaagaaagtggggaacagttttttaatctaggtcaggtaagctatcaaaacaagaaaactggcttagtgacgagggttcgtacggataagagccaatatgagtttctgtttccttcagtcaaaatcaaagaagagaaaagagataaaaaggaagaggtagcgaccgattcaagcgaaaaagtggagaagaaaaaatcagaagagaagcctgaaaagaaagagaattcatagtcaattcaactataatgcgttgaatccagaatagtccactgtagtttctagaaaattgctggaaatggatgttaagctccaattcatttgtttatatcttatttcagtttactatactttgtgctaaattaaagatatgaaacatgattttaaccacaaagcagaaactttcgattcccctaaaaatatcttcctcgcaaacttggtatgtcaagcagccgagaaacagattgatcttctatcagacaaagaaattttagatttcggtggtggcacgggtctattagccttgcccctaacccctagccaagcaggctaagtcagtcactcttgtagacatttctgagaaaatgttggagcaagctcgtttgaaagtggagcagcaagcaatcaagaatatccagtttttggagcaagatttaccgaaaaatcccttggagaaagagtttgattgccttgctgttagtcgggttcttcatcatatgcctgatttggatgcggctctctcactgtttcatcaacatttgaaggaagatgggaaactcatcattgctgattttaccaagacagaagctaatcatcatggatttgatttagctgaactggaaaacaagctaattgagcatggtttttcatctgtgcatagtcagattctctatagtgctgaagacctgtttcaaggaaatcactcagaattctttttaatagtagcccaaaaatcactcgcctagtcagggagtgatttttctataaggatggaaaaaagaagggaaatttggtaagataggaatatggattttgaaaaaattgaacaagcttatacctatttactagagaatgtccaagtcatccaaagtgatttggcgaccaacttttatgacgccttggtggagcaaaatagcatctatctggatggtgaaactgagctaaaccaggtcaaggagaacaatcaaacccttaagcgtttagcactacgcaaagaagaatggctcaagacctaccagtttctcttgatgaaggctgggcaaacagaacccttgcaggccaatcaccagtttacaccggatgctattgctttgcttttggtgtttattgtggaagagttgtttaaagaggaggaaattactatcctcgaaatgggttctgggatgggaattctaggcgctattttcttgacctcgcttactaaaaaggtggattacttgggaatggaagtggatgatttgctgattgatctggcagctagcatggcagatgtaattggtttgcaggctggctttgtccaaggagatgccgttcgcccacaaatgctcaaagaaagcgatgtggtcatcagtgacttgcctgtcggctattatcctgatgatgccgttgcgtcgcgccatcaagttgcttctagccaagaacatacttacgcccatcacttgctcatggaacaagggcttaagtacctcaagtcagacggatacgctatttttctagctccgagtgatttgttgaccagtcctcaaagtgatttgttaaaagaatggctgaaagaagaggcgagtctggttgctatgattagtctgcctgaaaatctctttgctaatgccaaacaatctaagactatttttatcttacagaagaaaaatgaaatagcagtagagccttttgtttatccacttgctagcttgcaagatgcaagtgttttaatgaaatttaaagaaaattttcaaaaatggactcaaggtactgaaatataaaatagattttgttataatagttgaaaacgcttaaaaaggggtatcatgttatgacaaaaacaattgcaatcaatgcaggaagttcaagtttgaaatggcaattatacttaatgccagaagaaaaagtattggcgaaaggtttgattgaacgtatcggtttgaaagattcaatttcaactgtaaaatttgacggccgttctgaacaacaaattttggatattgaaaatcatatacaagccgttaaaattttattggatgacttgattcgtttcgatattatcaaggcttatgacgagattacaggtgttggacatcgtgttgttgctggtggagaatatttcaaagaatcaacagttgttgagggagatgttttagaaaaagttgaagagttgagtttgttggctcctctacacaacccggccaatgcagcaggtgttcgtgccttcaaggaattgttgccagacattaccagtgtagttgtttttgatacttccttccacacaagtatgccagagaaagcttatcgctaccctctaccaacaaaatattacacagaaaacaaggttcgtaaatacggtgctcatggtacaagtcaccagtttgtagcaggagaagctgcaaaactcttgggacgtccattagaagacttgaagttaattacctgtcatattggtaacggaggctcaattacagctgtgaaagccggcaaatctgtagacacttctatggggttcactcctcttggtggtattatgatgggaacgcgtacaggggatattgatccagctatcattccttatttaatgcaatatacagaggattttaacacaccagaagatatcagtcgtgttcttaaccgtgaatcaggtcttttgggagtttctgctaattctagcgatatgcgcgatatagaagcagctgtagcagaagggaatcacgaggctagcttggcttatgaaatgtatgttgaccgtatccaaaaacatatcggtcagtaccttgcagtgctaaatggagcagatgccattgttttcacagcaggtgtcggtgaaaatgcagagagtttccgtcgtgatgtaatctcagggatttcgtggtttggttgtgatgttgatgatgaaaagaatgtctttggcgttacaggagacatctcaacagaggcagctaaaatccgtgtcttggttattccaacagatgaagaattagtcattgcccgtgacgttgaacgcttgaaaaaataagtgaaactaaaaaaatattcaatacaaggagttgggaaagttatttttccagcttctttttctgatgaaattgtccaaaaccttgctatgattggcttttttgaaaaatatggtataatagtagtaatttaatagatggagttgagttttgaagaaaaactttcgtgtaaaaagagagaaagattttaaggcgattttcaaggaggggacaagttttgctaatcgcaaatttgtggtctaccaattagaaaaccagaaaaaccgttttcgagtaggtctatcagttagcaaaaaactggggaatgccgtcactagaaatcaaattaagcgacggattcggcatattatccagaatgcaaaagggagtctggtagaagatgtcgactttgttgtcattgctcgaaaaggagtcgaaaccttgggatacgcagagatggagaaaaatctactccatgtattaaaattatcaaagatttaccgggaaggaaatgggagtgaaaaagaaactaaagttgactagtttgctaggactgtctctgttaatcatgacagcctgtgcgactaatggggtaactagcgatattacagccgaatcggctgatttttggagtaaattggtttacttctttgcggaaatcattcgctttttatcgtttgatattagtatcggagtggggattattctctttacggtcttgattcgtacagtcctcttgccagtctttcaggtgcaaatggtggcttctaggaaaatgcaggaagctcagccacgcattaaggcgcttcgagaacaatatccaggtcgagatatggaaagcagaaccaaactagagcaggaaatgcgtaaagtatttaaagaaatgggtgtcagacagtcagactctctttggccgattttgattcagatgccggttattttggccctgttccaagccctatcaagagttgactttttaaagacaggtcatttcttatggattaaccttggtagtgtggatacaacccttgttcttccgattttagcagcagtattcacctttttaagtacttggttgtccaacaaagctttgtctgagcgaaatggcgctacgactgcgatgatgtatgggattccagtcttgatttttatctttgcagtttatgcgccaggtggagtcgccctatactggacagtgtctaatgcttatcaagtcttgcaaacctatttcttgaataatccattcaagattatcgcagagcgcgaggccgtagtacaggcacaaaaagatttggaaaatagaaaaagaaaagccaagaaaaaggctcagaaaacgaaataaataaggaggaatctggtagtggtagtatttacaggttcaactgttgaagaagcaatccagaaaggattgaaagaattagatattccaagaatgaaggctcatatcaaagtcatttctagggagaaaaaaggctttcttggtctatttggtaaaaaaccagcccaagtggatattgaagcgattagtgaaacgactgttgtcaaagcaaatcaacaggtagtaaaaggcgttccgaaaaaaatcaatgatttgaacgagcctgtgaagacggttagtgaagaaaccgttgaccttggtcatgtggttgatgctattaaaaaaatagaggaagaaggtcaaggtatttctgatgaagtcaaggctgaaatcttaaaacatgaaagacatgccagcactatcttagaagaaactggtcacattgagattttaaatgaacttcaaatcgaggaagcgatgagggaagaagcaggcgctgatgaccttgaaactgagcaagaccaagctgaaagtcaagaactagaagacttgggcttgaaagttgaaacgaactttgatattgaacaagtagctacggaagtaatggcttatgttcaaacgattattgatgacatggatgttgaggctacactttcaaatgattataaccgtcgtagcatcaatctacaaattgacaccaacgaaccaggtcgtattatcggctaccatggtaaagtcttgaaggccttgcaactgttggctcaaaattatctttacaaccgctattccagaaccttctacgttacaatcaatgtcaatgattatgtcgaacaccgtgcagaagtcttgcagacctatgcgcaaaaattggcgactcgtgttttggaagaagggcgcagtcataaaacagatccaatgtcaaatagcgaacgcaagattatccatcgtattatttcacgtatggatggcgtgactagttactctgaaggtgatgagccaaatcgctatgttgttgtagatacagaataagtaaaatcaggtttatcctgattttttgctagttagaggaggttaaactgatgttgaataagataagagactatttagactttgctggtttgcagtaccgtaatcctgataaagcgggagcagagcgagagaagatgctggcattccgccacaaaggacaagaggcccgaaaggtttttacagaactggccaaagcctttcaagcaagccatccagaatggcaactccaacagactagccagtggatgaatcaggcccagcgtttgagaccacatttttgggtttatctacagagagacggacaagtgacagaacctatgatggccttacgtttgtatgggacatctactgactttggaatttctttggaagtcagtttcatcgaacgtaagaaggatgagcaaacactgggcaagcaggccaaagttttagacattccaaccgttaaagggatttattatctaacctactctaatggtcaaagtcaacggtgggaggcgaatgaagaaaagcgtcgtactttacgcgagaaggtgagaagtcaagaagttcgaaaagttttagtgaaggtagatgttcctatgacagaaaattcgtctgaagaagaaatcgtagaaggcttattgaagtcttattctaaaattcttccctattatctagctacgagaaaataagataatttgtaaaacatcataaatcatacagtccaagagtgaacagtccgctgtgtaattcttggtctttttgtttgcgctttcgcattatataataaacttacaaaaacaattcaaaaggagaacaattatggaagtcgtttcaagtgttctaaattggttttctagcaatattttgcagaatcccgcatttttcgtaggtttattggtgttgataggatatgcacttttgaaaaaacctgcccatgacgttttttcagggtttgttaaagcaacagtagggtatatgttgcttaacgtgggtgctggtggtttggttacaacctttcgtccaatcttagcagctcttaactacaaattccaaattggtgcagcggttatcgacccttactttggacttgctgcagcaaacaacaaaattgtagcagagtttccagattttgttggaactgcaactacagctctattgattggttttggaataaatatcttgctcgtagctcttcgaaagattacgaaggtaagaaccctctttattactggtcacatcatggtacaacaagctgcaacagtatctcttatggttctattcttagtaccacaattgcgcaatgcttacggtacagcagcgattggtatcatctgtggactttactgggcagttagttcaaatatgactgttgaggcaactcaacgcttgactggtggtggcggatttgcgattggtcaccaacagcaatttgcaatctggtttgtagataaagtagcaggacgctttggtaagaaagaagaaagtttagacaatcttaaattacctaagttcctctcaatcttccacgatacagttgttgcatctgctaccttgatgctcgtattcttcggagccattcttttaatcttgggtccagacattatgtctaataaagaagtcatcacttcaggaactctattcaatcctgctaaacaagatttctttatgtacattatccaaacagcctttaccttctcagtttacttgttcgttttgatgcaaggtgtccgaatgttcgtatctgagttgacaaacgccttccaaggtatttcaaacaaattgttgccaggttcattcccagcggttgacgttgcagcttcttatggatttggttctccaaatgctgtcttgtcaggatttacctttggtttgattggtcaattgattacaattgttttgctcatcgtctttaaaaatccgattcttattattacaggatttgtaccagtgttctttgacaatgcagccattgcggtctacgctgataaacgcggcggatggaaagcggctgttatcctttcctttatatcaggtgtccttcaagttgctctaggagctctttgtgtggcccttctcgatttggcatcttatggtggctaccatggaaatatcgactttgaattcccatggcttggatttggatatatcttcaaataccttggtattgttggttatgtacttgtgtgtctcttcttgcttgttattcctcaacttcaatttgccaaagcaaaagataaagagaaatattacaacggtgaagttcaagaagaagcttagtatctagaaaaggagaaataaaatggttaaagtattagcagcgtgcggaaatggaatgggttcatcaatggttatcaagatgaaggttgaaaatgctctccgtaagcttaatcaaacagattttacagtcaattcatgcagtgtcggtgaagctaaaggtttagcagtaggatatgacatcgtaatcgcttctcttcatttgattcaagaattggaagggcgaactaatgggaagttaattgggcttgataacttgatggatgataaagaaatcaccgaaaaactcagtcaagcactacagtaaaaggttggagggggctggacagaaactgagagttatcgtttctgtccttctccctctttaaataaaggaggcagatatgaatttaaaacaagctttaattgacaatgactcgatccgactaggtttagaggctaacaattggaaagaagcagtcaaggtagcagtagatcccttaattgaaagtggggcaattttgccagagtattacgatgctatcattgaatcgactgaagagtatgggccttactatatcttgatgccaggtatggctatgccccacgctagacctgaagcaggtgtgcaaagtgatgccttttcattgattaccttacaaaatcctgttgtattttcagatgggaaagaggtatctgttttgttggcactagcagcaacaagttcaaaaattcacacaagtgtagccattccacaaattattgccctatttgaattagaagattctattgcacgtttacaggcttgccagactaaagaagatgtcttggctatgattgaagaatctaaggatagcccttatctcgaaggattggatttggaaagttagaaagaggaataaagaaatgacaaaaagaatacctaatttacaagttgcattagaccattcagacttgcaaggagcgattaaagcagctgtttctgttggtcaggaagtagatattatcgaagctggaactgtttgcttgcttcaagttggaagtgaactggctgaagtcttgcgtagccttttcccagataagattattgtggcagacacaaaatgtgctgatgctggtggaacagttgctaaaaataatgcggttcgtggagcagactggatgacttgtatctgttgtgcaaccatccctactatggaagcagctctaaaggctatcaagactgaacgaggagaacgaggcgaaatccagatcgagctttatggcgattggacttttgaacaagctcagctttggctagatgcaggtatctcacaagctatttatcaccaatctcgtgatgctcttcttgctggtgaaacttggggtgaaaaagaccttaataaggttaaaaaactcattgacatgggcttccgtgtatctgtaacaggtggtctagatgtagatactctcaaactctttgaaggtattgatgtctttacctttatcgcaggtcgtggaattacagaggctgtggatccagcaggagcagcgcgtgccttcaaggatgaaatcaaacgaatttgggggtaaatcatggtacgtccaattggaatttatgaaaaggcaaccccaacacactgtacttggctagaacgtttaaattttgccaaggagttaggctttgattttgtcgagatgtctattgacgaacgtgacgagcgtttagcaagacttgactggagtaaggaagaacgcttggaagttgtcaaagcaatctatgaaactggtgttcgtattccttctatctgtttttcaggccatcgtcgctacccattgggttcaaaagatccagttctagaggaaaaatctctagaactcatgaaaaaatgtatcgaattagctcaagacttgggagttcgtacgattcaattagctggttacgatgtttactatgaggaaaagtcaccccagacacgccaacgttttatcaaaaatttgagaaaagcctgtgactgggctgaagaagctcaggtggtacttgctattgaaattatggatgatcctttcatcagtagcatcgaaaaatatttggctatagaaaaagagattgactctcccttcctctttgtatatccagatattggtaatgtgtctgcatggcataatgatatctatagtgagttttatcttggtcatcatgccatcgcagctctccatctcaaggatacttatgcagtgacagaaagttcaaagggccagttccgagatgtacctttcgggcaaggttgtgtcaaatgggaagaagctttcgatattttaaaggaaaccaattataatggacctttcctaatcgaaatgtggtctgaaaattgtgaaacagtagaagaaacacgcgcagccattcaagaggcgcaagcttttctctatccactcattaagaaagcaggtttgatgtaagatgaatcaagtaatcaatgctatgcgtaaacgagtctgtgatgccaatcaatcattgccaaaacatggacttgtcaaatttacctgggggaatgtatctgaagttaatcgcgaactcggtgtcattgttatcaaaccatcaggcgtggattatgacgaattgacacctgaaaacatggtagtgactgatctagatggtaagatcctagaaggggatttaagaccatcttccgacctcccaactcatgtgcaattatataagacttggtcagaaattggtagtgtggttcacacccattcgacagaagctgttggttgggctcaggcaggtcgtgatattcctttctacggaacaacccatgcagattatttctacggttcaatcccttgcgcccgtagtttgaccaaggacgaagtagaagtggcctatgaaaaagatactggcctggttatcgtagaagagtttgaacatcgcggacttaacccggttgaagtaccaggaattgttgtacgcaatcacggtccattcacctggggcaaaaatccagagaatgctgtttatcactctgtcgtactagaggaagtatcaaagatgaatcgctttacagaacaaatcaatccaagagttggacctgctccccagtacatactagaaaaacactaccaacgtaaacatggaccaaatgcttattatggtcaaaagtaagaacgatgaaggaggagaaaaagataaatttagctcctctttttacatttgatttttattgagagtaaagttggagttgaagtaattttaaaagattttttagaaatagcgcttgatatatatatggtaaaataaaaagaattgctgtgatatcaatagatttgggggattttttaatatggtactggataaggcaagttgtgatttgcttcaatatttgatggatcaagaaacgtccaaaacgattatggcgatttcgaaagatttgaaagagtcaagaaggaaaatttattatcacattgacaaaatcaatgctgctctgggtgacgaggcgcttcacatcattagtattccacgaattggtattcacttaacggaagagcagagagatgcttgttgtaaactattatcggaagtagattcgtacgattatatcatgagtgcgcatgaacgtatgatgataatgttactatggataggtatttctaaagaacgtattacgattgaaaaattgatagagttaacagaggtatctaggaatactgttctcaatgatttgaatagtattcgttatcaactaactttggaacaatatcaggtgatcttgcaagtgagcaagtcacagggatacaaccttcatgcccaccctcttaataaaattcagtatcttcaatcgcttctatatcatatttttatggaagaaaatgccacttttgtatctattttagaagataagatgaaagagaggttagatgatgagtgtttgctttctgttgaaatgaaccaattttttaaggaacaggttcctttagttgaacaagatttagggaagaaaataaaccatcatgaaataacttttatgttgcaggttctaccttatttgctgttaagctgtcataatgttgaacagtatcaagaaagacatcaggatatagagaaagaattttctttgataagaaaaagaatagagtatcaggtgtctaagaaattaggagaacggttgtttcaaaagtttgaaatttctttgtcaggacttgaagtttctcttgtagctgttctcctcctctcctatcgtaaagatttggatattcatgcagaaagtgatgattttcggcaattaaaacttgctttagaagaatttatctggtattttgaatcacaaatccgaatggagattgagaacaaggatgatttgttacgaaatttgatgatccactgtaaagccttgttatttagaaagacttacggtattttttctaaaaatcctctaacaaaacaaattcgatccaagtatggagaattatttttagtcactagaaaatctgcggaaattttagaaggagcatggtttattcggctaacagacgatgatattgcctatttgacgattcatattggaggatttttaaaatatacaccatcatctcaaaaaaatatgaaaaaagtttatctcgtttgtgatgaaggtgttgcggtttcgagacttttgctgaaacaatgcaaactttattttccaaatgagcaaattgacactgtatttacaacagaacaatttaagagtgtggaagatattgcacaagttgatgtagtgattactactaatgatgatttggatagcagatttccgattttaagggttaatcctatccttgaagcagaagatattttgaaaatgctagactatcttaaacacaatatatttcgtaataagagcaaaagtttcagtgaaaatctttctagtcttatttcgtcttatattgtagacagcaagttggctagtaagttccaagaagaggttcaaacacttataaatcaagaaatagtagttcaagcttttttggaagrtatttgaaggacagtccaatgatgaacacaaacctgtgtktttcstggtcttttttagtgttttgaagggtggkatactaatctcaaagataacaattatatccaaaggaggcaacatatgccaaacgtcaaagaaattacaagagagtcatggattttagccactttcccagagtggggaacatggttgaacgaagaaatcgaagaagaagtcgtacctgaaggcaactttgccatgtggtggctaggcaactgtggtacttggattaagacaccagctggtgctaacgttgtcatggacctttggtcaaaccgtggaaaatcaaccaaaaaagtgaaagatatggttcgtgggcaccaaatggcaaatatggcaggtgttcgtaagctgcaaccaaacttgcgtgttcagccaatggttatcgatccatttgctatcaacgaactagactattacttagtttcacacttccacagtgatcatatcgacccatacacagctgcagcaattctcaataatcctaagttagagcatgttaagttgg

SEQ ID NO: 39 - DNA, 7186 bp; double-stranded, linear
ccaggatttggtaccgttgcaagtggtgtgcctttcctcctaaaggaaaatggaggaaaaatcaatcaatcagcacattcagatatcaaagttgctaaggtattggtcaaggatgaagatgaaaaaaatcgcttgcttgcagcagggaatgactttaactttgtaaccaatgtggatgatattttatcagaccaggatattactatcgtagtggaattgatggggcgtattgagcctgctaaaacctttatcactcgtgccttggaagctggaaaacacgttgttactgctaacaaggaccttttagctgtccatggcgcagaattgctagaaatcgctcaagctaacaaggtagcactttactacgaagcagcagttgctggtgggattccaattcttcgtactttagcaaattccttggcttctgataaaattacgcgcgtgcttggagtagtcaacggaacttccaacttcatggtgaccaagatggtggaagaaggctggtcttacgatgatgctcttgcggaagcacaacgtctaggatttgcagaaagcgatccgacgaatgacgtagatgggattgatgcagcctacaagatggttattttgagccaatttgcctttggcatgaagattgcctttgatgatgtagcccacaagggaatccgcaatatcacaccagaagacgtagctgtagctcaagagcttggttacgtagtgaaattggttggttctattgaggaaacttcttcaggtattgctgcagaagtgactccaaccttcctacctaaagcgcacccacttgctagtgtgaatggcgtaatgaacgctgtctttgtagaatctatcggtattggtgagtctatgtactacggaccaggtgcgggtcaaaaaccaactgcaacaagtgttgtagctgatattgtccgtatcgttcgtcgtttgaatgatggtactattggcaaagacttcaacgaatatagccgtgacttggtcttggcaaatcctgaagatgtcaaagcaaactactatttctcaatcttggctctagactcaaaaggtcaggtcttgaagttggctgaaatcttcaatgctcaagatatttcctttaagcaaatccttcaagatggcaaagagggtgacaaggcgcgtgtcgttatcatcacacacaagattaataaagcccagcttgaaaatgtctcagctgaattgaagaaggtttcagaattcgacctcttgaataccttcaaggtgctaggagaataagatgaagattattgtacctgcaaccagtgccaatatcgggccaggttttgactcggtcggtgtagctgtaaccaagtatcttcaaattgaggtctgcgaagaacgagatgagtggctgattgaacaccagattggcaaatggattccacatgacgagcgtaatctcttgctcaaaatcgctttgcaaattgtaccagacttgcaaccaagacgcttgaaaatgaccagtgatgtccctttggcgcgcggtttgggttcttccagctcggttatcgttgctgggattgaactagccaaccaactgggtcaactcaacttatcagaccatgaaaaattgcagttagcgaccaagattgaagggcatcctgacaatgtggctccagccatttatggtaatctcgttattgcaagttctgttgaagggcaagtctctgctatcgtagcagactttccagagtgtgattttctagcttacattccaaactatgaattacgtactcgcgacagccgtagtgtcttgcctaaaaaattgtcttataaggaagctgttgctgcaagttctatcgccaatgtagcggttgctgccttgttggcaggagacatggtgaccgctgggcaagcaatcgagggagacctcttccatgagcgctatcgtcaggacttggtaagagaatttgcgatgattaagcaagtgaccaaagaaaatggggcctatgcaacctacctttctggtgctgggccgacagttatggttctggcttctcatgacaagatgccaacaattaaggcagaattggaaaagcaacctttcaaaggaaaactgcatgacttgagagttgatacccaaggtgtccgtgtagaagcaaaataaagaatagaagataggatggggaaactcttgaccagaggggttcatatcctttttgtgaaaagaagtttatactcaatgaaaatcaaagagcaaactaggaagctagccgcaggctgctcaaaacagtgttttgaggttgcagatagaactgacgaagtcagctcaagacactgttttgaggttgcagatagaactgacgaagtcagtaaccatactacggtaaggtgacgctgacgtggtttgaagagattttcgaagagtattagttaaaaacgtgataaaggagaaataaagatggcagaaatttatctagcaggtggttgtttttggggcctagaggaatatttttcacgcatttctggagtgctagaaaccagtgttggctacgctaatggtcaagtcgaaacgaccaattaccagttgctcaaggaaacagaccatgcagaaacggtccaagtgatttacgatgagaaggaagtgtcactcagagagattttactttattatttccgagttatcgatcctctatctatcaatcaacaagggaatgaccgtggtcgccaatatcgaactgggatttattatcaggatgaagcagatttgccagctatctacacagtggtgcaggagcaggaacgcatgctgggtcgaaagattgcagtagaagtggagcaattacgccactacattctggctgaagactaccaccaagactatctcaggaagaatccttcaggttactgtcatatcgatgtgaccgatgctgataagccattgattgatgcagcaaactatgaaaagcctagtcaagaggtgttgaaggccagtctatctgaagagtcttatcgtgtcacacaagaagctgctacagaggctccatttaccaatgcctatgaccaaacctttgaagaggggatttatgtagatattacgacaggtgagccactcttttttgccaaggataagtttgcttcaggttgtggttggccaagttttagccgtccgatttccaaagagttgattcattattacaaggatctgagccatggaatggagcgaattgaagttcgttctcgttcaggcagtgctcacttgggtcatgttttcacagatggaccgcgggagttaggcggcctccgttactgtatcaattctgcttctttacgctttgtggccaaggatgagatggaaaaagcaggatatggctatctattgccttacttaaacaaataaaacagagagtggggcttcccactttcttcatttctagaatatgaatagaagggatttatgaaacacctattatcttacttcaaaccctacatcaaggaatcaattttagcccccttgttcaagctgttagaagctgtttttgagctcttggttcccatggtgattgctgggattgttgaccaatctttacctcagggagatcaaggtcatctctggatgcagattggcctgctccttatctttgcagtaattggcgttttagtggccttgatagctcaattttactcagcaaaggcagcagtaggttctgctaaggaattgacaaacgatctttatcgtcatattctttccttgcccaaggacagcagagaccgtctgacaacttctagtttggtcactcgcttgacttcggatacctaccagattcagactggtatcaatcaattcctgcgtctctttttacgagcgcccattatcgtttttggtgccatttttatggcttatcgaatctcagctgagttgactttctggttcttagtcttggttgccattttgaccattgtcattgtagggttatctcgattggtcaatcctttctacagtagtctcagaaagaaaacggaccaactggttcaggaaacgcgccagcaattgcaagggatgcgggttattcgtgcttttggtcaagaaaaacgagagttacagatttttcaaacccttaaccaagtttatgctagattacaagaaaagacaggtttctggtctagtttattaacacctctgacctatctgattgtcaatggaactcttctcgttattatctggcaaggctatatttcaattcaaggaggagtgctcagtcaaggtgctctcattgctcttatcaattacctcttacagattttggtggaattggtcaagctagccatgttgatcaattccctcaaccagtcctatatctcagtcaagcgaatcgaggaagtctttgttgaggctccagaggatatccattcagagttagaacaaaagcaagctaccagagataaggttttacaagtccaagaattgacctttacctatcctgatgcggcccagccttctctgagatacatttcctttgatatgactcaaggacaaattctaggtatcatcgggggaactggttctggtaaatcaagcttggtgcaactcttacttggactttatccagtagacaaggggaacattgacctttatcaaaatggacgtagtcctcttaatttggagcagtggcggtcttggattgcctatgtacctcaaaaggtcgaactctttaaaggaaccattcgttccaacttgactctaggtttcaatcaagaagtatctgaccaggaactctggcaggccttggagattgcgcaagctaaggattttgtcagtgaaaaggaaggactcttggatgctctagttgaggcaggggggcgaaatttctcaggtggacaaaaacaaagattgtctatcgcccgagcagtcttgcgccaggctccgtttctcatcctagatgatgcaacctcggcactggataccattacagagtccaagctcttgaaagctattagagaaaattttccaaacacgagcttaattttgatctctcaacgaacctcaactttacagatggcggaccagattctcctcttggaaaaaggtgagttgctagctgttggcaagcacgatgacttgatgaaatccagccaagtctattgtgaaatcaatgcatcccaacatggaaaggaggactagaatgaaacgacaaactgtaaaccagacgctcaaacgtttagccgtagatttagcaagccatcctttcctccttttcctagcctttctaggaactattgcccaagttggcttatcaatttacctacctattctgattgggcaggtcattgaccaagtcctagtggctggttcatcaccagttttttggcagatttttctccagatgctcttggtggtaataggaaatactctggtacaatgggccaatcctctcctctataatcgtctaatcttctcttataccagagatttacgggagcgaatcatccataagctccatcgtttaccgattgcctttgtagataggcaaggtagtggagagatggttagtcgtgtaaccacggacatcgaacagttggcagctggcttgaccatgatttttaaccaatttttcattggtgttttgatgattttggtcagtattctagccatgctccaaattcatctcctcatgactctcttagtcttgctgttgacgccactgtccatggtgatttcacgctttattgccaagaaatcctatcatctcttccagaagcaaacagagacgaggggaattcagactcagttgattgaagaatcgcttagtcagcagactataatccagtccttcaatgctcaaacagaatttatccaaagattgcgtgaggctcatgacaactactcaggctattctcagtcagccatcttttattcttcaacggtcaatccttcgactcgctttgtaaatgcactcatttatgcccttttagctggagtaggagcttatcgtatcatgatgggttcagccttgaccgtcggtcgtttagtgacttttttgaactatgttcagcaatacaccaagccctttaacgatatttcttcagtgctagctgagttgcaaagtgctctggcttgcgtagagcgtatctatggagtcttagatagccctgaagtggctgaaacaggtaaggaagtcttgacgaccagtgaccaagttaagggagctatttcctttaaacatgtctcttttggctaccatcctgaaaaaattttgattaaggacttgtctatcgatattccagctggtagtaaggtagccatcgttggtccgacaggtgctggaaaatcaactcttatcaatctccttatgcgtttttatcccattagctcgggagatatcttgctggatgggcaatccatttatgattatacacgagtatcattgagacagcagtttggtatggtgcttcaagaaacctggctcacacaagggaccattcatgataatattgcctttggcaatcctgaagccagtcgagagcaagtaattgctgctgccaaagcagctaatgcagactttttcatccaacagttgccacagggatacgataccaagttggaaaatgctggagaatctctctctgtcggccaagctcagctcttgaccatagcccgagtctttctggctattccaaagattcttatcttagacgaggcaacttcttccattgatacacggacagaagtgctggtacaggatgcctttgcaaaactcatgaagggccgcacaagtttcatcattgctcaccgtttgtcaaccattcaggatgcggatttaattcttgtcttagtagatggtgatattgttgaatatggtaaccatcaagaactcatggatagaaagggtaagtattaccaaatgcaaaaagctgcggcttttagttctgaataagccattctcttttgaaagtttatggacgaaaaaagttgccttcgagtgacttttttgttacaatagctagaaaaattgttcactgtaatactcaatgaaaatcaaagagcaaactaggaagctagccgtaggttgctcaaagcacagctttgaggttgtagataagactgacgaagtcagttcaaaacactgttttgaggttgcagatagaactgacgaagtcagctcaaaacactgttttgaggttgcagatagaactgacgaagtcagctcaaaacagg

SEQ ID NO: 40 - DNA, 14273 bp; double-stranded, linear
ctgaaaattctaaaaaatttataagtaaggaattaattagttatttttgtgataaagtttatgatgaaatatttgttgaagaggtagttccgcacgtttttctgccatatgaatctgacttacttcttattttaccagctacggcaaatgtgattggcaaaattgctaatggtattgctgatgatttagttacagcaactgttttaaactttaataaaaaaataattttttgtcccaatatgaactctactatgtgggacaatcacatagttcaaagaaatgtatcaattctaaaggagttgggacatatatttttatttgagtctaaaaaaacatatgaggtaggattgcgtaaagcaatagattcaacatgttcaatgttacaaccacagtcgttagtaaaagaacttatcaaattagaaaatattgtccttgaagagggacattaaaaactactgagaatattaatgaggggaaaaaatggaaaattcatcaatcgatgtagatatgctgttggaagaattgacacaagaagcaatggtcgttgttgctgttgataaggactgttaatttaaacttatggcaatatatgaaaggttactggatgttttaaattatgcaggcagtagccttttattatatacaaatggataaagtaaggataatacaatgattaataaaaaaatacaacaagttgttttggaatcattacagaattttttgaatgggaacttcatttcgccttgtgtagtctatgattttggcttgctggaaactgtacttgatgaatttaaaaatcaaattcctgtaacattcaattaccaacttttttatgccgttaaagcaaattcaaatgagaagatacttgaattcttagtagataaaattgatggagttgatgtggcgtcattatctgaattagatgtggctaaaaaatttttcccaccaactcaaatttctgttaatggtcccgcattttcttatgaaactttatataatctgattaaaaaacaatataaagttgatattaactttttggaacatcttcaacaattttccccaaaagaatctgttggaataagagtaacggagccagatgaacttaataatcgtatgagtcgatttggaataaatatttgcagtgataattggactagtaatttacaaaatcctttaattacacgactgcattttcattttggagaaaaagatgataaatttattgttaagttagataaaatattatttaagttacaagaaattaataaacttagagaggttagagaaataaatcttggaggcggttttatgaaattatttatggaaaatcgtttgaaagaattttttctatcacttatggaaatctataaaaagtacgatattgatagtactgtgactacaataatagaaccaggtagtgcaattacttcattttctgcctatatgattactagcccagttaatgttagtgaggtgaatgagcagcaggttatcacgttagacacatcaatatacaccaatacattatggtttgttccgcatattattacaacgttaaattcaagtagtaaagagcgttatagtactattctctatggtaatacctgttatgaacatgacaagtataaaatgaaagtttcgcttccaaggttaactcaaaatagcagtatagtgttttttcctgtaggagcttatataaaaagcaatcattcaaatttacatcgtaatgattttatgcgggaggtatatttgtggacaaaaaacttgacatattagataaagttaaggaatatttaggaaataaaactactcaaattctggataatcaatataaagaatttttgaaacttaatgatataaggcgagcgtttggtatttcagaaaaagtattaaacaattcttttaattttacgagtaaagaatttaatgatttaattaataacgaaaattatttattcgaatatgcatgtagaattagagaggaatggagaaaaaaatgctttaatcattcttatcgttttctatgctcacctataattacagatgattttcttaacacgaagacattgagaagtagccaaattgaatataaatatgagcgatatttatcgaaaagttcgataggcgatagagcggttgatggctttgtttccttcaatactttaacagctaatggtatgtctgctattaaactatgtcttgagatattaaactctattttcttcaagaagaagattgatttattatattcaaccggatattatgaaacaagatttttattaaataatcttgctaaatcaggtattagttgctatgaggtaagtaattgtgaattggataaagataaattttataatgtattcatgatggaacccaatcgagccgatttaacattacaaaaaactgatttcaagatagtagaatattttgttaagtataaaaataattcaataaaagtcgttattttagatatttcatatcaaggttctaattttaaattagtagaatttttagagaaatttaaatttgcgaatgtaattatttttgtggtacgatctttgataaaattagatcaaatgggattagaattgacaaatgggggaataatagaagtgtttattcctaatcatttgagaaagttgaaaaattttattgaagaggaattcaataaatttagaaattctcacggagctaatctaagcctctatgaatactgtttgcttgataattctttaactttaaaaaatgattggaactattctgatttagttatgaaatttacgagtaatttttatgctgatataaaagacttgttcatggaaaattctgatattgaaatcatccatgaagagggagtaccttttgtatttttagatttaataggtgaaggtaaaaaagaatatgaaatgttttttcaatggttaaacttcttttacaaacagcttggaatcacattgtatgctagaaatagttttgggtttcggaatctaacagtagagtattttggaattattgggacagaaagatatatatttaagatttgtccaggtgtttataaagggttaagttattatttgatgaaatttttattaaaatctttttcaaatgaatatttaaaaactactgatgaggttaatagatgaaaaatttgataaagttgctaataattagattgattgttaacttagcagacagtgtattttatatagtagcattgtggcacgttagcaataattattcttcgagcatgttcttaggaatatttattgcagtaaattatctaccggatttgttactaatcttttttggaccagttattgacagagtaaatccgcaaaaaattcttataatatcaattttggttcaattagcagtggctgtaatatttttattattattaaaccaaatatcattttgggtgataatgagtctagtgtttatttcagtaatggctagctccataagttacgtgatagaagatgtgttgattcctcaagtggtagaatatgataagattgtatttgcaaattctctttttagtatttcgtataaagtattagattctatttttaattcattcgcatcatttttacaggtggcagtaggatttattttattggttaagatagatataggcatatttttacttgctctatttatattgttgttgttaaaatttagaactagcaatgcgaatatagaaaacttctctttcaaatattacaagagagaagtgttgcaaggtacaaagtttattttaaataataaattattatttaaaaccagtatttctttaacgcttataaactttttttattcatttcagacagtagttgtaccgattttttctattcgatattttgatggtccgattttttatggtatttttttaactattgctggtttgggtggtatattgggaaatatgctagcgccaatcgtaataaaatatttaaaatcgaatcaaattgttggtgtatttctttttttgaacggctcaagttggttagtagcaattgttataaaagactatactttatcacttattttatttttcgtttgttttatgtctaaaggagtcttcaatattatttttaattcgttgtaccaacaaatacctccacatcaacttcttggtagggtaaatactaccattgattctattatttcttttggaatgccaattggtagtttagttgcaggaacgcttattgatttgaatattgaattagtgttaattgctattagcataccttattttttgttttcttatattttttatacggataatggattgaaagaatttagtatatattagaaatgtttatgttcattcaaaagcataatgactataactgaaaaagaaaagtgatatctttaaggttgttcttcttggtggtgagattcgtgagacaacccaagcttttgtcggaaagattaccaatgctttgatggataggatgtactttagcaagatgtttttagtggtaacggtatcgtggatggacgtgtaataacctcttctttcgaggagtattttactaaaaaactagccttggagcgttccccagaaacggacttactcattgactcttcaaagatttggggagaagattttgcttcatctgttccttgaaaaaagtcacagcagtcatcacagacgatagtactgaacaaaactatgaagagttagaaatttatacgcaggtgattgtataaaggatctggaaatagataagaagttgattagtattgacctaggtggtacaaatattaagattactgttctttcaaatgacggtgagattgaaactttgtggagtattacaacagatacaagtgagaaaggttctcaaattatatcggacatcatcagttctattaaaaataaattgaccgaacggaatattcctgatagcgaccttcttggaatcggtatgggaagttgctcatcatactttccttgtaaatcataggggctataaactctccgtctacttgtcctgcaacaattgaagtctgctcaaaacgccgtccgctaatcttttcatagactttctcccttttaggagcctagctttctagtttgttctttgatttttattgagtataccactattttactccctctggcaagggactttgtctatgtggagggattgggctcctatgtggtggagcttttctgttctttctgaaatatggtataatagcactaatcaatttctaggaaaatagatacagaaaggggctgaaagatgtctcatattattgaattgccagagatgctggcaaaccaaatcgcggctggagaggtcattgaacgtcctgccagtgtggtcaaagagttggtagaaaatgccattgacgcgggctctagtcagattatcattgagattgaggaagctggtctcaagaaggttcaaatcacggataacggtcatggaattgcccacgatgaggtggagttggccctgcgtcgccatgcgaccagtaagataaaaaatcaagcagatctctttcggattcggacgcttggttttcgtggtgaagccttgccttctattgcgtctgttagtgtcttgactctgttaacggcggtggatggtgctagtcatggaaccaagttagtcgcgcgtgggggtgaagttgaggaagtcatcccagcgactagtcctgtgggaaccaaggtttgtgtggaggatctctttttcaacacgcctgcccgtctcaagtatatgaagagccagcaagcggagttgtctcatatcattgatattgtcaaccgtctgggcttggcccatcctgagatttcttttagcttgattagtgatggcaaggaaatgacgcggacagcagggactggtcaattgcgccaagcaatcgcagggatttacggtttggtcagtgccaagaagatgattgaaattgagaactctgacctagatttcgaaatttcaggttttgtgtccttgcctgagttgactcgggctaaccgcaattatatcagcctcttcatcaatggccgttatattaagaacttcctgctcaatcgtgctattttggatggttttggaagcaagcttatggttggacgttttccactggctgtcattcacatccatatcgacccttatctagcggatgtcaatgtgcatccaactaagcaagaggtgcggatttccaaggaaaaagaactgatgactctggtttcagaagctattgcaaatagtctcaaggaacaaaccttgattccagatgccttggaaaatcttgccaaatcgaccgtgcgcaatcgtgagaaggtggagcaaactattctcccactcaaagaaaatacgctctactatgagaaaactgagccgtcaagacctagtcaaactgaagtagctgattatcaggtagaattgactgatgaagggcaggatttgaccctgtttgccaaggaaaccttggaccgattgaccaagccagcaaaactgcattttgcagagagaaagcctgctaactacgaccagctagaccatccagagttagatcttgctagcatcgataaggcttatgacaaactggagcgagaagaagcatccagcttcccagagttggagtttttcggacaaatgcacgggacttatctctttgcccaagggcgagatggactttacatcatagatcagcacgctgctcaggaacgggtcaagtacgaggagtaccgtgaaagcattggcaatgttgaccaaagccagcagcaactcctagtgccctatatctttgaatttcctgcggatgatgccctgcgtctcaaggaaagaatgcctctcttagaggaagtgggcgtctttctagcagagtacggagaaaatcaatttattctacgtgaacatcctatttggatggcagaagaagagattgaatcaggcatctatgagatgtgcgacatgctccttttgaccaaggaagtttctatcaagaaataccgagcagagctggctatcatgatgtcttgcaagcgatctatcaaggccaatcatcgtattgatgatcattcagctagacaactcctctatcagctttctcaatgtgacaatccctataactgtcctcacggacgtcctgttttggtgcattttaccaagtcggatatggaaaagatgttccgacgtattcaggaaaatcacaccagtctccgtgagttggggaaatattaaaagtataaaaaagtctgggaaaaattttcaaaatcaaaaaaacgcataaaatcaggtgttcaaaaaccttgattttatgcgttttatcatggaaatagttacttcattttttcctaattcttttcgaaactctttttaaacgacgtcagttttatcagtaatctcaaaacagtgttttgagctaattttgccagttttgtctgtaacatcgaagttgtgttttaccactctgcgactggtttcctagtttgctctatgattttcacagagcattaaattgcgattttgccaagtttctttattcgtctaaaagtagagtctgttctatgcgtctaatgtacgaatcaggttgaccatttcaatagctccttgtgcacactcagaacccttatttcctgctttagtaccagctcgttctatggcttgttcaattgtatctgtcgttagcacaccaaacataacaggaatttcgctatttaaactgatttgggcgattcccttagatacctcgctacatacataatcataatgacttgtattccctctaatgacagctcccaagcagataattgcatcatattttttactttttgccatttttgatgcaatcagtggtatttcaaaagctcctggaacccaggctacctctatatctttctcgtttacattctctcttttgagattatctagtgctccagataataattttgaagttataaattcattaaatctcgctacaacaatacctattttaatattgtttgctactaaattaccttcataagtgttcatttatttttcctccatatttaaaatgtgacccattcgatttttctttgtttctaaataaaaactatcgtaaggattggcttctatttcgattgatattctactggaaatggtaattccatatttttctaactgttcaaccttgtcaggattatttgtcagtaaatgaagtgactgaagtcccagatctttaagcatttttgctccaatatgatattctcttaaatcaccttcaaagcctaatgcaagattggcatcaagcgtatccatgccttgatcttgtaaatgataggcttttaatttattgataagtccaattcctcgtccctcctgtcgcaagtaaagtaagacacccgaaccattctcaacaatcattttcatagccttatcgaattgctgtccacaatcgcaacgtaaagagcctaaaacatctcctgttaaacattcggagtggacccgacataatacattggcttcatcctctatatttcccataataagagcaagatgatgttccccatttagtttatctatatagctaattgctttgaaattaccgtatctagtaggcatattgacagttgaaactcgttctaccagctgatcatatacttttctatattcttgtaattctttgatggtaattagtggaatgttgtgttttttcgagaactgaattaaatcatctgttctcatcattttgccatcatgattcattatttcacaacataggccacactcttttagtccagctaattttaataaatcaacagttgcttctgtgtgtccatttctttctaggacaccacctttttttgcaattaaaggaaacatgtgtcctggcctgcgaaaatcagagggtgttatatcttcagctacacacatacgtgcggtcagtcctctttcctcggcagaaatacctgtggtcgtttctttataatcaattgaaactgtaaaagcagtcttatgattatctgtattgttttcaaccataggtgaaagcattaattgattagctaaactttcgctcataggcatacaaattaatcctttggcataagtagccataaaattaacattttctgttgtagctgcttgtgcagaacaaattaagtctccttcattttctctatccttgtcgtctataacaagaacaagtcgtcccttctgcaatgcttctaatgcttcttgtatttttcgatattccattgactgattatcctttctgctaaaatccattttgatataatagttccttagatatttctgattttggagagttatccatcagtttttgcacatatttacctaagatatcattttcaagatttactgtactcccgacttgtttactcttaagaatggtttgttccaaggtatgagggataacagatactgaaaagtttactttggagactttagcgacagtcagactaatgccgtcaattgtaatagatcctttttcaactattaaatctaaaatttctttttgtgtgttgatttgataccatacagcattatcatctttttttattgacgagatttttcctgtaccatcaatgtgtcctgtaacgacgtgacccccaagtcgaccgttgacagataaggctctttctagattcacctcacttccatgttttaatagagtaagagctgttcgactccatgtttcattcattacatcaactgtaaaggattgatgattgaaatgagtaactgtaagacagataccatttactgctatactatcgcctaaatggatatccgttaatatttttgaggctttaattgatagtttacaattacgagagtctttctgtattctttcaacttttccgatttcttcaattattcctgtgaacatggataaatcacttcactttctatgagatagtcatttcctatttgagaaaatgcataaggtttcaatctaatagcgtcatttggcaaagaaataccttcacctccgacaggaaacttggcactacctccaaaaacttttggtgcaatatatattttcagctcatcaacaatttgttgttccaaagcactccaattcattagactgcccccttctagaactaggctatcaatctgcatgtttcctagatgttgcattaaactcgataagtctatatgattgccttttttctttatggaaagtatttcacagccatgattttgatatagcttcattttatttttgtcttcagaggaagtggcaatgtaagttttaatatcatttgctgtttttacgattttagaggtaagaggagttcgtaaatgtgtatcgcatatgatacggataggatttttcccttcctccaatctacatgtcagcaaaggatcgtcttgaataacagtattgactcccaccataattgcactaacatggtgtcgtaactgatgcacatgctttcttgcttcttcttcagtaatccatttggattgatttgttttagtggctatttttccatccattgacattgcatatttcataaaaacatagggtacatgctgggtaatatactttctaaaactttttattaagttaagacactcattttctaaaattccaacagtaacttgaagattattttcctcaagtatctttactccttttccagatacaataggattacagtctaggcttccaatgactactcttgtaataccactatcgattatagcatctatacagggaggtgttttcccgaagtgacaacagggttcaagtgttacataaagcgtcgctccgacaggggattctctacagtttttaagagcatttctctcagcatgtgggccaccaaaaaactcatgataaccttgtccgataatgtgattatcttttacaataactgcgccgaccataggattgggattgacgtaaccagcccctttttgtgccagttttattgctaatttcatatattttgaatcgctcatctcgctacctccaaaaaaatataccttgaataggggactactcaaggcatacaaaagaaaacttatgcgattaacaaaaatgctctgaaatgacaagtaatcatttcagagcacgcaaaaagcacaaatatacttttatcttctttcatccagactatactgtcggctttggaatttcaccaaatcatgcctttcggctcgtgggctataccaccggtagggaatttcaccctgccctgaagatagttattcaattacagatgattatagtacttaattttgaatatgtcaacagataaataccgattgtttttgatatactgtatttgtgataatcgattctcgctcctcggataaagaaaatatgatatactagataaacgaaataagagagaaggaatactatgtacgcatatttaaaaggaatcattaccaaaattactgccaaatacattgttcttgaaaccaatggtattggttatatcctgcatgtggccaatccttatgcctattcaggtcaggttaatcaggaggctcagatttatgtgcatcaggttgtgcgtgaggacgcccatttgctttatggatttcgctcagaggatgagaaaaagctctttcttagtctgatttcggtctctgggattggtcctgtatcagctcttgctattatcgctgctgatgacaatgctggcttggttcaagccattgaaaccaagaacatcacctacttgaccaagttccctaaaattggcaagaaaacagcccagcagatggtgctggacttggaaggcaaggtagtagttgcaggagatgaccttcctgccaaggtcgcagtgcaagcaagtgctgaaaaccaagaattggaagaagctatggaagccatgttggctctgggctacaaggcaacagagctcaagaaaatcaagaaattctttgaaggaacgacagatacagctgagaactatatcaagtcggcccttaaaatgttggtcaaataggagcagagaatgacaaaacgttgttcgtgggtcaagatgaccaacccgctctacatcgcctatcatgatgaggagtggggccagcccctccatgatgaccaagtattgtttgagttgttgtgtatggaaacctatcaggcaggcctgtcttgggaaacggtactcaacaaacgccaagctttccgagaagtctttcatagctatcaaattcactcagtcgcagagatgactgacactgaattggaagccatgctggagaatccagctatcattcgaaatagagccaagctttttgctacacgcgctaacgcccaagcctttctacagttacaggcagagtacggctcttttgatgcctatctttggtcttttgttgaggggaaaactgtcgttaacgatgttcctgattatcgccaagcgccagctaaaacacccttatctgagaaattagccaaagatctcaaaaaacgaggcttcaagttcacaggcccagtcgccgtattgtcttttctacaggctgcagggctagttgatgaccacgagaatgattgtgagtggaaaggtcttaaatgatgtctaacaaaaataaggaaattctgatttttgcgattctctatacagtcctctttatgtttgatggcgttaaattgctggcttctttaatgccatctgccattgcaaattatcttgtttatgtagttttagctctatatggctccttcttgttcaaggatagattgatccaacaatggaaggagattagaaagactaaaagaaaattcttctttggagtcttaacaggatggctctttctcattctgatgactgttgtctttgaatttgtatcagagatgttgaagcagtttgtgggactagatggacaaggtctaaatcagtctaatattcaaagtacctttcaagaacaaccactactgatagctgtttttgcttgtgtcattggacctctggtagaagaattatttttccgtcaggtcttattgcattacttgcaggaacggttgtcaggtttactaagcattattctggtaggacttgtttttgctctgactcatatgcacagtttggctctatcagagtggattggtgcagttggttacttaggtggaggccttgccttttctattatttatgtgaaagaaaaagagaatatctactatcccctacttgttcacatgttaagcaacagcctctccttaatcattttagctatcagtatagtaaaatgaaatgagaacaggacaaatcgatttctaacaatgttttagaagtagaggtgtactattctagtttcaatatactgtaatatgtgatgaaaatgccagtaatgataccgagaaaaaagctgagaaacttttcccagctttatttgttatagtcaaagagaatgacttgttcctgtgcatctacatgagcatggaccccaaagggtacaattgctcttggagttgcgtggccgacattcagattatagacaatcgggatattgctgtcaatgatatccaatagtgcctctttatagtcgtcatggaaagtttcatccataggttttccgaccaagagtccattgatgaccgcgaatatgccagtgtcctttaaagttagcaacatctttttgaagtcttctggcttaggcttttcttcgcttgtttcgagcaagaggattttcccttcccagtctgacaagtcagggaaaagtttgtatttttggcagagttccgtgctatctgcgtatcgagagttgtcaaagatatcgtagagggattcgaggcaaccaccgaggattttcccctcgaactgggcacttccttgcaacaagtcaaaacctgtatttgtatgactgacacgaggtgttcccagggccgtgggactaaaatcagttcgttcctcataccaaacgtcactagggcggatttctgaaattcttcccgtctcaatcaattctttaaagtagtgaaggctataggctagcatttctttgtctaattcacaaatgtctgctaaaaaggattgaccataaaaagtcttgattcctaatttatgcaacatgaggtggttcatggttgtatccgagaagccaagaaaaattttttgcttgataaccttttggagttggtcattttcaaaaagataaggtagcaagcgataggtatcgtctccaccgatggcacataggatcatgtcgatgctatcatcagaaaaggcatgaatcaaatcctctgcacgagcttcaggatggtccttgataaagtctaatccttttaacgaatggggcaaaaagatgggattggtcccagatccttgagacgtt

SEQ ID NO: 41 - DNA, 9828 bp; double-stranded, linear
gtgaagtgcggcaaaaggtgcaagtgatgagctcaggttctttagctcttgacattgcccttggctcaggtggttatcctaagggacgtatcatcgaaatctatggcccagagtcatctggtaagacaacggttgcccttcatgcagttgcacaagcgcaaaaagaaggtgggattgctgcctttatcgatgcggaacatgcccttgatccagcttatgctgcggcccttggtgtcaatattgacgaattgctcttgtctcaaccagactcaggagagcaaggtcttgagattgcgggaaaattgattgactcaggtgcagttgatcttgtcgtagtcgactcagttgctgcccttgttcctcgtgcggaaattgatggagatatcggagatagccatgttggtttgcaggctcgtatgatgagccaggccatgcgtaaacttggcgcctctatcaataaaaccaaaacaattgccatttttatcaaccaattgcgtgaaaaagttggagtgatgtttggaaatccagaaacaacaccgggcggacgtgctttgaaattctatgcttcagtccgcttggatgttcgtggtaatacacaaattaagggaactggtgaccaaaaagaaaccaatgtcggtaaagaaactaagattaaggttgtaaaaaataaggtagctccaccgtttaaggaagccgtagttgaaattatgtacggagaaggaatttctaagactggtgagcttttgaagattgcaagcgatttggatattatcaaaaaagcaggggcttggtattcttacaaagatgaaaaaattgggcaaggttctgagaatgctaagaaatacttggcagagcacccagaaatctttgatgaaattgataagcaagtccgttctaaatttggcttgattgatggagaagaagtttcagaacaagatactgaaaacaaaaaagatgagccaaagaaagaagaagcagtgaatgaagaagttccgcttgacttaggcgatgaacttgaaatcgaaattgaagaataagctgttaaagcagtggagaaatccgctactttttcgatttttgattcaagtttttagattatatatagtagcttgaaataagatatgaacaactctattaggaaagtcaaattaatttctagaaatgttttagcagctacagcgtactattccaaactcaaccaactataatagatcgaaactagaatagtacatatctacttctaaaacattgttaaaaatcgatttgactttccttatttcattccgctatatatagtttgctgtttcttgtcgctcctctggaaagctgatataatagctttatgaataaaaaacgaacagtggacctgatacatggtccgattcttccctcgctcttaagcttcacctttccaattttgctatcaaatatttttcaacagctctataacactgctgatgtcttgattgttggacgatttcttggtcaagaatccttggctgcagtaggagcgacgacagcgatttttgacctgattgtaggttttacacttggtgttggcaatggcatggggattgtcattgctcgttattatggggctcggaatttcactaaaatcaaggaagcagtagcagccacctggattttaggtgctcttttgagcattctagttatgttgctgggctttcttggcttgtatcctctcttgcaatacttagatactcctgcagaaattcttcctcaatcttatcaatatatttctatgattgtgacctgtgtaggtgtcagctttgcttataatctttttgcaggcttgttgcggtctattggtgacagtctagcagccctgggatttctgattttctctgccttggttaatgtggttctggatctctattttattacgcaattgcatctgggagttcaatccgcaggacttgctaccattatttcgcaaggtttatcagcggttctctgcttttattatattcgtaaaagtgtgccagaactcttgccacagtttaaacatttcaaatgggacaaaagcttgtacgcggatctcttggagcaaggtttggctatgggcttgatgagttcaattgtatctatcggcagtgtgattttacagttttctgttaatacatttggtgcagtgattattagtgcccagacggcagctcgacgcattatgacctttgcccttcttcctatgaccgctatttctgcatcaatgacgacctttgcttctcagaatctaggagctaagcgacctgaccgtattgttcaaggtcttcgaatcggcagtcgtttaagtatatcctgggcagtttttgtttgtattttcctcttttttgccagtccagctttggtttccttcttggctagttcgacagatggttacttgatagaaaatggaagtctctatctgcaaatcagttcaaccttttatcccattttgagcctcttgttgatttatcgcaattgcttgcagggcttggggcaaaagatccttcctctagtttctagctttattgaactaatcggaaaaatcgtttttgtggttttgattattccttgggcaggatataagggtgttatcctttgtgaacctcttatctgggttgccatgacagttcaactgtacttctcattattccgtcatcccttgataaaagaaggcaaggcaatcttggcaaccaaagtgcaatcctagttggatttactgaataaaatccatttcctctagtgaaaatcgaaaaaacttgtgttctcttctttagtttggtgttgaaaatagtttaacagacttttgacttcttttatatgatataataaagtatagtatttatgaaaaggacatatagagactgtaaaaatatacttttgaaaatctttttagtctggggtgttattgtagatagaatgcagaccttgtcagtcctatttacagtgtcaaaatagtgcgttttgaagttctatctacaagcctaatcgtgactaagattgtcttctttgtaaggtagaaataaaggagtttctggttctggattgtaaaaaatgagttgttttaattgataaggagtagaatatggaaattaatgtgagtaaattaagaacagatttgcctcaagtcggcgtgcaaccatataggcaagtacacgcacactcaactgggaatccgcattcaaccgtacagaatgaagcggattatcactggcggaaagacccagaattaggttttttctcgcacattgttgggaacggttgcatcatgcaggtaggacctgttgataatggtgcctgggacgttgggggcggttggaatgctgagacctatgcagcggttgaactgattgaaagccattcaaccaaagaagagttcatgacggactaccgcctttatatcgaactcttacgcaatctagcagatgaagcaggtttgccgaaaacgcttgatacagggagtttagctggaattaaaacgcacgagtattgcacgaataaccaaccaaacaaccactcagaccacgttgacccttatccatatcttgctaaatggggcattagccgtgagcagtttaagcatgatattgagaacggcttgacgattgaaacaggctggcagaagaatgacactggctactggtacgtacattcagacggctcttatccaaaagacaagtttgagaaaatcaatggcacttggtactactttgacagttcaggctatatgcttgcagaccgctggaggaagcacacagacggcaactggtactggttcgacaactcaggcgaaatggctacaggctggaagaaaatcgctgataagtggtactatttcaacgaagaaggtgccatgaagacaggctgggtcaagtacaaggacacttggtactacttagacgctaaagaaggcgccatggtatcaaatgcctttatccagtcagcggacggaacaggctggtactacctcaaaccagacggaacactggcagacaagccagaattcacagtagagccagatggcttgattacagtaaaataataatggaatgtctttcaaatcagaacagcgcatattattaggtcttgaaaaagcttaatagtatgcgttttcttgtggagatatttccttcaattttgctactatattaaacaaaaatcaaaaagcaaactagaaagttatgctcaaataaaatctaaatttgacaatgtaaaccgagtcggatagctttaagtactgttttgaggttgaagatacgatttttgataggaactcatcaattttagatttttaagcagcatcaataaattgcttccttgttttgtcataatttttttatttaaaaaattatgacmagagtgtgctattctttttatgagaggtgtatgaatatgataaatgtatgtgataaatgtatgtgatgttggaaaaagaataaaagaacttagaatatcttcaaatcttactcaagataagattgctgagtatttgtctttgaatcaaagcatgattgccaaaatggaaaaaggtgaaaggaatatcacgaatggatttaagtaataaagcttcaaatcttagaaaaaagttgggagctgatggtgaatcgccgatagatatttttaaattggtacaaaagatagaaaatttgacgctggtattttatggactcggaaagaatattagcggagtctgttataaaggaactcagttcagtctcattgcagtcaattcagacatgccattaggaaggtaaagattttctttagcacatggactgtatcatctttattatgatgaggtgaagaagagttcagtcagtcttatcttgattggtgaaggagatgaaactgaaagaaaagcggatcagtttgcttcttattttttaattttcccatcttcactgtataggatggttgaggaaatcagagaaaatgccaatagaactcatcttgaagtagaagatattataaaattgggtcagttttatggtatcagtcataaagctatgttatatagattgaggaatgatggataccttgatgcagaagaaattaaaaatatggatattagtgttatagagacagcttcaagattaggctatgatacaagtttatatcgtcctttgtcagaaagtaaaaaagaaatggcattaggataatatattaattcaactgaacaacttttagaaaataacagaatttcgcaagggaagtatgaggaactgttactagatgctttcagatatgatattgtatatgggctagatgaagaggggggagttgtcgtttgactagtcgtgtatttattgatgcagattgtatttcagtatttttatgggttggcactgaacatcttttagaaaagctctatttgggtaaaattgttattccacaagaggtgtatgatgaaatcaatatacctacaattccccatttaaaatctaggatagatcagttggtagctaagggttcagctgagattgtgagcatagacattggaactgaagaatacgcattatatagagatttaacaagaaatcatgatagtaacaagattattggtaagggagaaggggcatctatttccttagcgaaaaagcataatgggatattaggaagtaataacctaagagatgttaaatcatatgtagaagaattttctttagaatatatgacaacaggagatatactgattgaagcgtttaaagcgtaatttattactgaataagagggcaatcatatctggaataatatgcttaaaaagagaaggaaaattggtgcaaattcattttcagactatcttcgtggaagtattcatcaaaatagacaaaaataaatttggataaatcgaactcactattcaggaggcatatgagcaattcgaaaaagaaaagtgtcaaattgagcctataggagtagaagtgaaatagtaagtcctgcatagtggatgagagaaaagttctccttgaagttttcctgaactatcagtcgcatgtcaaacgatatgtagggtaatgtgagaggggatagcgagtagtttttggttattttatcaaaaaacttatattttattataccgaatgataaaatataataaaaatgatagaataaggaaaaaacatgaatgtcaaaaagataatgtcaatttttcaatccttttatgttgatgtcagtattgaggaactgactttgactttaccaatcagttttgtaaaaaggtttgagtatactcaaatgacttttcataaggaatcatttttattgattaaagaaaagagaagggggagtttgagttcatttgttactcaggctcgcactatgggtgaaaaagccaatatggatgttgttttggtgttttcgaagttatcagacagtgaaaaaaagcaattacttcaagctagagttccgtttgtagactttaagggaaacctcttcttccctccattgggactagtactcaatgcgaatgatactgaagtccctaaggaattaacacctagcgaacaattaacgtggattgcctttttattgacaaaaggtcaaaaagtagtagatgttgatttgctttcacaagtcactggacttccaaactcaacaatttataggtgtttgaggacttttaaagctttatattggttaaacaagcaaaataagctttacacatatacggtgtcaaagaaagaattattcttaaaatccgtgtcatgtttatttaatcccatcaaaaaacggattttattgccagatggcgatataaagcagataaaatctgtttctaaccttctatatggtggtgcttatgctttgtcgcattcaacttttttagctgaaacggatgaaaatattagctatgtcatatggcagagaaaattcaatcagttatccttgccactttctcagcatgttttaaaatgaaagatgctagagatatggaaatatcgtccttttgtatctgagttttggaatgattttaaaaataatcatgataaacaatttgtagatccgatttctctttatttgaccttaaaagatgatgatgacccacgtatagaggaagagagtgaagcactagaaaatatgatattacagtatctgggagaagatgatgccagctaatacgaaagttatttttcaagaaatgtttgcggattttcagaactattatgttctgattgggggaactgctacctctatcgtattggattcgcaaggatttaaaagtcgcacaacaaaagattatgatatggtcatcattgatgaagtaaaaaataaggaattttatactaccttgaatcattttttagaattgggagagtatcaaggaagtcagaaagatgagaaagcgcagctttttcgatttacaacaactaatcctgagtttccttctatgattgaactatttagtatcttaccagaatatccattaaagaaggacggtcgagaaattcccttacattttgaccaagatgctagtttatcagccttattattggatgaagattattataatatattggtgcatgaaaaagaaaccattcaggggtattcggtattgagtaattgtggtttatactcttcgaaaatctcttcaaaccacgtcagcttccatctacaacctcaaaacagtgttttgagcagcctgcagctagcttcctagtttgctctttgattttcattgagtattaattatttttaaggctaaagcttggctggatatgagggagcgctctgccacaggtgctcaaggtttaagtaagtccattaaaaagcatttgaatgaccttacccgtttgacagcttccttgctaggagatgaaaagttatcggctataacatcaagtagtgcggtaaaagcagacatgcaccgctttgtgatagaattagagcctgtgaagtcaactattcttcaaaataatgacatttcattggatcaaaatgaaatttttgaaattctgaaaaattttctcgatggttaaaataattgtagcgagatggctatattgaattcgtctatatctggaaactagaaaaaacttcaatttcaggagaaaatgaagtcaatcttcccacaatcaaacgtatagtatcaaggtttttcaagacctgatattatgcgttttttgcttttcaaaactttttgcccagtcttcgtttttatcctctagtcacttgatttgtttcaggtggttttttagtatagtagaatgaaacgagaacaggacaaattgatcaggacagtcaaatcgatttctaacaatgttttagaagcagaagtgtactattctagtttcaatctactatagttaaatctgcggtcaagtctactggtgaatctatgattgtaatactcttccaaaatctcatcaaccacgtcagtcttgccttgcagtctgtatcttactgaccaagctagtgatggatttagaataggtgatttggagcgtcctattagctaggaaatgctgctcatagtcctttgctgaggctagggtgtttcaacattcaacactcaactggttgatctagttgataggaagggagttactataaaatactcaggcttccatcatattttttgaaacgattgtgtaatcaaaatgtaccaatattgtagtattggtacagaagatgttgtgaatggataaatatatcataactgctatctcaaaaagatttcatatgtctgtgcatatataatagacttcctgcaaaactagaatcctagttcatgattgataataccagcaatcaaattcattcgtaatccaaagcgtttacgatgatttcgataggttgttgaaaacattttaaacgtttctactttggcaaagatgttctcaaccttgcttctctccttagatagcgcatggttataggctttatcttcagctgttagcggcttgagtttgctggatttacgtggagtttgtgcttgaggacatatcttcatgagcccttgataaccactgtcagccaagattttaccagcttgtccgatatttctgcaactcattttgaacaacttcatatcatgacaatagttcacagtgatatccaaagaaacaattctcccttgacttgtgacaatcgcttgagccttcatagcgtgaaatttctttttaccagaatcattcgctaattctttttttagggcgattgatttttacttccgtcgcatcaatcattaccgtgtcctcagaactaagaggagttcttgaaatcgtaacaccactttgaacaagagttacttcaacccattggctccgacggattaagttgctttcgtgaataccaaaatcagccgcaatttcttcataagtgcggtattctaggcttaatttaggttttcgtccaccttttgcgtgtttaagttgataagctgtttttaatacagctaacatctctttaaaagtcgtgcgctgaacaccaacaagacgcttaaatcgtgtatcagttaattgtttacttgcttcataatttcgcagggagtctattgactctttggtaggtgtcaatgtttttttcatctatcccgagaattattttcccgccatttgtatttgcaaatgctgagtaggtttcccagaaagactctggaagattgtttttagcttttttgtattctaaatcaaccccttcaaattttaagtccatatttttcctttacatctgttttttgtggttctggtatttgttcaagttgagtgataatatagcgaattgaatttcgagagtttttactcagttaatttcttttttaacccactttaattgcttttttaacacgggttaaaaaagaaattaaagtgggttaatttttcttga

SEQ ID NO: 42 - DNA, 3369 bp; double-stranded, linear
ccgcgaaagatatttttgaacaagagtttggacgtgaggtccgtggctataataaagtagaagttgacgagtttttagacgatgtcatcaaggactatgaaacctatgctgccttggtcaagtcacttcgtcaggaaattgcggatttgaaggaagaattaactcgtaaaccgaaaccttcaccagttcaagcagaaccccttgaagcggcaattacaagttctatgacgaattttgatattttgaaacgcctgaatagattggaaaaagaagtttttggtaaacaaattttagataactcagatttttaagtagttatttgagatgtgcaatttttggataatcgcgtgaggagaattgtttctcatgaggaaagtccatgctagcacaggctgtgatgcctgtagtgtttgtgctaggcgaaaccataagcctagggacgagaaatcgttacggcagttgaaatggctaagtccttggataggccagagtaggcttgaaagtgccacagtgacggagtctttctggaaacagagagagtggaacgcggtaaacccctcaagctagcaacccaaattttggtcggggcatggagtacgcggaaacgaacgtagtattctgactgctatcagctagagctgttagtggtagacagatgattatcgaaggaagtggtcctagtcacttctggaacaaaacatggcttatagaaaattgcatataggttggggctgagaaattttctcaacctcattttttaaagtggacatatagaaaggtcttgcaagactgtaacatgaaaaaagaatttaatttaattgcaactgtggcagcagggcttgaggctgtcgttggtcgtgaagtgcgagagttgggctacgattgtcaggttgaaaatggacgtgttcgttttcaaggagacgtgagagctattatcgaaaccaacctttggcttcgggcagcagatcgtatcaaaattatcgtaggaacgttcccagctaagacttttgaagagctatttcagggagttttcgctttggattgggaaaattatttaccacttggagctcggttcccgatttcaaaagctaaatgtgttaagtccaaacttcacaatgagcccagtgttcaggctatttctaagaaagctgttgtcaagaaattgcagaaacactatgctcgcccagaaggggttcctctgatggagaatggcccagagtttaagattgaggtctctattctcaaagatgtggcaactgtcatgattgatacgaccgggtctagcctctttaaacgtggttatcgtaccgaaaaaggtggcgctcctatcaaggaaaatatggcagcagccattttacaactttctaactggtatccagacaagcctttgattgatccgacctgtggttcggggactttctgtattgaggcagttatgattgctagaaagatggcgccaggtcttcgtcgctcttttgcatttgaggaatggaactggatcagcgatcgcttgattcaagaagtgcgcacagaagcggctaaaaaagtagaccgtgagcttgagctggatatcatgggctgtgatattgatgctcgcatggtggaaattgctaaggccaatgctcaggtagctggtgttgcaggagacattacttttaagcagatgcgcgtgcaggatttacgttccgataaaatcaatggagtaatcatttccaatccgccttatggtgaacgtttgtcagatgatgcaggggtgaccaagctctatgctgagatggggcaagtatttgcaccgctgaaaacttggagcaaatttatcctgactagtgatgaagcttttgaaagcaagtatggtagccaagcagataagaagcgtaagttatacaacggaaccttgaaagtggatctatatcaatattttggtcagcgtgtcaaacggcaagaggtaaaatagaaagggatactcatgagtaaaaaaagacgaaatcgtcataaaaaagaaggtcaagaaccgcaatttgattttgatgaagcaaaagagctaacagttggtcaagctattcgtaaaaatgaagaagtggaatcaggagtcttgcctgaggattccattttggacaagtatgttaagcaacacagagatgaaattgaggcggataagtttgcgactcgtcaatacaaaaaagaggagttcgttgaaactcagagtctggatgatttaattcaagagatgcgtgaggctgtagagaagtcagaagcttcttcggaggaagttccatcttctgaagacatcttactacccttgcctctggacgatgaggagcaaggcttggatcctctattgctagatgatgaaaatccaacagaaatgactgaagaagtggaagaggagcaaaacctttctcgtctggatcaagaggactcagaaaagaaaagtaaaaaaggctttattttgaccgttttggcgcttgtatcagtaattatttgtgtcagtgcttattatgtctaccgtcaagtggctcgttcgactaaggaaattgaaacttctcaatcaactacagccaatcaatcggatgtggatgattttaatacactttatgacgccttttacacagatagcaataaaacggctttgaaaaatagccagtttgataaactgagtcaactcaagactttacttgataagctggaaggtagtcgtgaacatacgcttgccaaatctaaatatgatagtctagcaacgcaaatcaaggctattcaagatgtcaatgctcaatttgagaaaccagctattgtggatggtgtgttggataccaatgccaaagccaaatcggatgctaaatttacggatattaaaactggaaatacggagcttgataaagtgctagataaggctatcagtcttggtaagagccagcaaacaagtacttctagctcaagttcaagtcaaactagcagctcaagttcaagtcaagcaagttcaaatacgactagtgagccaaaaccaagtagttcaaatgagactagaagtagtcgcagtgaagtcaatatgggtctctcgagtgcaggggttgctgttcaaagaagtgccagtcgtgttgcctataatcagtctgctattgatgatagtaataactctgcctgggattttgcggatggtgtcttggaacaaattctagcgacttcacgttcacgtggctatatcactggagaccaatatatccttgaacgtgtcaatatcgttaacggcaatggttattacaacctctacaagccagatggaacctatctctttacccttaactgtaagacaggctactttgtcggaaatggcgctggtcatgcggatgacttagattactaagcagtcgg

SEQ ID NO: 43 - DNA, 9713 bp; double-stranded, linear
aagtttacaatttaaatgaattaacaattttcccaactaaaagcactccagttaccgcaacgtttgtactgaatgtactaaatcgcattccatcaacttcatctgtttcgtcaacttgaacagatactaattgaagatttaatacttctgctgccatagctagctcctcctatttaaatttttgggattaagtactttatccaccctcatatactctctccaccagtaaaatgcaagcaatgatacaaaatagatttaactattttatatagcgaaaacttacaaatttttaagaaataatttttgcattcttaaagataaaataggaacttttagtaataaatattaaaataaataaaataatagatactataaaatttggaagtattaaccccaaaagattcatatcatctattaaaatatcctctaaagagtagtatattaaagccataattttaatgttaagtaaaaatgcaattaatgaagtaacaaatgtcaaaaatatagcctcaccaactttaatcttaaccatctggtaattagaagttcctaaaatttcaaattgctgaatctcaatcctttcttgatgcgatgacaaaaatgcaattgaaataatatttgcaagtactatcaaaattggtgctcctacatagacaataaatgctacttttagctctaaatcactgtcatcttgaaattgagatagtatattctgagaaatcatttgaaaactagaaattagtaatatagctcctgtaattgcagcactgatagattttatataagacttacaatatagtaaattccacttcgaaacaatgaacataaaattatttctaaatataattatagaaagtagtttgataaaacatgactgtataaaaggagataattgataaataatcacaatatctaagattacaatattgaatattatctgggccttcgctaaaattgtgctatcttggaaaatttgttgcaaagaaagcaaccagataacactaaaaccagccaatagcagtattctttttactattgaaagaacatgccttattttagaactcttcctatttctaatcttcttgaacgtataaaagcaaccacttagaaaggctaaaaatgaaatcaacactactgtaatgatacatccaacagcactcgtttgaaattggatatcaggtaatatattttccccgaaaaagtattgtaaaaaataataataatttgacgtaacaaatatagagcatagatatgcaataaaactaataatcgaggaaatgataaaaatctgtccccccacaagaaatgatagttgaaggcgacttgctcccaacacctccagaagttcgtaatcatctctaaaaatttcaaccaacatatttattatgttagagagcacaaagaataatgttactcctccgaatactatcggaaacataaaaattggtttaggatctggaagtccgacaaatacttgcgaattattctcaacattaattaccccattaacagccaatcccataactaaactcgaaacaaaaattactggtgaaacgcctaaccattgtttcttattatgtaaaaattgatagtaaactaatctgagcatctctattcctccgtagttgattgtacctctaagattttatacaactcttccccgctaggtctatgaagttctttgaaaatttttccatctttcaatattaatgcacgatcagttttcgaggccaattctatatcgtgcgttaccataattacacacttacccgcccctactaactctctcaataattcaaaaattacttcacgagaaacgctgtctaaagccccagttggctcatcagcaaatattatatcactatcagcaataaccgctctagctatagcaaccttctgttgttctccaccagacagagttccaacaaaatcgtttaagccagcattaaacttcattcttttgagtaagttttctacatttttaatagttaattttttttgtgataatcgcaaaggaagtgctatattttctattaccggcagggaaggtattaaattgtatgcttgaaatataaaagatacttcgttacgtcttatacttgacaattttgcatttctgattttataggggttgattccatttaaaattacttccccacttgttggttcaagcaaactagaaatacattttaataaagttgactttccagaaccactaattcctagaatacttataaattctcctctcgaagcagaaagagaaacatttttcagcacttgcaacgttttattatttcctagtaaaaattgatgatacagccctttcacttttaatatataatctttatccatattcttgcctccaatcacttaattttgaaaagtgttccattttccaatttatatatatcagtgtatctcttgtcatttaagtcataatgatgtgaaacttcaataaatgaaatacctaaattgaacagaatatcatgtatggaatttgaattatcattatctaaattagctgatatttcgtcaaataagtacactttattatttctaatcagagctctagctaaagctattttttgtttttgacctccagacaaattactaccattttcaccacattgataatttagtatatctatcttttctaattcttcatatagatttaccttttttaacacctcaattatctgatcatctgaaaaatattcattttgaaataaagttacgttctcacgaatagtagtgtcaaaaatatatggtgtctgatcaactgttggtattgaatctgaactctttttcccatgtgataacaaatttacataacctttttgtggctttaaagaaccattaattaaatttaaaatcgttgttttcccactaccagaagttcctgttaataataccctaaatggtgacttaaatgagaagtcaatacttaatttattttctggtgtaatagaatatacaacatctttcatgtgtatctcatctattgatgaagtatacagtccgttattatcatgttcagcgtctataaaattcttctctccacttaagtattttaaaaacggtttccttaaatctttggttgtatttatcttatttaatgaataggcaattgattgtatcggccctaaaactttatcgtttgctaagaaaatacctatcagttcactaaaagaaaggcttttatgataaattacaaaataacatcctacaaccaagggaactagaaagcaaaaacctgaaattagtactgcaaccaattttgaaagaacctctgatcgtttcaaattaaaagtagaatcttctagtttatccaactttttatccgacaaactaattatttctttagtaacagaataagattttaatgtcttaaaaccattaaaaatttcttttattatgtgagtatactctgcattgctgttagagtactcattagctgaattagacaacatcttcttcataaagacaggtactataatcggcaatgctgataatacaataaatattattganactaggaagtttaaataaagcataaaacttagagagacgatgaacaacaatattgaagaaattatttcaaaaatttgtctaaaatagttttcttcgattaatctcaaatcatttgacaaaactgaaataatagatgagtaatctttaaccatttcagaagaaagatactgttctctaaaatatccttgtttaatttttacatttatatctttagttattgatgcttccgttacttctaaatagtaatttgatatatagattgctgaccaacccagaatacttatagcaccaaatcttagaacgtcagaaaatgaggaagtctgatttaaactacctgcatatacaataattcctgagagcaagacaccattaaacgaagatagaaatattaaaatccccattaatataagtttagtcttttttataaattttaaataattcataagttattccttcccacttcttcaaagaaataatttaaagtatcaatcattaagagaacatctgatggagtaaaacctccatgaccagctgctttgtttaaatacaacaaacttttaactccaatagaatttaatttctttgaccactctatcacttcgttattattaatatatgggtctttctcacccaaaatattaactataacagtatttgagtctcgtgccttttcaatattttgcataggcgaatatgactttatataagcctttacttcagggtctctaatatctccccactctgctatttcggtcttagaaagaggatcatttggattctgaagtgtatcataaggatttataaatggcgaaaataagagaatgctttgcaataaatttttttcctcgttcaacaccgcaccagcaattattccacctgcactagaagttattaaacctaatcgcttactgtcaattacatcattttcccttaaataatttactccctcaataaaatctctgatagaattccatttgtttaacgcctttcctgagcgataccattcaccacccaaatagcctccacctcttacatgaactatagcataaataaaacctgcatctattatagataacataatttcatctaaatcagaattatcattcttaccataagccccatagacacttagaatacatttttttcttcttgggagctcatccgtatcttcacttttccaaaataaagaaatcggtatgcttacatcataactgtcttttttagtccaaatcaccttagaaaaatatttagtattattcgattttatgatgggtctttcaaattcagtttttaatgtattttctattaaatcaaaactaagtattttttcgtaaaaagttctcctctctaaaaacagaagaacacgatcagaaaatgaattttcataaagtgttgtcttttcatcaaatgttatcttattaacactcaactccctcaaactattatttttaaatgtagcaagataaaagacggaattcgctgcgtttgaacagtctaaaaggatataacgtcctatacagtgaactcttctagccctatcttgatatggtatagtaatagaaactctgtctcccgaagaagtttcccttagaattagttgatctttcttttcttcagttgaagagagcccaagaaagtactgtgctttttctgtactaaatagagcgatatctctaggtgttggggctaccgtttctgtgtaagagtgtctaacaaaacccgtccggtcgaaactgtatagaaaaatcctgcctttctgaaagtctactgactttacaaaacaattattgctatcaatgtggactatttttaatcgaaaagagcattcgttttcttcaaacagttcctcttctgtaaagctatcaaaagatttatagaataacttacttggcctcccgtactctttggagcgagtatacataacaccgaatttacccaaatagaacgaactttctactgaaatatcttcaatgataaataactcttccatagtatatttttttattccaattaaattagtcgtacgcagtgaggatacaaccaaaactatataactctcatcagatgaaatcctaacatcctgtaagatactatcatctggcaaagtatatttttccacatcaaagacaattttaagtgaatttgaattgtctaaactggaagaactaaccttaggaatccagtcattatcttcgacataccattcctttattacaccagtattgggtatactccaattatcaaattggtaccaatatcgccctctcctaaatatcaaagaattccatttttttaattcctgaaatgatgaagagatagacctcttatagtgtgttttttcctgtattgtatttaaaaatatttcattactctgattcacaagtatgaccccttaataatggtatctaaatattatatttgaggaagaatcgtcaatttattatccattattgataccaatccaattgcaacacccgcaaatcccgaagcaatatctgttgttatctttaaaccattatctcccgcaataacaaatccttcttcaattacacacaaatatctataaagttgttcaattaatttcttttgtcctgaaaagttatcatcgatatcactatatatattattagcaacttcaagaccacaaaatccgttaaataaacctggtaatacacaaaaaactacatcagttgccctctctaaagaagttaaatattttaagtatttgcttgacaagatttctttatttctattaataagtaaaagcaggccagcacttccagttgctagatatggtagtaatctatgaccttggctgtactgcaatgaattattactatctactttataagcaactaattctttatctacagccaattctagaccatttttatagatactttcaccagttaatttataagcttcaccgaagagccaagctacccctgcgtgaccatatagtaatccaccaaaattctcataaggatcgttactctgaacatcactagcgccaactttacaaaaagtttctggattttctatataatttaaagtatattctctaagcctaattagtatttcttctcctagtttattatcaattccccctttactaagaaaatacagtccaaccagtaaaattccagcctgcccactatataaatttttattttgtgaattctcaaatatctctataaaatgagttgtaaaaagttcaactgcccgatctatctccccaaattcataaatgagccagattgtaccaattttaccatcaaaaagaccagaaagggacgatttcttaaaattatttactgcctcattaataacctgtgttcgaatctcataatagtcatcaaacttgaaattttttactttcttagctagttgttgataactccaaaggatagctaaatctgaaaacgcaattccttgattaaaattcagaccataataatgaactgggaagaatcttgattgaaattctttacgccactgtccataagttagcgtaaaccctctcaataattttataataaaatcttgtatatcttgctcactctcgatagttctaatctcatgcatgggttttaaaacttttttcctggaaatattctcaatctgtggacatttagaatctagatatgacaataaactttctacataatctatatgttctcttgtataacccaaagactcaaatagtttttttccttctatcctggtttgacttacatagttgtatgtcaaatccgatgtagttactagtggcatgtataaataatgagctatttgtctaataccataccaatctatctcactgggaagtgtttctcgccatgctctaaaaccaggggctgcaactttatgtacaactttttcatcatttgaaaagacagcctgttcccagtctattatactaatctcatcttcatccttaaccaagatatttcctaaatgtaaatcttgatgatatacattttcagaatgaaacttattcgttaaatcgatgagtttttctactatctttgaaactctcaatagataatctttggtcttatcaacaacttcatataaaggaaaattattggtaacccatctatttagtggaacgcccttcatatgttcaattcctaagaaggtgtgctcccagatcttaccgtgccagtatattttaggcgtctcactccattcatttagaatttttagtgctttgcactccgaagctaatttctctgaagaataagtaccatcaaatcctagacctgtatacggtctagcctcttttaaaattatttttttcccatcttcttttagcctagcattatatatcccaccactgtttgaaaatctaattgcattatctataataaagggaaagtctccctgttttttatctttcttgtcaagccatttattcaaaaagtcagggggcactataccttttggaattttaaatactggtaaacgttcatctttaacaacttcatcgccaacaattaattcatcaatagcaaccttcttttcatcatcccttgacggcctaaacacaccatacctcagatatattggtgcttcatcccaacgtttatcgcttaaaatatatggcccattatattgctttaaggcactttctaacctttgcaaaaccgactctaattcattttgatttggataacatgtaataaatttaccagaaaatcctcgactaaccaatttcccgtttcgcatgataaatttgtcttctgtactaagatgtttaaatggaattcgcatttcatggcaaatttttgctacatcttgtaacaattcatgtgaactgttatactctgaactaatgtgtattttccacccttgtctttcaacaaattttccaatagggtattgataaacccactcatcattattcattacttcgtgccaattaaaaggcagacttacttggtactttatgctagtatctgtactataatcattattagtgaaaaagaaaggatgctccaaattgaaattataatccataacaaaatctccaagaaattttatcaaacttaatatatctatagctagacagacttatttaaataaaaagggagaatcctttggattctccccatataagcactaacattccaacgtgcacatattggaacgacatccataactccagagaatctctaaagtttacaatttaaatgaattaacaattttcccaactaaaagcactccagttaccgcaacgatttgtactgaatgtactaaatcgcattccatcaacttcatctgtttcgtcaacttgaacagatactaattgaagatttaatacttcttctgccatagctagctcctcctatttaaatttttgggattaagtactttatccaccctcattatactctctccaccagtaaaatgcaagcaattatacaatgttgtcacatagaaaataatgtttccgtaacttttcaaagtaacttccatctctctcccaaaactggaagttagttttagaagttacctaaaaatcaggtcacctattttaaaaaagcagcaaactataaactagtaggttccacaccaaatgtagtcccatactgccccataagtcagatttatagcgcaccatacctaaaaacatcccaagtgaaacatacaaacaccaagctagaatggttcctgtatgatgtgctaaggcaaataaaacacttgtcaaagcaactctgatatctaattttctgaccaaattccataaaatttctcgatacagaaattcttcaaccatactcgcattgattaagaacaataaaaatgaaaaccaaggaatttgatgttgaaggccaattaagtttgcttgattcgtgcttccttgagcatgaatcagactaaaacatagacttataatcagtaggctaacaaattcaacaccaagccatttcatcctagatttcatattgaccttatgcgcttgtttgcgttggccatacatccataaaaaagaaatgagtgacgaaccatagagaatctgtagtatagttmactcaccgatacaaagaaatttcaataagtatagagrtaccaatasgacatttacttgttggaatatataaactggaattattcttttcatagttacctccgaaataaatcttcataatctaaatctaatacctgcacaatccttt

SEQ ID NO: 44 - DNA, 8657 bp; double-stranded, linear
aaagaaattgtcagagagtggctagatgaagtagcagagcgggctaaggactatccagagtgggtggatgttttcgagcgttgctacaccgataccttggacaatacggttgaaatcttagaagatggttcaacttttgtcttgactggggatattcctgccatgtggcttcgagattcgacagcccaactcagaccctaccttcatgtagctaaaagagatgccctcctgcgtcagaccattgcaggtttggtcaaacgtcagatgaccttggtactcaaggatccctatgctaactccttcaacattgaggagaactggaaagggcaccacgagactgaccacacagaccttaacggctggatctgggagcgcaagtatgaggtggattcgctttgctatcctttgcagttggcttatctcctctggaaagagactggcgagactagtcagtttgatgagatttttgtcgcagcgactaaggaaattctccatctgtggacggtggaacaagaccacaagaactctccttatcgttttgtccgagatacggaccgtaaggaagacaccttggtaaatgatggctttggacctgactttgcagtgacaggtatgacttggtcagcttttcgtccgagtgatgactgttgccagtatagttacttgattccgtcaaatatgtttgctgtagtagtcttgggttatgtgcaagaaatcttcgcagcattaaacctagctgatagccagagtgttattgctgatgccaagcgtcttcaggatgaaatccaagaaggaatcaaaaactacgcttacaccaccaacagcaagggcgaaaagatttacgcttttgaagtggatggcctaggaaatgccagcatcatggatgatccaaatgtaccaagtctactagctgcgccctatctgggctactgttcggtcgatgatgaagtgtatcaagctactcgtcgtaccattttgagctctgaaaatccatacttctaccaaggagaatacgcaagcggtctcggcagttctcataccttctatcgctatatctggccaatcgccctttctatccaaggcttgacaacaagagataaggcagagaaaaaattcttgctggatcagctggttgcctgcgatggtggtacaggtgtcatgcacgaaagctttcatgtagatgatccgaccctctactctcgtgaatggttctcctgggctaacatgatgttctgtgagttggtcttggattacttggatattcgctaaggggctcgctttagctcaaccgattcttatcagaatcacaagtttacatttaaaacgttaaaatttaaatttagaatgaggttttacttcatggaaaatgttgttgtacatattatctcacatagtcactgggatcgtgagtggtacttgccttttgaaagccatcgtatgcagttggtggaattgtttgacaatctctttgatctctttgaaaatgaccctgagttcaagagtttccacttggatggacaaactattgtccttgatgactacttacaaattcgccctgaaaatcgcgacaaggtccaacgctacattgacgagggcaaacttaaaattggtcccttttacatcttgcaggatgactacttgatctccagtgaagccaatgtccgcaataccttgattggtcaacaagaagctgccaaatggggtaaatcaacccagattggctactttccagatacctttggaaatatgggacaagcgcctcaaattcttcaaaaatcaggcattcacgtggcggcctttggtcgtggtgtgaagccgattggatttgacaaccaagtccttgaagatgagcagtttacgtctcagttttcagaaatgtactggcagggtgtggatggtagtcgtgttttaggtattctctttgccaactggtacagtaacgggaatgaaattccagttgacaaagatgaggccttgaccttctggaaacaaaaattgtcagatgtgcgtgcctacgcttcgaccaaccaatggttgatgatgaacggctgtgaccaccagcctgtacagaaaaatctgagcgaagccattcgtgtggcaaatgaactcttcccggatgtaatctttgttcatagttcttttgatgaatatgttcaagctgtagaaggtgcgcttcctgaacacttatcaactgttacaggcgagttgaccagtcaggaaacagatggctggtacacacttgccaacacttcttcatcccgcatttacctaaaacaagccttccaagaaaatagcaacctcctagagcaagtggtagaacccttgactattatcactggtggacacaaccacaaggaccagttgacctatgcttggaaaacacttttgcagaatgcgccacatgatagtatctgtggctgtagcgtggacgaagttcaccgcgagatggaaacgcgttttgccaaggtcaaccaagtaggaaactttgttaaaagtaacttgctcaacgagtggaagggtaaaattgctacggataaggctcaaagtgactatctctttactgtcattaacacaggcttgcatgataaggtcgatactgtcagcacagtgattgatgtggcgacttgtgatttcaaggaattgcacccaacagaaggctacaaaaagatggctgctcttatcttgccaagttaccgtgtggaggacttggatggtcgtcctgtagaggctacaatcgaagacctcggagctaattttgagtataatttaccaaaagacaagttccgccaagctcgtattgctcgtcaagtgcgcgtgaccattccagttcacctagcgccgctttcttggacaaccttccaattgctggaaggaaaacaagaacaccgtgagggtatttaccaaaacggagtgattgatacaccattcgtaacggtgagtgtggatgacaacatcacagtctatgacaagacaactcacgaagcctatgaagactttatccgctttgaagaccgtggggacatcggaaacgagtatatctatttccaaccaaaaggaacagagccaatctttgcagagcttaagggccacgaggtcttggaaaacacagcttgctatgctaaaatcttgctcaaacatgaattgaccgtgcctgtcagtgcggatgaaaagctagaagaagagcaacaaggtatcatcgagtttatgaagcgtgaggctggacggtcagaagaattgacaaacattcctctggaaactgagttgactgtcttcgttgacaatccacaaatccgcttcaagactcgctttactaacactgccaaggatcaccgtatccgtctcttggtcaagactcataacacgcgtccaagcaatgattctgaaagtatctatgaggtggtgacacgaccaaacaaaccagctgcttcatgggaaaaccctgaaaatcctcaacaccaacaagcttttgtcagtctgtatgacgatgaaaaaggggtgactgtatccaacaagggattgaatgaatacgaaatccttggggataacaccattgccgtgaccattttgcgtgcatcaggtgagctaggtgactggggctacttcccaacgccagaagcacaatgcttgcgggagtttgaagtcgagtttgcacttgaatgccaccaagcccaagaacgcttctcagcctatcgtcgtgccaaagccttgcagacaccgtttaccagccttcagcttgctagacaggaaggaagcgtggttgcgactggtagcctcttgagccattctgttctcagcataccgcaagtttgtccaacagcctttaaggtagctgaaaatgaagaaggctatgtgcttcgttactacaatatgtgtagtgaaaatgtacgtgtgccagaaagtcaacatctcttccttgacctacttgaacgaccatacccagttcattcaggactattggctccacaagagattcgtacagaattcatcaaaaaagaagaaatttaatttcaaaaagtaaacatcaaaagaaaggaggggcgaaaaagtaagaactaactgctgattcgccccttttatggtaaaaacaatgaccattgcaacgattgatatcggagggactgggattaagtttgccagtctgactcctgatgggaaaatactggataagacaagtatttcaacgcctgaaaacttggaggatttactagcgtggctagatcaacgcttgtcagaacaggattacagtgggattgctatgagcgttccaggtgcagtcaatcaagagacaggtgtgattgatggcttcagtgcggtgccctacatccatggcttttcttggtatgaggcgcttagctcttatcagctacctgtccatttagaaaatgatgccaactgcgttggactcagtgaactactagctcatccagagcttgaaaatgcagcctgtgtcgtgattgggacagggattggcggagccatgattatcaatggtagacttcatcgaggtcgccacggtctgggtggagaatttggctacatgacaacccttgcccctgctgaaaaacttaataactggtcgcaactagcatcaactgggaatatggtacgatacgtgattgaaaaatctggtcatactgattgggacggtcgcaagatttaccaagaggccgcagctggtaatatcctttgtcaagaagccattgagcgcatgaaccgcaatctggcgcaaggcttgctcaatatccagtatctgatcgatccaggtgtcatcagtctgggtggctctatcagtcaaaatccagattttatccaaggtgtcaagaaggctgttgaagactttgtcgatgcctacgaagaatacacggtcgcaccagttatccaggcctgcacctatcacgcagatgccaatctctacggtgctcttgtcaactggctacaggaggaaaagcaatggtaagatttacaggacttagtctcaaacaaacgcaagctattgaggttttaaaaggtcacatttctctaccagatgtggaagtggctgtcactcagtctgaccaagcatctatctctatcgagggtgaggaaggtcactatcaattgacctaccgcaaacctcaccaactttatcgtgccttgtccttgttggtaacagttctagcagaagctgataaagtagagattgaggaacaagcagcttacgaagatttggcttacatggttgactgttctcgaaatgcggtgctgaatgtggcttctgccaagcagatgattgagatattggctctcatgggctactcaacctttgagctttacatggaagacacttaccagattgaagggcagccttactttggctatttccgtggagcttattcagcagaggagttgcaggaaatcgaagcctatgcccaacagtttgacgtgacctttgtaccatgcatccagaccttggcccacttgtcggcctttgtcaaatggggtgtcaaggaagtgcaggagctccgtgatgtagaggacattcttctcattggcgaagaaaaggtttatgacttgattgatggcatgtttgccacgttgtctaaactgaagactcgcaaggtcaatatcgggatggacgaagcccacttggttggtttgggacgctacctgattctgaacggtgttgtggatcgtagtctcctcatgtgccaacacttggagcgcgtgctggatattgctgacaaatatggtttccactgccagatgtggagtgatatgttcttcaaactcatgtcagcggatggccagtacgaccgtgatgtggaaattccagaggaaactcgtgtctacctagaccgtctcaaagaccgtgtgactctggtttactgggattattatcaggatagcgaggaaaaatacaaccgtaatttccgcaatcatcacaagattagccatgaccttgcatttgcagggggagcttggaagtggattggctttacacctcacaaccattttagccgtctagtggctatcgaggctaataaagcctgccgtgccaatcagattaaagaagtcatcgtaacgggttggggagacaatggtggtgaaactgcccagttctctatcctaccaagcttgcaaatctgggcagaactcagctatcgcaatgacctagatggtttgtctgcgcacttcaagaccaatactggtctaacggttgaggattttatgcagattgaccttgccaacctcttaccagacctaccaggcaatctcagcggtatcaatcccaaccgctatgttttttatcaggatattctttgtccgattcttgatcaacacatgacacctgaacaggacaaaccgcacttcgctcaggctgctgagacgcttgctaacattaaagaaaaagctggaaactatgcctatctctttgaaactcaggcccagttgaatgctattttaagtagcaaagtagatgtgggacgacgcattcgtcaggcctaccaagcggatgataaagaaagtttacaacaaatcgccagacaagaattaccagaacttagaagccaaattgaagacttccatgccctctttagccaccaatggctgaaagaaaacaaggtctttggtttggatacagttgacatccgtatgggcggactcttgcaacgcatcaaacgagcagaaagccgtatcgaggtttatctggctggtcagcttgaccgcatcgacgagctggaagttgaaatcctaccatttactgacttctacgcagacaaggatttcgcagcaactacagccaaccagtggcataccattgcgacagcgtcgacgatttatacgacttaatattcttcgaaaatctcttcaaaccacgtcagcttccatctgcaacctcaaaacagtgttttgagcaacctgcagctagcttcctagtttgctctttgattttcattgagtataaaaacaagaacaccttgcttggcgcagggtgtttcgcgtgaaacagaagaattatctggtttcaaatgctacagttagacaaacttatgataaaatagcagaaagtgaatgtttcctaagagcaattggaggtattatgctacacttaaaattagtaaaacaagaaatagaagctgaaaagccagcatctgtagaagcttggatcatttccgtcaaatttaaaaaaggttgctaccgacatatatagattccaaaaacaaaaacgttagcggaactagcagatgtgattttatggagttttgattttgcaaatgatcatgctcacgcatttttcatggataatgttgagtggagtcatgcagattcttactttcgtagctttgttagtgacgatgttgaagaacgttacacagaaaatgtctatctggatagcctaagtgtcaaacaaaaatttaagtttattttcgacttcggtgatgaatggcgttttgaatgccaagtgctgagagaaatcgagacagaggacgaagaagcttatctcgtacgttcggttggaacgtcgccagaacaatatccagattatgatggttttgactatgaagaatggtaaaattgaaatcagtctgtgtaggcttagtatttcaatagacttcctgcaaaactagaatcctagttcatgattgataataccagcaatcaaattcattcgtaatccgaagcgtttacgatgatttcgataggttgttgaaaacattttaaacgtttttactttggcaaagatgttctcaaccttgcttctctccttagatagcgcatggttataggctttatcttcagctgttagtggcttgagtttgctggatttacgtgaagtttgtgcttgaggacatatcttcatgagcccttgataaccactgtcagccaagattttaccagcttgtccgatatttctgcaactcattttgaacaacttcatatcatgacaatagttcacagtgatatccaaagaaacaattctcccttgacttgtgacaatcgcttgagccttcatagcgtgaaatttctttttaccagaatcattcgctaattctttttttagggcgattgatttttacttccgtcgcatcaatcattaccgtgtcctcagaactaagaggagttcttgaaatcgtaacaccactttgaacaagagttacttcaacccattggctccgacggattaagttgctttcgtgaataccaaaatcagccgcaatttcttcataagtgcggtattctaggcttaatttaggttttcgtccaccttttgcgtgtttaagttgataagctgtttttaatacagctaacatctctttaaaagtcgtgcgctgaacaccaacaagacgcttaaatcgtgtatcagttaattgtttacttgcttcataatttcgcagggagtctattgactctttggtaggtgtcaatgtttttttcatctatcccgagaattattttcccgccatttgtatttgcaaatgctgagtaggtttcccagaaagactctggaagattgtttttagcttttttgtattctaaatcaaccccttcaaattttaagtccatatttttcctttacatctgttttttgtggttctggtatttgttcaagttgagtgataatatagcgaattgaatttcgagagtttttactcagttaatttcttttttaaccc

SEQ ID NO: 45 - DNA, 11384 bp; double-stranded, linear
tctattttgggtatagacttacctataaagaaaaatatctatacactgccttactagctatactgaacgagtcaacaaaaacgatatatattgatgatataaatacagcaagattttttaacttctttggcaatgatattcctaattcgtctttaaaaaaaattgactatatcgcaccttcagaaattgtttcatttagtacgtacgttcgacaacgttctaaagtaattcctaaaattttggaacatatattaaaatcaagttttttattagagaatatagatgtttctggttacactgtaaatattttagaagatcaattaacaaaacatagaacaatcaaaattagtaaaaactaactggttgatctcatgtataaatacctaacaaaaccacgcgccttgcctgctgatggaaagaaaggtacaaatacatgaatatcaaagaaaaaatcaaaaagaatggccaaagagtttattatgctagtgtttatctaggcgttgaccaactaacgggcaaaaaagcccgtacaactgttacagcaaccactaaaaagggcgttaaagtaaaagcgcgtgatgcgatcaatacttttgctgctaatggctatacagttaaagacaagccgacaattacaacatataatgagcttgtaaaagtttggtgggatagttacaagaatacagttaagccaaatactcgccaatccatggagggattggttagagtgcatttattgcctgtatttggcgattacaagctatctaaacttactacgcctattcttcaacagcaagtaaacaaatgggctgacaaggcaaataaaggcgaaaaaggggcatttgctaactactctttgctccataacatgaataagcgtattttgaaatatggcgtagctatccaggtaatacaatacaacccagctaatgatgtcatcgttccacgcaaacagcaaaaagaaaaggctgctgtcaaatacttagacaacaaagaattaaaacagtttcttgattatttagatgctctggatcaatcaaattatgagaacttatttgatgttgttctgtataagactttattggccactggttgccgtattagtgaggctctggctcttgaatggtctgatattgacctagaaagcggtgttatcagcatcaataagacactaaaccgctatcaggaaataaactcacctaaatcaagcgctggttatcgtgatataccaatagacaaagccacattacttttactgaaacaatacaaaaaccgtcaacaaattcagtcttggaaattaggccgatctgaaacagttgtattctctgtatttacggagaaatatgcttatgcttgtaacttacgcaaacgcctaaataagcattttgatgctgctggagtaactaacgtatcatttcatggtttccgccatacacatactactatgatgctctatgctcaggttagcccgaaagatgttcagtatagattaggccactctaatttaatgatcactgaaaatacttactggcatactaaccaagagaatgcaaaaaaagccgtctcaaattatgaaacagctatcaacaatttataaaaaataagggtgacccatttccgggctaccctcttactataccaaaaattagtaggggtagtaaaaagggtattaaattataaaaagcactaagggaaagcgccccaaagtgcttatttcaaaggctttatagcctataatcacataaagagattattttttaaggttgtagaatgatttcaatccacgatattcagctacttcaccaagttggtcttcgatacgaagcaattggttgtatttagcgatgcggtctgtacgtgaaagtgaaccagtcttgatttgtcctgcgttagttgcaactgcaatatcagcgattgttgaatcttcagtttcacctgaacggtgtgatacaacagcagtgtaaccagcttctttagccatttcgatagcttcaaaagtttcagtaagagtaccgatttggttaactttgataaggattgagttagcagcaccttcttggataccacgtgcaaggtagtcagtgtttgttacgaagaagtcgtcaccaacaagttgtactttcttaccaagacgttcagtaagagctttccaaccatcccagtcgttttcatccataccatcttcaatagtgatgattgggtatttgttaaccaattcttcaaggtagtcgatttgttctgcagatgtacgaacagcagcaccttcaccttcaaatttagtgtagtcgtaaactttacgttctttatcgtagaattctgatgaagcacagtcaaatccgataaatacgtctttacctggtacatatccagcagcttcaatcgcagcaaggatagtttcaacaccatcttcagttccttcgaaacgaggagcgaatccaccttcgtcacctacggcagtttccaaaccacgtgatttaaggattttcttaagagcgtggaagatttcagcaccgtaacgaagggcttctttaaatgttggcgcaccaactggcaagatcatgaactcttggaaagcgattggagcgtcagagtgagaaccaccgttgatgatgttcatcattggagttggaagaactttagtgttgaatccaccaagatagctgtaaagtgggatttcaaggtagtcagcagcagcacgagctacagcgatagacacaccgaggattgcattcgcacccaatttacctttgttaggagtaccgtcaagtgcgatcatagcacggtcaatagcttgttgatcacgtacatcgtagccaatgatagcttcagcaatgatgttgtttacgttgtcaacagctttttgtgtaccaagaccaccgtaacgagatttgtcaccgtcgcgaagttcaactgcttcgtgttcaccagtagaagctcctgatggaaccataccacgtccgaaagcacctgattcagtgtaaacttctacttcaagtgttgggttaccgcgtgagtctaggacttcgcgagcgtaaacatcagtaataattgacattttttactctccttatgagttaaattttttacacctctataataccttaaaacccctcctttttcaagaaaaaacgttatctttgtgcaacttttccttaactttataaagtaatcgctttcttttgtctgttttattctaacttttatgatatactgttttcatgacagatttatcaaaacaattacttgaaaaagctcatggtgggttaaaaataaatccggatgagcaaagacgctatcttggtacttttgaggaaagagttcttggatatgtagatattgacacagcaaatagccctcagttagaaaaaggctttttatttattttagaaaaccttcaggaaaaagcagagccactatttgtgaagatttcaccaactatcgaatttgataagcaagttttctacttaaaagaagcaaaagaaactgatagtcaagccaccatagtatctgaagagcatattacttctccttttggcctggttattcatagcaatgcaccagttcaagtagaagaaaaagaccttcgacttgcttttccaaaactttgggaagttaaaaaggaagaaccagccaaaacatccttatggaagaaatggtttagctaaatcttgcacatatttaataagtgcccaatattggcagccgtgcgctccagatagaaactggcatttttcaaactatcttctaaaggttcacttttctccaaaatagaaaagacagcttggatattttcaaatggtaggggaggtaaatcttcagcaagactaccgcaaatagcaataacaggaactccaacaggggttctttttgcaacacctataggcgctttcccagcaaagctttgactatcaagtcttccttctccaacaacaaccaagtcagcatctgaaactttcttatcaaagttgattaagtccaagcaggtatcaattccagacacgatacttgcctgagcaaaggcacacaaaccaccagcaaggcctccacctgctcctgctcctttaatttctaatgttgcaggtgagaatttttcataaaaatcttggatcgcctgatctacgactgcaaacatagtcggatgtagacctttttgattgccaaaagtgtaagtcgcaccttgatgaccacataagggactcacgacatctgctaaaatatgaatttgaacaccttcaggaattttatagcaattttctgttgaaacagaagctaagtttaataaggattgaccggaagcaggcaagacatttccatccctatcataaaattgataacctaaaccagcagcaatccccagtcctccatcattactggccgtgccaccaacaccgatataaatatctttaatccctttagagatgagatgaagaatcaactctccaataccacaagtttggatttgaagtggatttcgtttctctagcggaatttttccaagaccaaccaagtcagctacttcaaatagtgccagttcccctttttgaaaatagcgcatggcttctttttgtccaaaagggtctgtcacttggatccatttttcttttaggtcaagagaatgtcggatagcatctacagtaccttctcccccatcaccaacagggcagaggagacattctacatctgctatcgattgttggaagcctctttttattgcttcagctacctgttgagctgtcaagctttccttaaacgaatccggtgcaattacaatcttcatattttccctcattctaaacagtcaatcaaagggagaacttctaaaaaatccctcttgtcaacatgatgtggtatttcttttttgagcacttctttggcacaaaaggcgattcctaacttcgccgacttcaacattaatagattattaaccccatcaccgattgccaccgttctttctttagaaagttttagtttctttctccatttttccagagtctcttttttgacctggggacttataatttgtccaactaattttcctgttaaaagaccttctttgacttcaagctagttggcagtgaaataggcaataccaagggattttgctaatctctccaactattggtgtaaatccaccagacaccagaccaactaggatgccattcttttggagaatagagatgaactctgggacatttagcgatagatgaattgagttgaagacgttatcaaagaccaaaataggaagaccttccaacaaggacactctttttcttaaactgctttcaaagaccaactctcctcgcattgctcgacttgtaatctgcgaaatttccgcctcatgacctgcctctctccctaaaagatcaatcacttcttctaggattaaggttccatctacatccaaaacacacaagccttttacttgagacatcagttctcctctctaaacagcctaaaaatcgtatgaagtcatcatacgattttatctattaattaactaaactatggtacaagtcaaggtatgacttgcaggctgtatcccatgagaagtcactctccatagcttgtttttgtaggtttctccaaatgtctggatggtttctatacaagtccaatgctgtttggaaagtccaatttaaccaataaggagatagattgtcaaagctaaagccagtaccgcttccttcgattggattgaaagcgcgaactgtatctcgcaagcctccaacttcatggaccaatggcaaggttccataacgcatagccatcatttgagacaagccacacggttcaaaacgacttggcatgaggaagaggtcacaagcagcgtagatttcctgagcaagtttgacatcaaaagtgatatttgttgatagcttgtctgggtaaatctgagcaaaccatgagaaagctccttcaaaggctggatcgccagttcccaaaagaacaatctgaacatcttcttgcaagatatggtgaagactttcgaccaccacatcaaaacctttttgacgtgtcaaacgagaaacaattcccaccagtggaacgtctgctctaacaggcaagccaactctttcttgcaattttgccttatttttggctttcccagacaaatcttcctgattgaaatgatagtctaaaagagcatccgtctgaggattataaagatcagcatcaatcccattcacgataccagatactttaccagactccattttaagaatctgatccaaattacatccaaactgactagtcataatttcatgagcatagctaggtgaaacggttgaaacacggttcgcatagagaatacctgccttcatccagttcagacagttgttccatcgaagggtgccatcagcgtaacgttcaaagccaactccaaacaaatcacccaacattccttctgaaaattgtccttggaattctaaattatgaatggttaaaactgtttcaatgtcctcataggcttgaatccaacggtatttttccttcaacaagaaaggaatcatagctgtatggtagtcatgaacatggagaagatcaggaataaagtcaatcctttccatagcctcaatggcagccagttggaaaaaggcaaagcgttctccgtcatcaaaatcaccgtaaacatgaccacggaagaaataatattgattgtcaataaagtagaaggttacaccatttaatactgttttcttaattccacaatactgtctgcgccaaccaacgctcacctcaaaatgaagcacatcttcaatctgatttccaaatttagcctctaccatatcatagtagggtaaaatcactgcaacttcgtgcccagcttttaccagtgattttggaagagcgccaatgacgtctcccaaaccacctgtttttgaaaagggtgcaccctctgctgctacaaataaaattttcatgaatgaatatcctctgttactttagcacctttcttaaccacaactggatgttctgcagttcctcgaatcacaacaccatgctcaacttcaacccctttgtccaagatagcatattcgacctgagccccttctccaataacaacacgagggaagagcaggctatctttaaccaagctatccttatggacatgaatattacgtgatagaacagaattagctacttgaccttcaataatactaccagaggcaaactgagaagtgcttaccttagatgtattagcatagtaagttggctcttcgtttttgacctttgtataaatcttttggtttggtgagaaaagagaatagaatttttgtgattcaagcatatcgatattcgcttgataataagatttaacagagtgaatattggctagatagcccgtgtactcgtaggcgaaagctccctcttttacagccaaatcccgtaaaacatagcgcaatttctctggatgttcttttttagcttcttcttccaagtgttcaatcaaccaaggtgtatcaacgacaaagatatctgtagacatattgaacgtttcagctgttgacttgctatcaaagagtttatgagaaagaacatggtctgtttcatctacatccaagattgcatttacttctgaaatatctttcttagctagttttttataaactacagtgataggctcttttgttgtactatgtaggtggaaaacttggttcaaatcaatgttaataagaacatcgcagttgagggcaaccgtttggtttgagccagaacgtttcaaataagtaagaagctgttggtagtattcttttccaactgtactactttctacacgggtattgtaaattcctagatagtaatggctaagaagggttgataagccccactcgcgtcctgaacgaatatggtcaaatactgagctgatattatcctgctggaaaataccaaagacactacgaacacctgcattagcaaggcttgaaagtgggaagtcaatcaaacgatatttcccaccaaatggcaaacttgctactggacggtggtccgtcaatgtcgacatattgtgaaaaccaactgtatttcctaaaatggcagaatatttatcaatcttcatctgttgctacccccactacttcattatatcctacaacttgtacttcatctgttccatcaatttcgacaccgtcagaaataatcgcaccttcaccaataatggcacgtttaatcttagctccttgaccaatgatagctccactcatgataactgaatcaaggacttccgctccttcgcgaacttgcgcgcctgttgaaaggatagaatgtttaacagttccatcaacgaaacatccgtctacaactaatgagtcttccacatgagcatttgccccgaggaagtttggtggtgaaatcaagtttcttgagtaaatcttccattgacggttacgactatccaaggcattttctggagaaatatactccatgttcgcttcccaaagtgactcaatagtaccaacatctttccaataaccactaaattcgtaagcataaacactttcacctgactcaaggtaatttggaatgacatttttaccaaagtctgacatgccaaccttgctcttttcagcagcgactaacatattacgaaggcgttgccaatcaaaaatgtagattcccatagaagcttttgtagatttaggttgagctggtttttcttcaaattcaacaatacgattgttagcatctgtgttcatgataccaaaacggcttgcttctttaagagggacgtctaaaactgctactgtcaagctggcattattatccttatgagactggagcatatcatcatagtccattttgtagatgtgatccccagacaaaatcaagacatactcaggattgacactgtcgatatagtcgatattttggtaaatagcgtgactagtcccctcaaaccaacgatttccttcacttgcagaataaggttgaagaatagagacacctgaattaataccgtctagtccccagcttgaaccattcccaatatggttgttgagagcaagtggttgatactgtgtaacgaccccaacattgtgaatccctgagttggcacagtttgatagggcaaagtcaatgatacggtagcgcccaccaaattgcacagctggttttgcgatgctttgagtgagtttaccgagacgagttccttgcccaccagcaagaatcaaagctaacatttcatttttcattttctactcctttttggtttttatttgtgacggttttagtagatttcaagcgacgtttgattttccatacacttgctcccatagccggtagggtaaaggttaaggtctgctcataatctttccatagtccttcttgcgtttgaacagtttgattatgttctttccaaacgcctccccactcttccaactcagtattccatacttcttcgtaaattcctgcaacgggtagtccgattgtaaaatctttccgctcaacaggtaccatattaaagatacagactaacatttctccctttttacccttacgaataaaggaaagaacactctggtctcgattatccgcatcaatgatttcaataccatcatagctggtatcaatttcccacagacagcgatgatctttgtaaaactggtttagctgagaagcgaaatacttcatcttagcattcattgggtcttctaggttagaccattccaactgttcttcagatttccattctaggaattgaccgtattcgctacccatgaagagcaatttcttaccagggtgacaaatttggtacgtatagagattgcgcaagcctgcgaattgattgtaacgatctccccacatcttatgcatcatactcttcttgccatgaaccacttcatcgtgcgagaatggcaagagataattctccttgaaaacatacataaagctgaaagtcaccaggttaaagtcatatttacgatagatcggatcttcttcgtagaaacggaggatatcattcatccagcccatgttccatttgtagtcaaatcctagaccaccaatctctttcattcccgtaatcttgatcgcagacgaactttcttctgcaatcatcatcacatctggatattctaacttaataacctcattcaagcgctgaaggaaataataaccttcatagttgagatttccgccatctttattaggtgtccatggagcatcatcatagtccaaatagagcatgttgctaacagcatccacacgaataccatccaaatgatagacatcaatccaatgcttaatgcaagaaattaagaaggactggacttcattttttccaaggtcaaaattaagggcaccccaaccatggttatgagccttattatggtcttggtattcaaaagtcggtgtcccatcataataggctaaggcatcatcgttgatggtaaagtgactggtacccagtccacaataaccccaatattatgggtatgacactcctcgacaaaatcttgaaactcctctggtcggccataagcatgctctaaagcgaagtaacccataagctgatacccccaactcaagcccaaaggatgggacatcaagggcataaactcaatatgagtatagttcatttcaacgagataaggaatgagttcatccttgagctgggcaaaactataaggactgccatcagaatttcttttccatgatccagcgtgaacttcataaatattgacaggacgctcttcaaagccccaacgttttcttcgtgccagccaaagtccatccttccatttcttctcaggaagctctgttacgattgcccctgttcctggacgagcctcatacctgacagcaaaagggtcaatcttcatcagttgatgaccattttgacgtgtgacatgatatttgtaaatatgcccttcttgagccatattggtaaagacttcccagaccccaaaatcatttcttaccattggaatctgattttcaatccagttggtaaaatcaccaaccaagtgaacagcctgagcattaggtgcccaaacacggaaggtatagccatgctctccatttagttcttccctatgtgctcctagataatgttggagataaaaattttcacccgtcataaaggtttttaatgcttctctattatccatatactccccttctcctgtaagcgttttctatgtttttattatactacctttttagagaagattcaagtaaattactatacttctttaattattttgaaaatctacaacaagttcacttactcgttcaattgtaaatcaatattttttcaaaaaattgcgaaaacgcctttctttttctactatagtgaaatgaaataaaacatgcgcaaatcgattaaggaatttaatctaatttctaacaatgtcttagaaatcaaagtgtactattttaactcc

SEQ ID NO: 46 - DNA, 7577 bp; double-stranded, linear
tgttgatttgttactagacgttgaccaacgtccttcggctggaaaaggaattctccttagtttccaacacgttttcgccatgtttggtgcgaccatcttggtaccattgattttgggaatgcctgtatctgttgccctttttgcttcaggtgttggaacactcatctacatgattgctactggttttaaagttccagtttatctaggttcttcatttgcctttatcacagctatgtcactggctatgaaagaaatggggggggatgtatctgctgcccaaacaggggttatcttgactggtttggtctatgtccttgttgctaccagcatccgatttgtaggaacaaaatggattgataaactcttgccaccaatcattatcggtcctatgatcatcgttatcggtcttggacttgcaggttcagctgttaccaatgcaggtcttgtagcagacggaaattggaaaaatgctctggtagccgttgttactttcctaattgctgcctttatcaatacaaaaggaaaaggcttcctacgaatcattccattcctctttgccattatcggtggttaccttttcgcactaactcttggcttggttgactttacaccagttcttaaagccaactggttcgaaattcctggtttctacttgccatttagcacaggtggtgcctttaaagagtacaatctttactttggtccagaagccatcgctatcttgccaatcgctatcgtaacaatttctgaacatatcggagaccatactgttttgggtcaaatctgtggtcgtcaattcttaaaagaaccaggtcttcaccgtactcttcttggtgacggtatcgcaacttctgtttctgccttccttggtggaccagccaatacaacttacggagaaaatacaggggttatcggtatgactcgtatcgcttctgtctcagttatccgtaacgctgccttcatcgcgattgccctcagcttccttggtaaattcactgccttgatttcaactattccaaacgctgtacttggtggtatgtcaatccttctctatggggttatcgccagcaatggtttgaaagtcttgattaaagaacgtgttgatttcgctcaaatgcgaaacctcatcatcgcaagtgctatgttggttcttggacttggaggagctatccttaaacttggtccagttacactttcaggtactgccctttcagccatgacaggaatcatcttgaacttgatcttgccatacgaaaataaagactaagagtctaaatacacctaatccactcagacagctgagtggatttttcgtataccataataaaagtgtcttaacaaaattattaaaatcaaaaaacgtataatatcagatattctaaaaccttgatactgtacgttttatcatagaaatttttactttattttctcatcaaatgagatttgcatcaatctcttgtcttacttgcgtttcttcttcgctttcttcattttgttagccatacgtttcatggactgtttcatggcaaattcaccaattttacctttcaaaccgccaccaaacatctggctcatatctggcattcctgctcctccgagagctgataagtcaggcataccgccttgtcccatcattccttcaagggcagacatatccattcctcccatatttggcatatttttaggaaggttatttggattaatccccatttgcttcatcattttattcatatccccagacataacaccctgcatgagctgtttagcctggttaaagtccttgatgaatttattgacttcgacgaatgtatttccagaaccagcagcaatacgacggcgacggcttggatttaacaaatctgggttttcacgctcttcaggtgtcatcgaagacacaatggcacgtttacgagcaatctggcgttcatccaccttcatgttttgaagggctggattgttggccatacctggaatcatcttgagcaagtcttccatcggccccatattttgcacctgatctaattgatcgatgaaatcattaaaatcaaaggtgttttcgcgcatcttctcagccatttcaagggctttttgttcatcgtattcctgagaagctttctcaatcaaagtgagcatatcccccataccaaggatacggctagacatgcggtctgggtggaaggtttcaatgtccgtaatcttttcacctgtaccagtgaacttgattggttttccagtaatgtgacgaacagacagagcagcaccaccacgagtatcgccatcaatcttggtaaggatgaccccagtcacttccaactgagcattaaactcacgcgcaacattggctgcttcctgaccaatcatagcatcaacgacaagcaagatttcatttggttgagccaatgctttcacatcacgaagctcattcatgaggagctcatcaatctgcaaacgacccgcagtatcaatcaagacatagtcgttatgattagtttgggcttgctccaaaccttgacgtacaatctcaacagctggtacttctgttccaagtgcaaagacaggcacatcaatctgttgtcccaaggtcttaagctggtcaatggcagctggacgataaatatccgccgcaatcatcaaaggacgagcattttcttctttcttgagtttgttggccaatttaccagcaaaggttgttttaccagccccttgtaaaccaaccatcatgatgatggttggaatcttaggtgacttgataatttctgccgtatcagaacctaaaacggctgtcaattcctcatcaacgattttaataatctgttgcgcaggattaagtgtatcaatgacctcatgcccgactgcacgctcacgaactttcttgataaagtcctttacaacaggcaaggcaacgtcggcctcgagcaaggccaagcgaatttctttggttgcctcttggacatcagattcagagatttttccttttttacgtagatttttaaagacgttctgcaaacgttctgttaaactttcaaatgccatttttcttcctcttattctctattatcaatgcttgttaaaatttctatctgctcctgcagaaagtcatccttgggatagcgctccaaaatctgatcaaaaatctgactgcggacaatatagtccgagtacatgtgcaatttcatctcataatcttccagaatcttttctgttcgcttgatattgtcatagacagcctgacgactgacaccgaactcctcggcaatttcagcaaggctgtaatcatcagcgtagtagagctcgatataattcatttgcttatctgtcaaaagcgccgcataaaattcaaagagcgcattcatacgattggttttttcgatttccataacttttattataccaaaaattagcctaatctaccacactaggaagccgatccaagaagatagatagctaaatttgaaaaagacatgagcctagccccaagtaatttccaattgatagctggcaaagggatgtccctcttgattttgtagttgataatctagttcaatcttttgcctatcaacttgataatggctcgtttggatgataaactcctgcatgcccataggtgtaggaatataggctaaactatcgctatcctttagaaagcgcataatggtcttgggattagaaaatcggctcatcacaagttcttgaccatgaaatttaatcactactttttccttttcctcattatagaaaagcaggtagctataatctcctttttcatgcacttccacatcataaagctggtcaatcacttccaactgctcatcaaactgaatcgtatttcgcatccgaatcttcacatcaggccctctttcttgtctcttgtcctactattttaccaaaaagagcaggattttgctataatggtcatatgaacgaaaaagtattccgtgaccctgttcacaactacatccatgtcaataatcaaatcatctatgacttgattaatacaaaagaatttcagcgtttgcgccggatcaaacaactgggaacttccagttataccttccacggtggagaacacagtcgcttctctcactgtctaggagtctatgaaattgcacgacgcatcacagagattttcgaagaaaaatatcctgaggaatggaatcctgccgagtctctcttgaccatgaccgctgctctcctacacgaccttgggcatggtgcctactcccatacttttgaacatctctttgatacagaccatgaagccattactcaggagattattcaaaatcctgagacagagattcaccaagtcctgctacaagtggcacctgatttcccagaaaaggtggccagtgtcattgaccatacctatcctaataagcaggtcgtgcagctcatttctagtcagattgacgcagatcgcatggactatctcttgcgcgactcctattttacaggagcatcctatggggaatttgacctgactcgaatcctccgagtcattcgtcctatcgaaaatggtatcgcctttcagcgcaatggcatgcacgccatcgaagactacgtcctcagtcgctaccagatgtacatgcaggtttatttccaccccgcaacacgcgccatggaagttctcctacagaatcttctcaaacgcgccaaggaactctatcctgaggacaaggatttctttgcccgaacttctccacacctcctgcctttcttcgaaaaaaatgtgaccttgactgactatctggctctggatgatggcgtgatgaatacctacttccagctttggatgaccagtcctgacaagattcttgcagatttatcgcatcgctttgtcaaccgcaaggtctttaaatccattaccttttcacaagaggaccaagatcaacttactagcatgagaaaattggttgaggatatcggctttgatcccgactactacactgccattcataagaactttgacctcccttatgatatctatcgtcccgaatctgaaaacccacggacacagattgagattttacaaaaaaatggagaactggccgaactctctagcctgtctcctatcgtccaatcccttgctggcagtcgccacggagataatcgcttttattttccaaaagaaatgttggaccaaaacagcatctttgcaagcattacccagcaatttttacacttgattgagaacgatcattttaccccaaataaaaactagaagaggaaatttatgagtattaaactaattgccgttgatatcgacggaacccttgtcaacagccaaaaggaaatcactcctgaagttttttctgccatccaagatgccaaagaagctggtgtcaaagtcgtgattgcaactggccgccctatcgcaggcgttgccaaacttctagacgacttgcagttgagagacgagggggactatgtggtaaccttcaacggtgcccttgtccaagaaactgctacaggacatgagattatcagcgaatccttgacttatgaggattatctagatatggaattcctcagtcgcaagctcggtgtccacatgcatgccattaccaaggacggtatctatactgcaaatcgcaatatcggaaaatacactgtacacgaatcaaccctcgtcagcatgcctatcttctaccgtacccctgaagaaatggctggcaaagaaattgttaaatgtatgtttatcgatgaaccagaaattctcgatgctgcgattgaaaaaattccagcagaattttacgagcgctactccatcaacaaatctgctcctttctacctcgaactccttaaaaagaatgtagacaagggttcagccattactcacttggctgaaaaactcggattgaccaaagatgaaaccatggcaatcggtgatgaagaaaatgaccgtgccatgctggaagtcgttggaaaccccgttgtcatggaaaatggaaatccagaaatcaaaaaaatcgccaaatacatcaccaaaacaaatgacgaatccggcgttgcccatgccatccgaacatgggtactgtaaaagtatcatttttcaataagaattgattagcaataaaatccaatgaatttttttagcaaactatttaatttaaaacaaaataatcataatagagacacaaattctgattgtaacaatttttacctaaacgaattagaatgtggccttactcctgggcaactcatactcatagattggactcaaaaaacagggagaaattataatttcccaagatattttaaatactctcttcaaattgaccctgaatctacacacaatcaattatacaaattaggatacttcactaaaaataagactttatcatatcttacagtagtagaattaaaaactatattatctaaacataatttagctacttctggaaaaaaagcagaattaattacaagaataattaataatgttaacattgacaatttagatattccgttcgaatttaaactaacaaaagaagcacaaaatcttattatcgaacatagtgactatatcaaagcatactatgataaagacataactatggaagattattgtaaagaaaaaaacaatatctcttttaaagcaacttttggtgatataaaatggagtctcttaaataaacaagctcataggaatactgtatcaggagattttggatgcttatctaacacacgaaaggctcagggaagacatttggaacaagaaggtaatattaaacatgctttaatatattacatagaatctttgataattactatttcaggattagaaaacaatttttcagccactgattatccagtatattatcccgattcgatacctgactactcactaaaacatattcaaacattaatggaatcattatctgatgacgattatgattttgcttttgatgaagcattatttcgcttctcaattttgaatgcaaatcattttttatctaaggaagatattgactatttaagagttaatttacctcgttccactgctgaagaaataaacaattacttaaagaaatatgaatgttatagtcctttaaataatttagaacttgacgattttgaataaattgactatacaaacatttatatactcgatatagtctcaattttatctgatgattgcccaaatttttcaataataaaacgcataatattatggagacaatcccctatattatgcgttcttttaatatcaaagactttttgacaaacttctttgatatctaattacatgccccctgcaggaatcgaacctgcaactactccttaggagggagttgttatatccattgaactaagggagctagataaaaactctgctaaatgagcagagttttttagtcgaattaacgacggatttctttgatacgagctgctttaccttgaagagcacgcaagtagtacaatttcgcacgacgtactttaccgtaacgaacaacttcgattttttcaacacgtggagtgtggattgggaagatacgctcaacacctacaccgttagagattttacgaactgtgtagttttctgagattccagcacctttacgtgcgataacaacacg

SEQ ID NO: 47 - DNA, 4945 bp; double-stranded, linear
cctcgctgatgattggtgctgttttatttgctggtccagccttggctgaagaaactgcagttcctgaaaatagcgganctaatacagagcttgtttcaggagagagtgagcattcgaccaatgaagctgataagcagaatgaaggggaacatgctagagaaaacaagctagaaaaggcagaaggagtagcgatagcatctgaaactgcttcgccagcaagcaatgaagctgcaactactgaaactgcagaagcagctagcgcagctaaaccagaggaaaaagcaagtgaggtggttgcagaaacaccatctgcagaagcaaaacctaagtctgacaaggaaacagaagcaaagcccgaagcaactaaccaaggggatgagtctaaaccagcagcagaagctaataagactgaaaaagaagtccagccagatgtccctaaaaatacagaaaaaacattaaaaccaaaggaaatcaaatttaattcttgggaagaattgttaaaatgggaaccaggtgctcgtgaagatgatgctattaaccgcggatctgttgtcctcgcttcacgtcggacaggtcatttagtcaatgaaaaagctagcaaggaagcaaaagttcaagccttatcaaacaccaattctaaagcaaaagaccatgcttctgttggtggagaagagttcaaggcctatgcttttgactattggcaatatctagattcaatggtcttctgggaaggtctcgtaccaactcctgacgttattgatgcaggtcaccgtaacggggttcctgtatacggtacactcttcttcaactggtctaatagtattgcagatcaagaaagatttgctgaagctttgaagcaagacgcagatggtagcttcccaattgcccgtaaattggtagacatggccaagtattatggctatgatggctatttcatcaaccaagaaacaactggagatttggttaaacctcttggagaaaagatgcgccagtttatgctctatagcaaggaatatgctgctaaggtaaaccatccaatcaagtattcttggtacgatgccatgacctataactatggacgttatcatcaagatggtttgggagaatacaactaccaattcatgcaaccagaaggagataaggttccggcagataacttctttgctaactttaactgggataaggctaaaaatgattacactattgcaactgccaactggattggtcgtaatccttatgatgtatttgcaggtttggaattgcaacagggtggttcctacaagacaaaggttaagtggaatgacattttagacgaaaatgggaaattgcgcctttctcttggtttatttgccccagataccattacaagtttaggaaaaactggtgaagattatcataaaaatgaagatatcttctttacaggttatcaaggagaccctactggccaaaaaccaggtgacaaagattggtatggtattgctaacctagttgcggaccgtacgccagcggtaggtaatacttttactacttcttttaatacaggtcatggtaaaaaatggttcgtagatggtaaggtttctaaggattctgagtggaattatcgttcagtatcaggtgttcttccaacatggcgctggtggcagacttcaacaggggaaaaacttcgtgcagaatatgattttacagatgcctataatggcggaaattcccttaaattctctggtgatgtagccggtaagacagatcaggatgtgagactttattctactaagttagaagtaactgagaagaccaaacttcgtgttgcccacaagggaggaaaaggttctaaagtttatatggcattctctacaactccagactacaaattcgatgatgcagatgcatggaaagagctaaccctttctgacaactggacaaatgaagaatttgatcttagctcactagcgggtaaaaccatctatgcagtcaaactatttttcgagcatgaaggtgctgtaaaagattatcagtttaacctaggacaattaactatctcggacaatcaccaagagccacaatcgccgacaagcttttctgtagtgaaacaatctcttaaaaatgcccaagaagcggaagcagttgtgcaatttaaaggcaacaaggatgcagatttctatgaagtttatgaaaaagatggagacagctggaaattactaactggctcatcttctacaactatttatctaccaaaagttagccgctcagcaagtgctcagggtacaactcaagaactgaaggttgtagcagtcggtaaaaatggagttcgttcagaagctgcaaccacaacctttgattggggtatgactgtaaaagataccagcctaccaaaaccactagctgaaaatatcgttccaggtgcaacagttattgatagtactttccctaagactgaaggtggagaaggtattgaaggtatgttgaacggtaccattactagcttgtcagataaatggtcttcagctcagttgagtggtagtgtggatattcgtttgaccaagccacgtaccgttgttagatgggtcatggatcatgcaggagctggtggtgagtctgttaacgatggcttgatgaacactaaagactttgacctttattataaagatgcagatggtgagtggaagctagctaaggaagtccgtggtaacaaagcacacgtgacagatatcactcttgataaaccaatcactgctcaagactggcgcttgaatgttgtcacttctgacaatggaactccatggaaggctattcgtatctataactggaaaatgtatgaaaagcttgatactgagagtgtcaatattccgatggccaaggctgcagcccgttctctaggcaataacaaggtacaagttggctttgcagatgtaccggctggagcaactattaccgtttatgataatccaaattctcaaactccgctcgcaaccttgaagagcgaagttggaggagacctagcaagtgcaccattggatttgacaaatcaatctggtcttctttattatcgtacccagttgccaggcaaggaaattagtaatgtcctagcagtttccgttccaaaagatgacagaagaatcaagtcagtcagcctagaaacaggacctaagaaaacaagctacgccgaaggggaggatttggaccttagaggtggtgttcttcgagttcagtatgaaggaggaactgaggacgaactcattcgcctaactcacgcaggtgtatcagtatcaggttttgatacgcatcataagggagaacagaatcttactctccaatatttgggacaaccggtaaatgctaatttgtcagtgactgtcactggccaagacgaagcaagtccgaaaactattttgggaattgaagtaagtcaggaaccgaaaaaagattacctagttggtgatagcttagacttgtctgaaggacgctttgcagtggcttatagcaatgacaccatggaagaacattcctttactgatgagggagttgaaatttctggttacgatgctcaaaagactggtcgtcaaaccttgacgcttcattaccaaggccatgaagttagctttgatgttttggtatctccaaaagcagcattgaacgatgagtacctcaaacaaaaattagcagaagttgaagctgctaagaacaaggtggtctataactttgcttcatcagaagtaaaagaagccttcttgaaagcaattgaagcggccgaacaagtgttgaaagaccatgaaactagcacccaagatcaagtcaatgaccgacttaataaattgacagaagctcataaagctctgaatggtcaagagaaatttacggaagaaaagacagagcttgatcgcttaacaggtgaggttcaagaactcttggctgccaaaccaaaccatccttcaggttctgccctagctccgcttcttgagaaaaacaaggccttggttgaaaaagtagatttgagtccagaagagcttacaacagcgaaacagagtctaaaagatctggttgctttattgaaagaagacaagccagcagtcttttctgatagtaaaacaggtgttgaagtacacttctcaaataaagagaagactgtcatcaagggtttgaaagtagagcgtgttcaagcaagtgctgaagagaagaaatactttgctggagaagatgctcatgtctttgaaatagaaggtttggatgaaaaaggtcaagatgttgatctctcttatgcttctattgtgaaaatcccaattgaaaaagataagaaagttaagaaagtatttttcttacctgaaggcaaagaggcagtagaattggcttttgaacaaacggatagtcatgttatctttacagcacctcactttactcattatgcctttgtttatgaatctgctgaaaaaccacaacctgctaaaccagcaccacaaaacacagtccttccaaaacctacttatcaaccgacttctgatcaacaaaaggctcctaaattggaagttcaagaggaaaaggttgcctttcatcgtcaagagcatgaaaatactgagatgctagttggggaacaacgagtcatcatacagggacgagatggactgttaagacatgtctttgaagttgatgaaaacggtcagcgtcgtcttcgttcaacagaagtcatccaagaagcgattccagaaattgttgaaattggaacaaaagtaaaaacagtaccagcagtagtagctacacaggaaaaaccagctcaaaatacagcagttaaatcagaagaagcaagcaaacaattgccaaatacaggaacagctgatgctaatgaagccctaatagcaggcttagccagccttggtcttgctagtttagccttgaccttgagacggaaaagagaagataaagattaaatatcgaaaaatcttgtgaaatctttccg

SEQ ID NO: 48 - DNA, 25002 bp; double-stranded, linear
gacaactcaagtagctttttcttattttgaaaaaggagatcagagtttaactatgtcagaaaaatcacaatgggggtcgaaacttggttttattctagcatctgctggctggccatcgggcttggttccgtttggaagtttccctacatgactgctgctaatggcggtggaggctttttactaatctttctcatttccactattttaatcggtttccctctcctgctggctgagtttgcccttggccgtagtgctggcgtttccgctatcaaaacctttggaaaactgggcaagaataacaagtacaactttatcggttggattggcgcctttgccctctttatcctcttatctttttacagtgttatcggaggatggattctagtctatctaggtattgagtttgggaaattgttccaacttggtggaacgggtgattatgctcagttatttacttcaatcatttcaaatccagccattgccctaggagctcaagcggcctttatcctattgaatatcttcattgtatcacgtggggttcaaaaagggattgaaagagcttcgaaagtcatgatgcccctgctctttatcgtctttgtttttatcatcggtcgctctctcagtttgccaaatgccatggaaggggttctttacttcctcaaaccagacttttcaaaactgactagcactggtctcctctatgctctgggacaatctttctttgccctctcactaggggttacagtcatgttgacctatgcttcttacttagacaagaaaaccaatctagtccagtcaggaatctccatcgtagccatgaatatctcgatatccatcatggcaggtctagccattttccaagctcgatcccccttcaatatccagtctgaagggggacccagcctgctctttatcgtcttgcctcaactctttgacaagatgccttttggaaccattttctacgtcctcttcctcttgctcttcctttttgcgacagtcactttttctgtcgtgatgctggaaatcaatgtagacaatatcaccaaccaggataacagcaaacgtgccaaatggagtgttattttaggaattttgacctttgtctttggcattccttcagccctatcttacggtgtcatggcggatgttcacatttttggtaagaccttctttgacgctatggacttcttggtttccaatctcctcatgccatttggagctctctacctttcactttttacaggctatatctttaaaaaggctcttgcaatggaggaactccatctcgatgaaagagcatggaaacaaggactgttccaagtctggctcttccttcttcgtttcttcgtttcgtcattccaatcatcatcattgtggtcttcattgcccaatttatgtaatcaaaaaggacttgagtagtgaactcaggccctttctttttatggatggctaacaatcaattccaaaccttgcccttccagagtccaagcttcaacatcacttggtaggataaagtggctgcctttttgaattggataatttttcccgtcaacagttagctgaccttgaccagccaagacactcaataagctgtagtcagctgtcttttcaaagtcaacttttccagtaatttcccacttgtaaactgcgaagaaatcattagatacaaggagagtggaacgcaaatcatctgctttaacagttacaggacggctatttgctggctcaccaatgttcaagacatcgatggatttttcaagatgaagttcacgcaagttgcctttgtcatccttgcggtcaaagtcatagacgcgataggtggtatcgctagactgctgggtttcaaggattaagatacccgccccgatagcgtgcatagtcccgcttggtacatagaagaaatctccagccttaacagggactttggtcaacaagtcatcccagttcttgtcctcgatttgctggcggagttcttcttttgacttggcattgtgaccgtagataatctctgaaccttcatccgctgcgataatgtaccagcattctgtttttccgagttcgccttcatgctcgagtccataagcatcgtctgggtgaacttggacactgagccagtcgttggcatcgaggatcttggtcaaaagtggaaatacaggttctggacgattgccaaataattcacggtgttccgcatacaaagtagcaagatctgttccctcgtaacgaccattggcaactttagagactccatttggatgggctgagatggcccaatattctccgattttttcacttgggatgtcgtagccaaactcatcacgtagcttggctccaccccagattttttcttgcataactgattgtaaaaataatggttctgacatgtcgatctcctgtctgatttttctcccctcattatagcaaaaaaagagttcgaattgaactcttttttacatcttataaagcagggagaagattttataaaaatagtaaacaaatgtgctctacccgatgcttgcaccattgctataaatgacatccttgtaccaatagaaggacttcttcttgctacgtttgagagctccgtttcctacattatctcgatctacatagataaagccatagcgcttattcatttcccctgtgccagctgaaaccggatcgatacagccccaagtcgtataaccaagcaagtcaaccccgtcttggtaaatggcatctcgcatggccttgatgtgggcctctaagtaagtaatccgatagtcatctgctacataaccattctcatccggtgtatccatagcaccgagtccattttctacgataatactaaactaaaatcaaaaagcattatataatagtgatatgaaatcaactaaagaagaaatccaaaccatcaaaacacttttaaaagactctcgtacagctaaatatcataaacgccttcaaatcgttctatagtaaaatgaaataagaacagtacaaatcgatcaggacagtcaaatcgatttctaacaatgttttagaagtaggggtgtactattctagtttcaatctactatatttcgtctgatgggcaaatcttataaagagattatagaacttttatagtagtttgaaataagatgtgaacaactctatcaggaaagtcaaattaatttatagaaatattttagcagccaaggtgtactgttatagattcaatacactatagactgtaatcaaacaacgatttggcgaaatgtaaaaaaatatgaggagttcggactcgactctctccttcaagaaacacgtggtggtcgtaaccatgcatatatgacagttgaggaagagaaagcctttcttgcccgccatttgaaggctacagaggcaggagaatttgttacaattgatgccttatttcaggcttataaaaaggagttaggtcgttcctacacacgtgatgccttctatcaactgttgaagcgccatggttggcgaaatattacgccacgtccagaacatcctaagaaagcagacgctcaaaccattgttgcgtctaaaaataaaatctcaatccaagaaggcaagaaagcgttttaaatatagtagacgttttcgtaaggtttgcttgatgtaccaagctgaagctggtttcggtagaatcagtaaactgggatcttgttgggctccaataggagtaggtccacatatccatagtcactatatacgagaatttcgctattgttatggagctgttgatgcctatacaggcgaatcatttttcttaatagctggtagatgtaatactgagtggatgaacgcctttttagaagagctttcacaagcttatccttttactcgttatggacaatgctatatggcataaatcaagtaccttaaagattccgactaatattggttttgcatttattcctccatacacaccagagatgaaccccattgaacaagtgtggaaagagattcgtaaacgtggatttaagaataaagcctttcgaattttggaagatgtcatgaatcaactccaagatgtcatacaaggattggagaaggaggtgataaagtccatcgttaatcggagatggactagaatgctttttgaaagcagatgagtattatatgcaatttctttatataaaaagaccggattgctccgatctttcaatagttcatattctcaatttctattttaaaaatagctaaggttaacgtcaaatgactacgcgacctatttcatacgataaaaatcaagcactagaccagcaggtccttgaactaataaggactctgttccccaatcggttacagttggtccgtgtaaaacctttataccaagctcgttcaaccgtttgtagttctggtctacatcctcaacctcgatatgaataatgattcctgactgaaagttttccaaaggaaccaaatgattttgtgacaacataaggcagtgactaccaatcgtaaactgagcaaaaccatcattagcataatctgcctttttatccaagatatgctccaagtcagcacagacttggggaacatttgaaacgataatatctaattgatttaaattcatttactctcctccataaaaagaccggattgctccgatcttttaaagttctgctctatgaaaatcaaagaataaagtctacaagtttcatatttgattttcggcgagaggaattatttaattgcgcgtgattgcaatccttcttcttccaagaagagacggaatggtacgagttcttctgcttcgtatttttccttgaaggctttgatagcttcttctgagtgaagttttggatccaattcaagtacttctactggaagtggacggtgttgagtgatgcgagcatcgatgacaacagttttaccttctttgttcaatttaacagcttctgcaacaactgcatcgatgtcttcgatacggtcaactgtgaatccaacagctccttgagcttccgcaattttagcgtagtcagcgtttgtgaagtctacaccaaacaagtgtttgtttgtatcttcgtatttgttcttgatgaagccgtactcagcatttgagaagacaaggttgataactggaaggtcgtattgaacgtttgtgataacgtctgggtagcacatgttgaatgctccgtcacccatgatgttccatacttggcgatctggattgtctttcttagcagcgataccaccaggaagggcaatacccattgtcgcaaagagtggagatgtacgccacatgttcttaggtgtcatgtgaaggtgacgagtagatgtttgagtagtgttacctacgtcgattgagtagatagcgtcttgatcagcatgtttgttgattgcattgtaaacttgatacaattgcaattcaccctcagttttaccttcgagtttgttcatgtaatcacgccagttttggttgttcttaacgtttgcacgccaccatggagttgattcaactgggtttactttgtcaaggatagctttagctgcttgaccagcatcaccaaggattgaagcgtcaagggcatgacgtttaccaagtttgtaagggtcgatatcgacttggatgaatttttcagtgttcttgaatgcttcgtaaacttcagcaaatgggaagtttgaaccaaggaaaagaactgtgtctgcttcaaagaccacttcgttggctggtttccaaccaacacggtaagcagaacctgtcaaaccttcatagttccattcgaaagcttcaaagtttttaccagttgtgatgattggtgctttgattttacgtgacaattcagtaatcacttcaccagctttaacaccaccaaatccagcatagataactgggcgttcagcattgttcaagatttcaacagctttgtcgatttcaacttcgttcaaagcaggagcgatgaatgagcgttcgtatgaacctgaaccgtagtatgagttttcatcgatttcttggaaaccgaagtttactggaatttcaacaacagctggaccttttttagaaactgcagcacggcaggcttcgtcaattacttttggcaattgctcagcgtaagctacacgtttgttgtaaacagcgataccgttgtacattgggttttggttaagctcttggaaagcatccatgttcaattcgttaactggacgtgatccaaggatcgctaggaatggagtgttatccatagctgcatcgtaaacaccgttaatcaagtgagtcgcacctggaccacctgaaccaactgcaaccccgattgagccgccgaatttagcttgcataaccgctgcaagagcacctgtctcttcgtggcgaacttgtaagaaacggatatctttgtcttcagccaaagcgtccatcaatgagctgagtgttcctgatgggataccgtagattgtatctacgccccatgttttcaatacgttaagcattgctgcagatgcagtaattttcccttgagtcataatgataactctccttcaatttttttaaacttggagaatacgattacatagaattggaaacgttctccaaatttttactattccactgtatcatatttatgctgacttttctaaaaatctgctcaaaactctctattctctattctaatacagttttgaaagttctgtcatttctgttttataacaaagaaatctagtcattacttttagtctattttactaaaatttaacagaagggaactggtcagaacagatacagaactaaaggccatggctagacctgccaattctgggttgagagccagtccaacacctgaaaagactcctgctgcaatcggaattccgacaacattgtagataaaagcccagaaaagattgagtagaattcgatgaaaggttttcttactcatatcaaaggcacgaaccactcctaaaagattattggttgtcaacaccaaatctgctgactcgatggcgatatctgttccagctcccatagcaatccccacatctgctacactaagggcaggagcgtcattgataccgtccccaacaaaggctactttccctgactgttgcagtttatggatttcatgggctttttcttctggcaagacgcctgcaatgacctcttcaattccgatttgatctgcaatagcacgcgccacaccagcattgtctcctgtcagcatgactgttcggagaccacgtttttttagctgactgatggctagcttagcattttccttaggaatatcttgcaaagcaagcaagcctttgatttcattgtcaacagctaagaacacaactgtcttagcttctttttctagttcttctagtttatcttgataagtattagaaatatccatgccatccagcattttagcatttccaagtaaaacttgttttccattgattcgccctgaaacacctttcccgtgcaaggactgaaaattttcaacagtttgaaactcaagtccagcttcactcgctcgcttaacgatagcctcagccagtgggtgttgagaagcatcttccaaggaggctgccaacccaaacacttctacttcgtcgccgatgacatctgttaccacaggtttcccttccgtcaaagtcccggtcttatcaaagacaagggtttgaactttctggatttcctgtaagacagttccatttttgaggagaacccccatcttggcactacgtcctgtccccaccataagggctgtcggtgttgcaagtcccaaggcacaaggacaggcgataatcaaaaccgccactccgtagagaagagaggacacaaagctagctccaagcacaaccacactatccctgagcaagacgaaccaaacccaaaaggtcatgattcctaaaatgacaactactgggacaaaaatccctgaaatcttatccgtcaagtcctgaatcggcgcacgacttgtctgagctttcttcacaaaatccacaatctgagccaaaacagtctctgagccaactttttctgctctaaagacaagcgttccactatgattgatggttgagccaatgacagtatctccaactgtcttgtccacaggcagactctcacctgtcaccatggattcgtcaatactagagacaccttctactacgacaccatcaacagcaatcttttcaccgggacgcactcgaatcaggtcgcctaccttgacttgttccaaaggaacttggacataactatcatcactcaagacttctgcggttttagcttgcaagtccagtaatttctccacagcttgggacgtattttttctcattttttcctcaaaaactgctcccaaaagaacgaaaaagaggataaatccagcactttcgaagtaaacagggagaccagcaaagagagcaactaggctatagaaataagccactagagttcccagcgcaaccaaggtatccatgttggcattgtgctttttaaaactggcccaagcactctggatatatggcttacctgcaactaacataataggcgttgttgctagaaaggttccccaatgcatgacttgatgactaatgctacctgtcaacatcccaatcatgagaatcacaagaggcacagtaaagatactagtaatccaaaaacgttgcaggagagatagagattttcgagtcttctcaacgactgtatagcttcccttttgcatcttcatgccacaagaaaattcatgtcgccctaattcttgaggcgtaaaacgaatgactttctcctcatctacgccgattggttccaagataccttcttcttcaaacagaatttccttataacagtttgaaggagtagcacgatgaaaggtaatctcagctggaattcccttttgaagctggatatgggctggatgatagcctttttcagctcggatacggattttttgaatgccattttctaagcttgctttcacaatttctgtcatagtctccacctactctacaatcatcttgccgtgcatcatgttcataccacaagcaaagccaaactctccagcctgttcaggcgtgatttccactacatactcttcccccattggcaggttcgcatgtacaccaaaatctggaaaaacaatttgatccagacatggtgaaggatccttgcggtcaaagacaatgcgtgctggcactgatttcttgaggacaatcaactcaggagtatagcctcccatgacttccactcgaatctcttggtatccgtttttttgctgggctttttgtccagatttttcaggctttttgaaaaaccaaaacaagataaacgcgataagggcaatacaaataatggttacaatactatttaacatgacgtctcctttacatacaattacatcttacttctgttacagcacttgatttcttctctgaaatcacagcttccaagtcttccaagtcagtctgagtaaattcacattctacaatcaagtcagccaacaaattcctaatcctacgggaacaaaccttgtctttgatatcttggacaagtaaatcccgactttggtctagagttaaaagggctgaataaacaaaggacttgccttcttttttccgagtcaaacactctttatcaaccagacgagccaaaagtgtctgaaccgtggacttggaccagtcaaaccgctctgccaaaaccctaatcaaatctgtactggtctgctccccctgcatccaaataatcttcatgacctgccattctgcatctgaaatctgcattaccatacctccaaaatctacatttgtcaattacactcatcagtatactcttaaaatctacatttgtcaattatagaaataatattttcttcgaaaaatagaattttaatcatttgaaaaacgatttgcagtcaaatattactatataaacaataaaaatatgctatactaaagaaaaaagaaaacaaccactaggggtgcgtaaagctgagattaacgactgttagatccctctgactcaatctaggtaatgctagctgatggaagtggaaatgataatggggactagcagtcttctattgcctttctaaaacagactagcttgttcttaagaatacaaacttcagttggttgggaggttttagatgacttatttacccgttgctttgaccattgcagggactgaccctagtggtggtgctggcattatggcagatttaaagtcattccaagcgagagatgtctatggaatggctgttgtaaccagtcttgtcgctcaaaataccagaggtgttcagctaatcgagcacgtttctcctcaaatgttgaaagcccaattggagagtgtcttttctgatattccacctcaggctgtaaaaactggaatgttggctactactgaaatcatggaaatcatccaaccctatcttaaaaaactggattgtccctatgtccttgatcctgttatggttgctacaagtggagatgccttgattgactcaaatgctagagactatctcaaaacaaacttactacctctagcaactattattacgccaaatcttcctgaagcagaagagattgttggtttttcaatccatgaccccgaagacatgcagcgtgctggtcgcctgattttaaaagaatttggtcctcagtctgtggttatcaaaggcggacatctcaaaggtggtgctaaagatttcctctttaccaagaatgaacaatttgtctgggaaagcccacgaattcaaacctgtcacacccatggtactggatgtacctttgctgcagtgattactgctgaactagccaagggcaagagtctttaccaggcagttgataaggccaaggcctttatcacaaaagctattcaagatgcccctcaactcggtcatggttctggtccagtcaaccatacaacttttaaagattaagaaaaaaaactctctagttcccactttaagggaattagagagtttttatactcttcgaaaatctcttcaaactacgtcagcttccatctgcagcctcaaaacactgttttgagctgacttcgtcagtcttatctaaaacctcaaggcagtactttgagcaacctgcgactagctttctagtttactctttgattttcattgagtattaattaggaaagaatgttatgcaacttttttaaaaaggcttgcgtttttgcctcaatatcttctgcttgcatcaaatcacgtacaacagctacaccagctatgccagtgcccataagctgatcaatattctccgaagtcaagcctccaatagcaactactggaatggcaaccgtttggcaaattgttttcaaggtcgatatcagagtaatgggcgcattttccttggtggtggttgggaaaatggctcctgtacccaagtaatctgcacctgatttctccgcttccagagctcttttaaccgttttagcggtgacaccgaggattttttcaggacccaagactttgcgagctaccgaaactggtaattcatcatctccgatatgcagacctgctgcatcaaccgcaagacaaacatccaaccgatcatcgattatcaagggtacctgataagcatctgttatttccttgacttgttttgccagttgataatattgattggttgtgagatttttttctcgcaattggactatggtaacccctgaacggcaggccgtctcaacttttgcaagaaagctttccacggaatcttgatagcgattggttaccagatatagtctaagtgcttctctattcataaacctctcctttgatggtatctagccaattttcatctcttcttaggagcgaaagctgattgagtacttggtaacgaaattcttccaatcccattccttgaacaactattttctcagcagcgatattgagataagagactgctaagcaagaagcttcaaaaccagtctttccttggctgagaaaaacagctgttaaggctccaaccaagtctcctgtccctgttatccagtctaattcagtacagccatttcccagtacagcgacctgatttttcgaaacgacgaggtccttgggacctgtgactaagaaagacataccaggataggtctgacaccagtctttcaagacttgaagcaaatcctccgtttcttgatctttagcactcgcatcgaccccaacgccgtggtgctttaatccaacaagacttcgaatttctgacatgtttcctttaaggaccgtaggtctatagtctaaaaggtctttaactaagctcttacgaatggatgaagtcgttacgccaaccgcatctactaccatcgggagagaagattggtttgcatacgaagctgccatgcggattgctttttccttctcagctgacaaatgccccaaattgatgaagagagcctgactttgcttagtaaaatcaagaacttcacgggaatcatctgccatgacaggtttgcatcccagagccaaaatcccatttgccagcatctcacaagaaatctcattggtaatgcagtgaatgagggaactagagcctataggaaagggatttgtaaattcctgcatcagtctatcctttcactaaagaaatatccctgcacttttttaaagaattcctgcttgattaaaaatcgaaaggcaataaaggaaatcgctgtaccaatcaaggttgctccgaaaaatcgaggcgtgtagataaaccagctaagcttagcagctgatcctgtaaagagtaccataacaggataggaaacaatggaaccaataatacctgttcccaaaatctctcctagagcagaatagtgaaattttcgaccgtacttataaaagagacctgctagaagggctccaaaagtcgctcctgtgagagctaaaggcggaatcccttgagtcgtcatacggataaaggctgtgactgtagccatagccaaggcataaacaggtcccatcatgattcctgctagaatattgactacactggacatcggtgccattccctcaattcgaaagataggtgtaaggactacatcaagggcaatcatcatagataaaatggttaatttgtgaacttgtaattggtgctttctcatgcttctattcttctcctttttctaaagactgtaaatcgctcttccatgtctggtgttggtaggccatttcccaaaacttggcttccatatgaacactgatgtggaaggcatctagcattttttgcttgtctgtctcgtcactttctcgatagagctgattgaccagtgctccctcctctctgatctgttgctctaactcatccgtaatataagtttcaatccattgttgatagagaggatttggtgatggtttaagattaagtgatttgcctatatcatggtataaccaaggacaaggaagcaagcttgcaaaagcgatggctaagttcggttctgcaaattgcctataaatatgagaaatgtaatgataacaggttggagcgattggatgttgctccatttcctggtcgctgatttccaattccttgaaaaattgttggcgaataaataactcaccctccactaaaccctgagcattttgtttcaagagtcttttcatctcttggtttgaagtcttatcagccaaaagatgatagatttctgagaaagccttcagatagtaggcatcctgaatcaggtaatagcggaaaatggcaggttctaaattcccctcttgtaattgtaaaataaagggatgatgaaaggaagcctgccaagctttcttggataattccatcgcaatatctgtaaattccataataactcctttataaaaatagactggtttgaagcaataaaaagaaaagcaggtagattaattttgtttttttaggaatataaaaagtccgatagctattcttcaactgtgcatgttcgtcatatccgtgagcagatagagctctcaggtaaagatggcgccacctaaagactgtcatcagaaccttactgtaaatcaagggcgaccaaaaatgtagttcttgaccacgtaataggcaagcttctttgagggacttgatttcttgctgaatgagaggaaaagaattgaataccacaatcaaggcataggaccaagagcgtgatagccccttttgagccaagtacaagagaagctcttttagtgaaacagaggaaacaaagacaaggccgatacaaactgtcacaaaggccctcgttccaagcatgactgcctgtgaagcatctccgtgtaactgaactgcccagtagttggcaaaagatggtaaaatggcaagtatgatcatccaagctaacattttaaatcgacggtaatagagcataaagagaatacaaaatgcgactaccgaaagagtcagagcaatcgaaggaatgaaagatgtttccaaggataaaatcagcaagaagagactgataatcggtgtctgggttgctactttgaccatactatctcacctccccttgggtattgctactctgagatgtaagtggtttggtaatggtcacttctttcacatgccgaagaccctgactagtcatctcaatccaataatcaaccacagaaatcaaagggtctaaacgatgactaatgagcagaaaacttcttccttgattcctctcctccacaatccacttgcaaaaataatggcaggctctatcatccaaacctgcaaaaggttcatctagcaagatcacggaagccttactggtcaagatggtcaggagctgaagaattttttgctgaccaccacttaattgatagggactcttatcgactgcctgctccaaatcaaaatatcgtaaagcttgaaaaatccgctgatttctttcagaatcaggtccatctaattgaagctcctctcgcagactgactcggataaactgcttctcagcttcctgaacaacaccagtcagatcacgatacaaactctttttctttttcaggaccgaacccttccaagtaatgctccccttatacttttgaaattgaagaatagaccgaaagagggttgatttcccgacaccattgtcacccaggatacaggaaatcccttgatagaatgtgaaatcagcaattgaaaagagggggcgattaccaagctcaccagtcacacggttcatatggaatagttccgggctagaagcaacttcctttgaagcaacctgtgtcatctcataggaagggatttgaaacacttcccttagttttccgtctcttagctccaccatatggtcgatataggctttatagtcagataaatcatggtcgcacaaaataactgtcttcccatcatagaccaactcttttagaatctccaatatctcgattctgctcttgcggtcaatggaagcgaagggctcatccaagagatagaccctaggattcatggcaaagaggacagccagcgctgctttttgcttttccccacctgataagtgatggatgagacggtgcaagatgtccttgcaacgacattgctggacaacctctgctattttagaatcaatttcctgaaggtgatagccgatattttccatggtaaaaaccaactcctcaaacaagctctccatggtaaattgatgattaggattttgcaagagaataccaaccgtctggacacgttcgacgatagaaagctgactgacctcgctcccatctatcaggacttgaccgctatagggaagagaactaacttgggcaatcatttgaaagaggctggattttccagacccactactcccaactaacaaggtaaaggcttgcgcatgaaaagtaaaatcaaacggctcagagaagattggggactgaatcgctcgtagttccagacccatctatgcttttcctccagttgcaaactgatgatagagtttgacaatggcacgaaccaagatggtacagaagaaataaacagaaataaaacgtaccacaagcaaggaaaggacaaacggaagggaaaaggcgtagtaacctaacttaatgtattcatagacaaagctaacaagcgtaatcccaatactattagcagttagagagagccaactttcatagcgattcttagttacgataaaaccaaattcacttcccaaaccttgaacaaagccagacaaaagagctcctagaccaaattggctaccataaaggacttcagcaagcgcagctagcacttctccaatcgttgcacttccgactctcggaacaaagatggcagcaatgggcgcagccatacaccagagaccgaagaggatttcattggcaaaggcctgcaaaccaagaggtgttaagagtagactgagaatattatacacatatcctgaaccaacgaaaaccccaccaaaaaagatagacaagaaagcaagcaagataacatcttttaactgccattttttcaacataaaaaactcctttttttaaagaaaagtgaggcactcaagaagaccgacctaaatactttgtatagcagactgaatttagaacagtacacaagaacactaaaatatttctagaaattaatttgaattttctaattgatttgttcgcatcttatttcaatctactatatcatcttcatccagtttcgtaaaagaaaaaactctaattacagatacaaattagagttcagcttacaagattagacagttcttttcgacatacgaaaaaaacatttcacatttcccttcgccagtcttaactgtatcaggttcaatgggtatcatctcagcctaaagcaccccaaatgtctttattatttaattatgtgattattataacacacattttatactagttcaagaaattgaactggaaatacagccttgcactcacaaagacagcagatctttcttttgcaaaaaacaaatgacctgtttgatgaattagccattcaagctgaatctggacatagctttttaaaaaaggaaaatcctacttacttagaatccaaggatagatatctattgttcactcatttcccgaacagttttttctatattttttgcatacgatattgccgaaatgattgaaacgccatccatattggtctttataatgtctttaatatgtttcgtctgtatcccaccaattgcaactaaaggcatttgtggcaatagttttctcatcaattcaagaccttcataacctatagtaccaccagcatcatcctttgactgggtaccaaatacaggcccaacacctacataatctacatattcaacttttgattgttgaaattcttcttcgtttcttatagaaagaccaattattttatctggcatcaattttctaatttcatcaacaccaatatcatcttgacctacatgtacgccatcggcgtcaatttccattgctaaatctatatcgtcattaacgataaatggaacattgtattttttacaaagttctttaatttggatagctagctcaagtttttctaagccttctaaagcaccctcacctttttctcgaaattgaaataaggttataccaccttttaaggcttcctcaacgactgtatatagattttttccttggcaagtagtcgttccacaaataaaatatagttttagtaattctttatgaaacatcttacttcactcttttgaattcctttacatcttcatctgtaatctcgtataaggcatttataaattcaactttaaatgtcccaggaagatgtccatttggacgtttttctgctatttctccagcgatattgtaaaccaacactgctgtttttaatgatttcaattcttgacctttttctagtccgataaagcttgctactacagctcctaataagcatcctgtcccaatgactttcggcatcatagcactaccattatgaatcattaccacttctccattaacagcaatggcatccacttcacctgttactactattggaatattgaacttctcatttgctgctagagcaatttcgtcaatattatctacgcccgcactatctactcctttagatgccacatctattcctactaaagaggcaatctcgccagcatttcctctaatcgctgctagtttataattgttgattagatcatctgctactttttttctatattctcctgctccacaggctacaggatctaaaactgctgggacattatatttctctgcaattttcagagcagcttggtataatttccaattttcatctgtcaatgttcctatgtttattaataaaccaccagcatactttaacaaatcctctaaatctgctggaaactcactcatggctggtgaggcgcccagtgctactaatccatttgctgtgaaattttttactacatcattggttatacaaatgaccaatggtgctttttcttttaataattttaaacttgtcatattgaaatccttccttttcactttatacgatctactaatttcgatttatctttagttgagaatttttttcatttacattgaatgatttatactcaatgaaaatcaaagagcaaactaggaggctaaccgcaggttgctcaaaacactgttttgaggttgtggatagaactgacgtggtttgaagagattttcgaagagtcttacctcatcaaatttgtaaatatcatgagccttctctagacatcgtaaccaatatcaaaaaaagctaattctaaagcgactgcttgattccagcgttgctgaagttctgtcaaatcttctcgatttttaccgacacgattgagttcgtcaaccagaaattgaacccactctgcaaagaaaggacctctgtggagattgatccattccgaatgaatatagacttcaggtaaagccaaatctttagaaccccagtctaaatagagaccttctgcaatgaccagcatgaccaaaagatgggcatagtctgatgaagccaccgccgaatacattagatcctgaaaggcttttgttacagggtgcaaagtcacttctagatagtcattctctgctacttttaactctttaaaagccttttggaaataaccatcttcatctgcttcaagaaagcctagttgcttggcaaaacgaagcttggattcaagtttatctgcgtgactacgcaggcacccagcatggataagaaggcatcaaagaagtgataatcttgaatcagatagtcctttaagaccttattctcaattgtccccgcaaaaagttccttaacaaaacgatgattgattgcagcctgccaatccttctgactgctttttaataattctccaacagtcaaacctggctgaaatgcatagtcttgtgtttccatatttacttctcctctctttacttgttagtaattaataaaacaccaagaaatatcaagcaaaatcgtaattccacttgatccttttaaagcacatcgagagcatttgcagagagctaactaaacaagcctatccagtttatataaacaaaaaactccaattacaatcaagaattagagttgacttacaagattagaccgttcatttcaccatacgaaaaaactgttcacatttcccttcgccagtcttaactgtatcaggttcaatgggtattatctcagcctaaagcaccccaaatgtctctattatttaactactgaaccagtatagcaaaaaatgaaagccctagcaagatatttgaccgaaaaatatctttatatataatatattgaaactagaatagtacacctctacttataaaacattgttagaaatcgatttgactgtcctgattgatttgtcctattcttatttcattttactatagttttcgatagcaatttattcttccaatacacgaagaaaaacctccacattcagtggaggcaatctgttttatcaatacaattttaagtcacgagggtcaactgggaaggttgggttgtatggattgtgacggagcttgaagtgtttgacatcttcaatggtctgagttccagacaattgcataactgtcttcaattccgcattcaagtgttcaaagacttgacgcacaccgacactaccaccgagagccaagccatagatgacagggcgtccaatagcaaccaagtctgctcctgatgccaaggctttaaagacgtgttgaccacgacgaacaccagagtcaaagacaatcggcacacgtctatcaactgcttctgccacttcttgaagcgagtcaaaggcagctggtccaccgtcgatttgacgaccaccgtggttggttacccagataccagaagctcctgcagcaagcgaacgttcaacgtcctcacggcattgtggtcccttgacatacacaggaagaccagagtattcagcgataaattctacatcgcgtggagacaagcgttgtttagctgatttgtaaacaaagtccattgatttaccagcaccttctggcaggtattcttcaacaatcggcatgccaactgggaagacaaaaccattacgcttatccacttcacgattcccccctacagtagcatctgccgtcaagacaatcgctttataaccttcagccttcacacggtccatgatgtggcggttgataccgtcatccttactaaagtaaaattgaaaccaatgaggtgtcccttggagggcttcagaaatctctggaaggtcaacagtagagtaagaactggttgtataaagagaaccaaactcatgcacaccacgcgcagtcgccacttccccctgttcatttgccaatttatgagccgcaacaggtgccataatgattggagaagatagtttttcacctgcaaattcaatctctgtacttggattttctacattgcaaagtgtatgaggaacgatgagcttgtggttaaaggcacggatattctctcttaaagtgaaagtatcttccgccccactagcgatatagccaaatgctgctttaggaataacttgttgcgccattggctccaaatcataggtattgatgaartctacatgaccttctgcattgcttgttttgtatgacataaaatgtcctccttaataagtaagcgtttactttgtgtattacaaaaatatcttaactctttttcaaaacttttaaaatattttgtttggaaatttcagaaattttatgtctatgataaaaatccttataacggcaataaaaaatagatattatccaaagaagattttaagtgctacaataactgtattatttctagatgggaggttctatttttggattgatccattgttgaacaatatctaccactatatcaaaaggcattctttctgaccttgcatattgcagtttggggaattttgggatcctttctgctcggtttaatcgttagtatcatccgacattatcgaatccttgttttggcgcaagtagcgacagcctacattgaattgtcacgtaatacgccccttttgattcaactcttctttctctacttcggtcttccccgaatcgggattgtcctatcttcagaagtctgtgcaacgcttgggcttgtctttttaggaggctcctatatggcagaatctttccgaagtgggctggaagccatcagtcaaacccagcaggagattggcctcgctattggtctgacacctctacaggtcttttactatgtggttcttccgcaagcaacagcggtggcactcccctcctttagtgccaatgtcattttccttatcaaggaaacctctgttttctcagcagtggctttggccgacctcatgtacgtcgccaaggatttgattggtctctactatgagacagacattgcgctagctatgttggtagttgcttatctaatcatgctgctacccatctcactggtctttagctggatagaaaggaggctccgccatgcaggattcgggaatccaagtactctttcaaggaaataatctcctgagaatcttacagggattgggcgttacgattgggatatccatcctgtctgtcctcttatccatgatgttcagaacagtcatgggaatcatcatgacctcccattctagaatcatacgatttttaacacgattgtatctggaatttatccgtatcatgccccagctggtgctactcttcatcgtttactttggcttggctcgaaactttaatatcaatatctcaggtgagacttcagctattatcgtttttaccctctggggaacagctgaaatgggagacttggtacgtggagctatcacttctctccctaaacatcagtttgaaagtggacaggcactcggcttgactaatgttcaactttactaccacatcatcatcccacaagtcttaagaagactgctaccgcaggctatcaatcttgtcactcggatgattaaaaccacttcattagttgttttgattggggttgtggaagtgaccaaagttggacaacaaatcatcgatagcaatcgcctgaccatcccaactgcttcattttggatttatggaaccattctaatcttatatttcgcagtttgctaccctatttccaaactatccactcacttagaaaaacattggagaaactaaatgtctgaaactatcttagaaatcaaggaactaaaaaaatccttcggagacaatcccatcctccaaggactttctctagaaatcaaaaaaggggaagttgttgtcatcctagggccatctggttgtgggaaaagtaccctccttcgttgcctcaacggcttagaaagtattcaaggtggagatattcttctggatggtcagtctatcgttgaaaataaaaaagattttcacctagttcgccaaaagattggcatggtctttcaaagttatgaactctttccccatctggatgtcttacaaaacctcatcctaggccctatcaaagctcaaggaagggacaagaaagaagtaacggaagaagctttgcaattactagagcgtgtcggtttgctggataaacaacatagctttgcccgtcaattatctggtggacagaagcaacgtgttgcaattgtccgtgccctcctaatgcatccagaaatcatcctttttgacgaggtgactgcttcgctggatccagaaatggtgcgtgaggtgctggaacttatcaatgatttggcccaagaaggccgtaccatgattttagtaacccacgaaatgcagtttgcccaagccattactgaccggattatcttcctcgaccaagggaaaatcgctgaagaaggaacagctcaagccttctttaccaatccgcaaaccaaacgagcccaggaatttttaaacgtctttgactttagccaattcggctcatatctataaaggagattcttatgaaactattcaaaccactcttaactgttttagcacttgcctttgcccttatctttatcactgcttgtagctcaggtggaaacgctggttcatcctctggaaaaacaactgccaaagctcgcactatcgatgaaatcaaaaaaagcggtgaactgcgaatcgccgtgtttggagataaaaaaccgtttggctacgttgacaatgatggttcttaccaaggctacgctacgatattgaactagggaaccaactagctcaagaccttggtgtcaaggttaaatacatttcagtcgatgctgccaaccgtgcggaatacttgatttcaaacaaggtagatattactcttgctaactttacagtaactgacgaacgtaagaaacaagttgattttgcccttccatatatgaaagtttctctgggtgtcgtatcacctaagactggtctcattacagacgtcaaacaacttgaaggtaaaaccttaattgtcacaaaaggaacgactgctgagacttattttgaaaagaatcatccagaaatcaaactccaaaaatacgaccaatacagtgactcttaccaagctcttcttgacggacgtggagatgccttttcaactgacaatacggaagttctagcttgggcgcttgaaaataaaggatttgaagtaggaattacttccctcggtgatcccgataccattgcggcagcagttcaaaaaggcaaccaagaattgctagacttcatcaataaagatattgaaaaattaggcaaggaaaacttcttccacaaggcctatgaaaagacacttcacccaacctacggtgacgctgctaaagcagatgacctggttgttgaaggtggaaaagttgattagtcattaactcttaaaaggaactggattttaagctccaatccctttttaagattttacctataacatcctgagtctatctaagatgttcaatctgaacacagtgtacatactttatcttctattgcatatactttatcacataagatacgaatatcctcttcactatgactagcaatcaaaattgttgtccctttttcactagagagctttctaaacaatgttctcatattttctacacttgatttatccaaggcattcataggttcatctagtaaaagaatagagggattctccataattgcttgagcaatccctagctttttcctcatacctagcgaataagttttaactttctggtctttttgctcatatagaccaactattttcagtgtatcattgatttcctgattaccaactactcctcgtatgcttgccaaatattgtaaattcttaaagccactataataatttataaaaccaggttcttcaatcaaagctcccaaattagctggaatttttctctcaggaacaatattttccccattgattaacacttctccataagacggactatataaaccagctattaatttaaacaatacacttttccctgagccattcgcaccagtaattcctataatttccccctgtttacaactaaagttaaggttttgaaaaacacatgtcttttttaatttcaactcaatattttttaatgtaattatttcattcattctataaacctcctcttttgacgagtgaaatagaaaatgctttgaaaaagaaagactaaaaatagcaactgaagaaataaatctcgtcctatatctccattccctcgattcaaaatataaaatagataattagttcgatttcctacaaatagaccaccaaacacaatcatgagtaaaaagaaactaacgcaagcaaagttcg

SEQ ID NO: 49 - DNA, 11443 bp; double-stranded, linear
caggtacggtgaggcgcaactaaaatataattttcatcttgattaggaattttatcagtattatgatagtgagcattgccattgatggaccataagagcaatacaactaatccacgcaaataagtataaaacatgcgatctccttcgattgttttcttgttattattataccttatcaaaggagggctggcaaacttttcccttgactagatacatatttaggatgaaattagaattctgttaaaaaaaatgatataatagaatttatggataaaaataagattatgggattaacccaaagagaagtcaaggaaagacaggctgagggtttggtcaatgactttaccgcatcagccagtaccagcacttggcaaatcgttaaacgaaatgtctttaccctttttaacgctttgaactttgccattgctttggctcttgcctttgtgcaggcttggagcaatctggtcttctttgctgttatctgctttaacgctttttctgggattgtgaccgagctacgagccaaacacatggtggacaagctcaatctcatgaccaaggaaaaggtcaaaaccatccgtgatggtcaggaagttgctcttaatcctgaagaattagtgctaggagatgtcattcgtttgtctgcaggagagcagattcctagtgatgccttggttttggaaggctttgcggaagtcaatgaagccatgttaacgggagaaagtgatttggtgcaaaaggaagttgacggcttacttttgtcaggaagtttcctagccagtgggtcagttttatctcaagttcaccatgtcggtgcagacaactatgctgccaaactcatgcttgaggctaagaccgttaaacccatcaactcccgtatcatgaaatcgctggacaagttggctggttttactgggaagattatcattccctttggtctggctctcttgctggaagccttgcttttaaaaggcctgcctctcaagtcatccgttgtaaactcgtcgacagctcttttgggaatgttgcctaagggaattgcccttttgaccattacttcgctcttgactgcagtgattaagttgggcttgaaaaaggtcttggtgcaggagatgtactctgttgagaccttggcgcgcgtggatatgctctgtctggacaagacgggtaccatcacccaaggaaagatgcaggtggaggctgttcttccgttgacggaaacgtatggtgaagaggctattgccagcatcttgactagctacatggcccatagtgaggataagaatccaactgcccaagccattcgccagcgttttgtgggagatgttgcttatcctatgatttccaatcttcccttctcgagcgaccgcaagtggggggctatggagttagaaggcttggggacagttttcttaggggcacctgagatgttgcttgattctgaagtcccagaagctagggaggccttggagagaggatcacgtgtcttggtcttagctctcagtcaggagaaattagaccatcacaaaccacagaaaccatctgatattcaggctctagccttgctggaaatcttggaccccattcgagagggagcagcagagacgctggactatctccgttctcaggaggtgggactcaagattatctctggtgacaatccagttacggtgtccagcattgcccagaaggctggttttgcggactatcacagctatgtagattgctcaaaaatcaccgatgaggaattgatggccatggcggaggagacagctattttcggacgtgtttcccctcatcaaaagaaactcatcatccaaacgttgaaaaaagcgggacatacaacggctatgacaggggacggggttaatgatatcttggcccttcgtgaggcggattgttctatcgtgatggcggagggggatccagcaacccgtcagattgccaatctggttctcttgaactcagactttaatgatgttcctgagattctcttcgagggtcgtcgcgtggtcaataacattgcccacatcgccccgattttcttgataaagaccatctattccttcctgttagcagtcatctgtattgccagtgctttactaggtcggtcagagtggattttgattttccccttcattccgatccagattaccatgattgaccagtttgtggaaggtttcccaccattcgttctgacttttgagcgaaatatcaaacctgttgagcagaatttcctcagaaaatccatgcttcgtgccctaccaagcgctctcatggtcgtcttcagcgtcctgtttgtgaaaatgtttggcgcgagtcaaggttggtctgagttagaaatctcaactctactctattatctcttggggtcaattggtttcttatccgtatttagagcctgcatgccatttaccctatggcgtgtcctcttgattgtttggtcagtaggaggtttcctagccacagctctcttcccaagaattcaaaaactgcttgaaatttcaaccttaacagaacaaacgttgcctgtttatggtgtcatgatgttggtctttaccgtgattttcatcctgaccagtcgttaccaagcgaaaaaataaatcaaaaccaccagtgtgaactggtggtttgttctgcggctataagccgcttctaccggccagggccaaaggcccaccgaaatagcttcctcgcgcaccactttcccgagcaggtgctaaagcaccttagttacttcctcttatttatttcgccagtaaacggatctactgactcgaataacgtgagctggtctgctactctgtcttcttgtaattgattctgaatatattcagctatcactttctgattacggcctaccgtatctacataatagcctctacaccaaaacttgcgattgccatatttgtattttaaattcgcatgcttatcaaaaatcatcaaactgctcttgccctttaaatagcccataaaggacgaaacactaagtttcggaggaatactgataagcatgtgaatatggtctgaacaagcattcgcttcatggattattacacccttacgctcacataagtcacgtatgattcttccgatactagctttgtatctgccataaatgatttgacgacgatatttgggtgcaaaaacaatatgatatttacaattccatgtggtatgtgataaactttgattatcctctctcatgaggtacctcctgtatgatatgttgtagtggcggagaaaccacttctatcttatcattttaggaggttctttttgttaccacgctaaaagctctatggaaccactagcatagctagtggttttcgggagacaacaagaaagactgcaatctgtggattgcagttttttatacgatggatctatcgtagatctgatgtgcaaggcctacgtgccgatcatctatcggtgaacccaagagcgaccctcaagcctgcttggattgaggtaatagattcaaatatctgtagttagactatttgaagtttgatgtaagaaagagaaagcgacagattgaagtaattttaactctcttctattgctagaacaaatggtcggataggttggtagtttgaaaatgaagatgctatctattgttaaatggaacatagtgttatttattagaaaatcgtttggtttatttcttatcaaatacgaaaagcaacttaaatatttcaactaaaatagatgttatgaagaaaaggtaaaatgattttggcatagtgaggttctgttctatttgatatcatatttttgataaaaacaaaaatgtccattgcaaaggacaaaatgcgaagtatattattttttgaaagcgatataatggattcataaaggaggtgtatcgtgtctagaaaacaagaacaaatggaaacgttgttgctccttttgcgagatagtaaggattatatatctgctaaagtattgggagaaaaattaaattgctctgataaaacggtttatcgccttgtcaagggaatcaacaaagattgtccggtagaagcattcattttatctgaaaaaggcagaggtttcaaattaaatccaagaagttccctcgtggacgttgatgggaattttacagaggcttttgatcctgaagtaaggcgtgaaaaattactagaacgtctcttgttgactgctcctaagccacattctatttatgatttaggagaggaattctacgtaagcgagtcagtagtactaaaagatcgtcagatattacaagagagtctagcaatttatgggttagatttaaaaatgagacaacgaaagctttttattgatggggatgaggctcaaattcgttcagccattctaaatctactgccaatgtttaatcagttggatttagagcaaattacacagaataaggttcagcctcttgacggagaacttgctcacttttgtttgggattactgattacacttgagagagaattgggggtaaacattccctatccatataatataaatattttctctcacctgtatatttttatcagtaggaatcgtcgtagtactagtattcatgttgtagcaccttcaaaacctactattgttgatgagaaaatttacagtgtctgtcaaaaaattattcaagaaattgaacaatattttaggatgaaggttgatgcagttgagattgactatctttatcaatacgttgtatcttcgagattgcaaaaaccattttcttccgggaagcttcctttttctcagcgagttttagatgtcactcattactattttagccgtatgtgtatggacaatagagagattgaaacgacagatcctgactttgttgacttggcgagtcatatcagtcccttactgaggagattagataatagagtacagattaagaatagtcttttatcacaaattcttttaacctatcctaatctggttaaagagttaacaactatttctaaagaagtgagtctagtatttggttttgcttccttgagtctggacgagattggttttctagtcttatattttgcacggtttcaagaaaagcgagcacgtcctctaaaaacagtagtgatgtgtacatcaggtgtcggaacttcagagcttttacgagcacgattagaaaagcaattttctgaattggatattattgatgtagttgcttatcatcaattagatgagctgataaatctatatccagatttagatttcattgtgacgacggtagctttgcaggaaccagcaagtgtcccgtttgtcctagttagtgtttttctaaccgagggtgataaacaacgtcttcaagcaaaaattcaggagataaactatgaataatctttcgcttgtccttatggatatatctgttcaaaatcgtcaagaagcctacaaagaattagcaaatcaaatcagccttcttgtttctgaagatacagaaaaaatagaagagcttctatattaccgtgagagacagggaagtatagaggttgctaaaggtgttcttctaccacattgtgaaggaaactttcaacatcatgtcttagtgattactagattaaaatcacctatcagagaatggtcgaaggatatccagtgtgttgaccttattatcggtttggccattgcagtatcacaggacaagtcatgtattaaaacattgatgagaagactagcagatgaatcattcataaatcaattaaaacagttaacaaaagaagaattacgggagataatatatggaaatcaaagatattcttaatgtgagtctgatccagacggatttacagatgcagagcaaagaagaggtttttgaggcattagctcaactattggttgagacgggttatgtgtctgatagagaccaatttatcgaaggtctttatcagagagaggcagaaggacagaccggtattgggaattatattgctattccccatagcaagagttctgctgtggagaaggcgggggtagtcatagctataaatcacaatgagattccttgggagaccattgatgggaaaggggtcaaagtaattgtactctttgcagttggtgatgatacagaagctgctagggagcatttgaagaccttatcactctttgctcgaaaacttggtaatgacgaagttgttgccaaattagttcgggctcagacatctgatgatgtgattgcagctttttgttaataagaaaaaattttggagggtatccgtatgaaaattgttggtgttgcagcttgtactgtgggaattgcccacacttatattgcacaggaaaaattagagaatgccgcaaaggtagctggacatgtgattcatgttgagactcaggggacaataggggtagaaaatgaattgagtcaagagcagattgatgcagcggatgtagttattttagcagttgatgttaagatttctggtatggaacgctttgagggtaaaaagattatcaaggttccaacagaagtggcagtcaaatctcccaataaactgattgctaaagctgttgagattgttacgaaataactgaaaatatttaaggagaaaatatatgttgaaacacttaaacttaaaaggtcacttattgacagccatttcctatatgattccaattgtttgtggtgcaggattcttagttgccattggtttagcaatggggggtggtgttcctgacgctcttgtagcaggaaaattcactatctgggatgctttagcaactatgggtggtaaagcccttggtctcttgccagttgttattgctacaggtttgtcttactcgattgctggtaagccagggattgcaccaggttttgttgttggtctaattgccaattctgttggttcagggtttatcggtggtatcttgggaggttatatagctggtttcttggttcaagcgattattaaaaaggtcaaagtaccaaactggattaaaggtttaatgccaaccttgattattccttttgtagcctctttggtaagtagtttgattatgatttatattattggagcgcctatcgcagcctttaccaactggttgacgagcttattacaaagcttgggaagtgcttcaaatggtttgatgggggcagttattggaattctcagtgctgttgactttggtggcccacttaataaaacagtctatgcgtttgtgttgactttacaggctgaaggtgtgaaagaaccattgactgctttacaattggtgaatactgctacaccagttggatttggattggcctattttatcgcgaaattactcaaaaaaaatatctatactcaagaggaaatcgaaacattgaaatcggctgttcctatggggattgtcaatattgttgaaggtgtaattccgattgttatgaataacttggttccaggtctcattgcaacaggtatcggtggtgctgttggtggtgctgtttctttgacaatgggtgctgattctgctgtgccatttggtggagtgcttatgttaccaaccatgactcgtccagtagctggtatttgtgccttgttagctaacattgtagtcacaggacttgtctacgcgattttgaaaaaaccaataaaacatgcagaaccagttatgactgttgaagaagagattgatttgtcagatattgaaattttgtaagagggtaacgatgtcaagaattgaattttcaccatctttgatgaccatggatttggacaaattcaaagagcagattacttttttgaatgataaagtagcatcttatcatatcgatattatggatggccattttgttcccaatattaccttgtctccttggttcattcaagaagttcaaaaaattagtgacacacctttatcagttcatctgatggtcacagacccaaccttttgggtagatcaagttctcgatttacaatgtgagtatatttgtattcatgctgaagttctgaatggtcttgcttttcgtttgattgataaaattcatgatgcaggtctaaaggctggtgttgtccttaatcctgaaacacctgtttctacaatctttccctacattgatttacttgacaaagcaactattatgactgtagatccaggttttgcaggacaacgctttttggagtctaccttgtataaaatccaagaactccgtcagcttagagttcagaatggttatcactacatcattgagatggatggttcttcgagtcgtaagactttcaaacaaattgatgtggcaggaccagatatttatgttataggtcgcagtggattatttggtttggatgacgatattgccaaagcctgggatatctgttctagagattacgaagaaatgaccggaaaaacaatgccaatcaaataatggtttgagaagaaatttattagttaggaggaatatatgtcactacaatcagttaacgccattcgttttcttggcgtagatgctattaacaaatctaattctggtcacccgggaattgtcatgggtgctgcgccaatggcttatagcctatttacaaagcaccttagaattacacctgagcagccaaactggattaaccgagatcgctttatcttgtctgcgggtcatggatcaatgctactgtatgctctcttgcatttaacagggtataaggatgtatccatggacgagattaaaaatttccggcaatggggatctaagacacctggtcatcctgaagtgacgcatacgtctggtgtggatgcgacatctggtccgcttggtcaggggatttctactgccgttggtttcgcccaagcagagcgttttttagctgctaagtacaacaaagatggtttccctatttttgaccattatacttatgttatcgctggagacggtgacttcatggaaggagtgtctgcggaggcggcttcttatgcaggtcatcaagctttagataagcttatcgtcctctacgactccaacgacatctgcttggatggtgagaccaaagatactttctctgaaaatgttcgcgtccgttacgatgcttatggttggcatacagttctggtagaagatggaacagatttagcagcaatttctacagcaattgagacggccaagttttctggtaaaccgagtttgattgaagtgaaaacggtaattggttacggctcacccaataaaagtggtacaaatgctgttcatggtgcaccactaggagcagaagaaacaggagcaactcgtaagtttttgggatgggattacgatccatttgaagtaccagaggaagtatattctgatttcaagacaaatgtagcggatcgtggtcaggaggcatacgatgcttgggctagtttggtgtctgattacaaggttgcttatcccgaagttgctagtgagattgacgctattgtagctggaaaatcccctgtaaccattactgaaaaagacttccctgtctatgagaatggcttctctcaagcaactcgtaattcgtcccaagatgctattaatacagcagcagttttaccaaccttcttaggtggatcggcagacttagctcactctaacatgacctacatcaaggcagatggcttacaagataaatataatccattaaaccgcaatattcagtttggggtacgtgaatttgccatgggaacaatcctcaatggaatggctcttcatggtggtttacgagtttatggcggaaccttctttgttttctctgactacgtcaaagctgctattcggctatcagccattcaggagttgcctgtaacttatgtctttacccatgattcaattgccgttggtgaagatggtccaactcatgaaccagttgaacatttggcaggtttacgctcaatgccaaacttgactgttatccgtccagcggatgcccgtgaaactcaagcggcttggcatcatgccttgaccagtaccaccactccaactgtcattgtcttaacccgtcaaaacttggtagttgaagaagggacagactttggtaaggtcgctaaaggagcctacgtcgtgtatgataccccgggatttgatactattatcattgctacaggatctgaggtcaatctagctatcaaagctgctaaggaattggttttacaaggtggtaaagtacgtgtggtatctatgccctcaaccgaactatttgatgctcaagatgctacctacaaggaagacattttaccatctaagactcgtcgtcgtgtggccattgaaatggcagcgacccaaagttggtacaagtatgttggtttggatggcgcggtcatcggtattgacatcttcggtgcgtctgccccagctcagactgtgattgataattatggatttacggtagagaatatcgttgctcaagttaagtccctatagaaaccaattacaatgaagatacagctgttgtcagactagcagatgtagtgatagacactaatcagatgattggttatttaaaaactgtaatgaaaatgtaataatttatctacgaaagttatagtagatagtatacacaatagagtataccctgaaacggttgcgaagtacgctaatcactttgctactgatctagatagtttctttaatcaataaacacagcatccacagattgacttaggatattgtaagttttttgaaagctagagagaaggtctctaaaattaaaaaacgcatagtataggatgttgaaatgatgaactgcaccccaaaagttagacagaaaaaaatctaacttttggggtgtttttattatgaaattaacttatgatgataaagttcagttctatgaacttagaaaacaaggatatatcttagagaagctttcaaataaatttgggataaataattctaatcttaggtacatgattaaattgattgatcgttacggaatagagttcgtcaaaaaagggaaaaatcgttactattctcctgatttaaaacaagaaatgattcataaagtctgacatgaaggctggactaaagatagagtttctcttgaatacggtctcccaagtcgtacgatacttcttaactggctagcacaatacaggaaaaacgggtatactattgttgagaaaacaaaagggagagtacctgagagcggagaatgccatcctaaaaaagttaagagaactccgattgaaggaggaaaaagagaaataagaaagacagaaattgttcaagaattaatgactgagttttcgttagatcttcttctaaaagccattaaactagctcgttggacctactactatcacttgaaacagctagataaaccagataaggaccaagagcttaaagctgaaattcaatccatctttatcgaacacaagggagattatgcttatcgccgggttcatttagaactaagaaatcgtgcttatctggtaaatcataaaagagttcaaggcttgatgaaagtactcaatttacaagctagaatgcgacagnaacgaaaatattcttctcataaaggag

SEQ ID NO: 50 - DNA, 5338 bp; double-stranded, linear
ccaattacattatattatcaaaatcgtcgaaactggctccatgaatgaggcagccaagcaactctttatcactcagccaagtctctccaatgcagtgcgagatttggaaaatgaaatgggcattgagatctttatccgcaatcccaagggaatcaccttgacccgtgatggcatggagtttctctcttatgcccgtcaggttgtcgagcagacccagcttctggaggaacgctataaaaatcctgtcgcccaccgcgaactctttagcgtttcgtctcaacactatgcctttgtggtcaatgcctttgtctctttgctcaagaaaagcgatatggagaaatacgaactcttccttcgtgaaactcggacttgggagattatcgacgacgtcaagaacttccgcagtgaggtcggggtcctcttcttaaacagttacaaccgtgatgttttaaccaagatgctggatgacaatcacctgctagcccaccatctcttcacagcgcaaccgcatatctttgtcagcaagaccaaccctctggcaaagaaagacaaggtgaaactgtctgatttggagaatttcccttacctcagctatgaccaagggacgcacaactccttctacttttcagaagagattctttctcaagaacaccacaagaaatccattgtggtcagtgaccgtgccaccctctttaatctcttgattggtttggatggttataccattgcgacagggattttgaacagcaacctaaacggagacaatatcgtttctatcccactggatattgatgacccgatcgagctggtctatatccagcatgagaaaaccagcctatctaagatgggcgaacgctttatagactatctcctagaagaagttcagtttgatagttgagaaatgataagaaccaatatgtaggctagcaacaacctgcacattggttctttttacttataattaaaagtttcccctgccaacttatcagctagcttgggaaagagagtataaaacttatgggctaggttcaacaaaatcgggagattgagttctcgtttgttttttcctataatcttgacaatctttttagccactgcatctggttctagcaggaagcgatcaaccgatttaagataagttccatctgggtcggcttggtcgaaaaatcctgtacggattggtcctggattgactgttgtcacatagactccatagggcataagttcgagtcgcagagcatttgaaaaaccaatagccgcaaacttggtcgctgagtaaagactagacttgccagtagctattagacctgccatgctgacgatgttgatgatatgccctttgctgctttccttcatacgagccgcaaggtgacgagacagattcatcagggcaaaggtattgacctcaaacatctggtgaatatctttatcagcaatctggtcaaatccctcaaaaatcccgtaaccagcgttgttaatcaagacatcaatcttgccatagcggagataaagatcagttaccagagcttctagggctgaatcgtcggtaatatcaatttcaatcaattctgcatgggaataatttccgtagagttgggctaatttttccttatttctaccaagcaagatgagttggtcattgggcaggagtttgaccatttcttgagctagaccaccgctagctccggtaatgagaatagtaggcatacttatcctttctgtgactgctagatttccacttcttccaagtctttgaccacatggacattttcaaaaattgtggcagcgtctttcttgagtttgctaatatcttttgagaggaaacgggcactgatatggttgagtaggaggcgtttggcacctgcttctaccgctacttgtgcagcttgcatattagttgagtgaccatggttacgagcaattttttcatcacccttgccataagtggactcatgaactaggacatctgcattgacagccagacgcacactggcacccgtttttcgagtgtctcctaaaatagtgataatcttacctggacgtggcgctgagatatagtctgctgccttgatttcagttccgtcttccaaaacaagatcctggccgtttttgattttaccaaaaagcgggccgaacggaacaccagcagccttgagtttttcagcatccagcgtcccttctagatccttttgcatgacacgatagccaacacagaaaatagtgtggtccagctcctctgcatacacagtgaatttatcggtttcaagaattttacccagagaatcttggtcaaactcatggaaatgaatgcggtagggcagacgagaacctgacacacgaaggctggttaagacaaatgacttgattccttgaggtccgtagatttccaaatctgtctgctcttcattggcctgaaaggcacggctagaaaggaaacctggcaaaccaaaaatgtggtctccatgcagatgggtaataaagattttgctgaccttacgtggtcgaattgtggtttccagaatgcgattttgcgtaccttctccacagtcaaagagccaaacttcgttaatctcatccaaaagtttcagggcgagacttgaaacgttgcgggctttagagggctgaccagcccccgttcctaaaaattgaatatccattcgatactttctaattaatcaatatataacatggctgtgcggttttccgatcggaaatagcgtttgccagaaaaagcagcagcttcttgcaataaatcctcttggctgtagcctttgagacgttttcgaccatcagccaatctttccaaatcagtcaaagctgtgagactttctaggctgataacttcctcgtcctcgacaggcttcatgtaaatcttaccagactcttcaaagactaattgatgggggaaaatttgcgcaatttcaaagagcaagtcatccgagattttctcctcattttcaaagaaaatccgaccaaggccgtcactctcataacaaaaaccaaaggatttaccagacagattaagccgaataaaaggcttattttctagggtgaaacttggctcagtattgtaaagattcagttcctgactgagttctgcaaaataatccgtcgcagcctgaggactctttttctgatagagttctgcaaagtaggcattaacaacacttggcggaggtgtaataagtgttaactgctcctgatctgttttaccagctagaagctgatccagatagaccttgtccagacttgtataacctccatactttagagccaaagttttaatatcagtcataaaattcttctaacctccatttatttttctcggaaatgtagcctgtaatcacttcgccgtcttcctgataatcacgttcttccagaattgcaacactctctaaatcatgaatcttgtaggactttgaaaaaggcactcgcagggtaaatgcttcaaaaatttccttaatcttatctagcaataatgcttgcaagttttcacgactgtcctcagacttggcagaaatgagggtatatggcgtttgggtaggcgtgaaatcctccaccaaatccgctttattataaagcgtcaagtgaggaatatcttccatgtccaggtctttcatgatggagagaaccgttttttcatgctcctcgtggtaaggattgctagcatcgataacatgaaccagaaggtccacatgcttgctttcttccaaggttgacttgaaactggacaccaactctgtcggcaaatcttggataaagccaacggtatctgtcaaagttacttggagattgcctcccagatgaatactcttggttgtcgcatccagagtcgcaaagagctcatctgcttcatactgggtcttactggtcaagatgttcatgatagttgatttcccagcattagtataaccaatcaaaccaatcttaaaagtgctagactccaaacgtttttctctgacagtcgcacgatttttctcaaccaccttgagctggcgctcgatatccgtgatttgattgcgaacgctacgacggttcagctccagctggctttcaccaggaccacgggaaccaattccccctgcctgacggctgagcataatcccctgaccaaccaagcgaggcaaaaggtatttgagttgggctaggtggacttggagcttcccttcatggcttcgagcccgcatggcaaagatatccaaaatcaactgcatacggtcaatgaccttaacaccgagaacttcctctagattgacattctgccttggggtcagacgattgttgacgatgacagtagtgatttcttctgcatccaccataagcgcaatctcttccaacttaccagagccgacgaaggtcttggaatcatatttttcacgtttttgtctgtagctatctacaacgactgcccctgccgttttcgctaaactagccaattcttccatggagaggtcaaaactgtccataccctgcaattccacaccaatcagcaggactcgctcctcttttttctccgtttcaatcatctaaaaactcctctatctggcttaaaatgcggtcttgtacaccagattctccaatctgataaaaggtgacctgcatgcgattacggaaccaggtcagctgacgcttggcaaaacgacgagtcgcctgtttaagactctcactagcttcctccaaggtctgctctccacggaaataaggaaagagttccttatagccaattcctttagcagcctgtacattaggggaatggtcaaacagccacttggcctcatccaaaagcccagcctcaaacatcaaatccactcggtggttgatacgctcataaagttgactacgttcatcatccaagcagataatcagcggttcatacaaggtctcttgattttccaaatcctgaccaaaatgggcaatttctaaggcacgcatagcacgacgacgattaaactggggaatctcaaggcctgcttgatccaccaaatgggctaattcctcatctgaatatggctccaaactagctcgataagctaaaatctcctcatgaggagtctccccacctaggtggtaaccttctagcaagctctggatataaagtccagtcccaccggcgataatggctagcttgccacggttgtgaataccctcaatagtcatcttagcttctgaaacaaaatcaaaagccgagtaagactcggttatctctctaacatcgattaaatgatgaggaacagctgcctgctcttctggactagccttggccgtcccaatatcaagtcctcgatagacttgctggctatctccactaaccacttcgccattaaaacgctttgcgggg

SEQ ID NO: 51 - DNA, 19446 bp; double-stranded, linear
cggaaacccatctagtctccatcgtttgggagaccaagcaacacgaatcttagatgcttctcgccaacagattgcagatttaatcggtaagaaaagcgatgaaatcttctttacctcgggtggaacagaaggggataactggcttatcaagggtgtggcctttgaaaaagctcagtttggcaagcacatcattgtttcagccattgaacatccagcagtcaaagagtcagccctctggttgaaaagtcaaggatttgaagtggattttgctccagttgataagaaaggcttggtcgatgttgaggcgttacaggtttgatacggcatgatacaatcctcgtttccatcatggctgtgaacaatgaaatcggctctatccaacctattgaggctatttcagaattcttggcagacaagccgactatttccttccacgttgatgcggttcaggcgcttgccaaaattccgactgaaaagtatctgacagaacgggtggattgcgcgactttctctagtcacaagttccacggggttcgaggtgttggctttgtctatatcaaatctggcaagaagattacacctcttcttacaggtggtggccaggagcgagattatcgttcgacaactgaaaatgtggcagggattgcagcgacagccaaggccctccgtttgtctatggaaaagctagatatctttaggagcaagactgggcagatgaaggcagtgattcgccaagctcttctgaactatccggatatttttgtcttttcagatgaggaaaactttgcacctcatattctgacttttggaatcaaaggtgttcgaggtgaagtcatcgttcacgcctttgaagactatgatattttcatctcaacaacctcagcttgttcatctaaggcaggaaaaccagccggtaccttgattgccatgggagtggacaaagataaggccaagtcagctgtgcgtcttagcctagacttggaaaatgatatgagtcaggtcgagcagtttttgaccaagttaaaattgatttacaatcaaactagaaaagtaagataggagcattcatgcagtattcagaaattatgattcgctacggagagttgtcaaccaagggtaaaaaccgtatgcgtttcatcaataaacttcgtaataatatttcggacgttttgtctatctatacccaagttaaggtaacagcagatcgcgaccgtgcccacgcttacctcaatggagctgattacacagcagttgcagaatctctcaaacaagtttttggaattcaaaacttttctcctgtttataaggttgaaaaatctgtagaagttttgaagtcttctgtccaagagattatgcgggacatctacaaggaaggtatgacctttaagatttctagcaagcgtagcgaccacaactttgaacttgatagtcgtgaactcaaccaaacacttggaggggctgtattcgaagccattccaaatgtgcaagttcaaatgaaaagtcctgacatcaatcttcaggtggagattcgtgaagaagcagcctatctttcttatgaaaccattcgtggggctggtggtttgccagttggaacttcaggtaaagggatgctcatgttgtcaggagggattgactcacctgtagcaggttatcttgctcttaagcgtggggtggatatcgaggcagttcactttgctagtccaccatatactagtcctggtgccctcaagaaagcgcaggacttgacccgtaaattgaccaagtttggcggaaatatccagtttatagaggtgcctttcacagagattcaagaggaaatcaaagccaaagcgccagaagcttatttgatgactctaactcgtcgctttatgatgcggattactgaccgtattcgtgaggtacgaaatggtttggttatcatcaatggggaaagtctaggtcaagtagccagccaaacccttgaaagtatgaaggctatcaatgctgttaccaacactcccatcattcgtcctgtggttaccatggacaagttggaaatcattgacatcgcccaggaaatcgatacctttgacatttcaatccaaccgtttgaagactgttgtaccatttttgcaccagatcgtccaaaaacaaatcctaaaattaagaatgcggagcagtacgaagcgcgtatggatgttgaaggcttggttgagcgagcagtggctggaatcatgattactgaaatcacacctcaagccgaaaaagatgaagttgatgacttgattgacaatctgctctaattcagaaaatccaaaagaatagcgaaaatcagtaaaaaaagttagttttttctctaaaaacaggtaaaaaactaactttttttatttttatgatataatgatataaaattttgaatatagagagttttctgacaatgaatcaatcctacttttatctaaaaatgaaagaacacaaactcaaggttccttatacaggtaaggagcgccgtgtacgtattcttcttcctaaagattatgagaaagatacagaccgttcctatcctgttgtatactttcatgacgggcaaaatgtttttaatagcaaagagtctttcattggacattcatggaagattatcccagctatcaaacgaaatccggatatcagtcgcatgattgtcgttgctattgacaatgatggtatggggcggatgaatgagtatgcggcttggaagttccaagaatctcctatcccagggcagcagtttggtggtaagggtgtggagtatgctgagtttgtcatggaggtggtcaagccttttatcgatgagacctatcgtacaaaagcagactgccagcatacggctatgattggttcctcactaggaggcaatattacccagtttatcggtttggaataccaagaccaaattggttgcttgggcgttttttcatctgcaaactggctccaccaagaagcctttaaccgctatttcgagtgccagaaactatcgcctgaccagcgcatcttcatctatgtaggaacagaagaagcagatgatacagacaagaccttgatggatggcaatatcaaacaagcctatatcgactcgtcgctttgctattaccatgatttgatagcagggggagtacatctggataatcttgtgctaaaagttcagtctggtgccatccatagtgaaatcccttggtcagaaaatctaccagattgtctgagattttttgcagaaaaatggtaagttaagaaaggaaaaaacgaaatgcatattgaacatcttagccactggagtggtcatcttaaccgtgaaatgtaccttaaccgttatggacatggtgggattccagttgtggtctttgcttcatcaggtggtagtcacaacgaatactatgattttggcatgattgatgcctgtgcttcctttatcgaggaaggccttgtccagttctttaccctatctagtttggatagtgagagctggttggctacttggaaaaatgctcatgaccaagcggaaatgcaccgtgcctacgaacgttatgtgattgaggaggccattcttttatcaagcacaagacaggttggtttgatggcatgatgacgacaggttgctctatgggagcctatcatgcactcaatttcttcctccagcatccagatgtctttaccaaagtgattgctctcagtggtgtttacgacgcacgtttctttgtcggtgattactacaacgatgatgctatttaccaaaactcgccagtagattatatttggaaccaaaacgacggctggtttattgaccgttaccgtcaggcagagattgtgctgtgtacggggcttggagcctgggaacaagatggtttgccatccttttacaagctcaaagaagcctttgacaagaaacaaattccagcctggtttgctgaatggggacatgatgtcgcccatgactgggaatggtggcgtaaacaaatgccttatttcctcggtaatctctatttataaaaggagttacctatgaattaccttgttatttctccctactatccacaaaactttcaacagtttaccatcgaactagctaataaaggcatcacagtcttgggaattggtcaagagtcttacgagcaattggatgagcccttgcgcaatagcttgaccgagtattttcgtgttgataatcttgagaacatagatgaagtcaaacgtgcagttgcttttctcttttataaacatggtccaattggccgcatcgagtctcacaatgaatactggcttgagctagacgcaacactcagagaacaattcaatgtttttggtgccaaaccagaggatctcaaaaagacgaaatataagtctgaaatgaagaaacttttcaaaaaagcaggtgttcctgtggtacctggagctgttatcaagacggaagcagatgttgatcaagcagtgaaagaaatcggtcttccaatgattgccaaacctgataatggagtgggagcagccgcaacctttaaacttgagacagaagacgatatcaatcacttcaagcaagaatgggaccattcaaccctttatttctttgaaaaatttgtcacttccagcgaaatctgtacctttgacgggctcgtggacaaggatggaaagattgtcttctcaacaacctttgactacgcctatacaccgcttgacctcatgatttataagatggacaattcttattatgtgctcaaggatatggatcctaaactgcgcaagtatggggaagcaattgtcaaagaatttggtatgaaagaacggtttttccatattgagttcttccgtgagggggacgattatattaccatcgagtacaataaccgccctgcaggtggttttaccattgatgtttataactttgctcattccttggacctttatcgtggctatgcagctattgtcgcaggagaggagttcccggcgtcagactttgaaactcagtattgtttggctacttctcgccgtgcaaatgctcactatgtttattcagaagaggatttgcttgccaaatatagccagcagttcaaggttaaaaaagtcatgccagctgccttcgcggaacttcaaggagattacctgtatatgctgaccactccgagtcgacaagaaatggagcagatgattgcagatttcggacaacgtcaagaataagaactatcggattaaggaaattaactcccttaatccttttgttttgtctgataaaaaataagagcatcccaacaaggtagctatcataaaacttgttcgataactatttgaagcaggattaggtggtcagaaattaaattttaatatttcaattgagtcatagtattgtgtttgcgtatccttaaatcagctaaaaggatccatgacgacacctatacgatatagttttcaagataccaaacaagtctattaatattcaatgaaaatcaaagagcaaactaggaagctagccgcaggtttctcaaaacactgttttgaggttgtggatagaactgacagagtcagtatcatatactacggcaaggtgaagctgacgtggtttgaagagattttcgaagagtataaaatattcaggtgacgcatagatatagttaattgaagctttgtttgaaatctgataaaataatgatattactaagttttaaaaactaaagaaaagggaagatatgattacaggcgaattaaaaaataaaatcgatcagctgtgggaaattctttggacagaaggaaacgcaaatcctttaacaaatattgaacagttgacttatctcttatttatgaaagatttggatagtgtcgagcttggacgtgaaagtgatgctgaatttctagggattccttatgagggagtttttccaaaagataaacctgaataccgttggtcaacttttaaaaatataggagatgctcaggaagtttatcgtttaatgactcaggagatttttccgtttattaaaaatctcaagggggatacagatgatacagccttttcacgatatatgcgagaagctatttttcaaataaataaacctgctacgcttcaaaaggcaatttctatcttagatgtttttccaactaggggattagatgtagattttgataatgacaaacaaagtattactgatatcggagatatctatgaatatctgttatcaaaattgtcgaccgcaggtaaaaatggacagttccgtacacctcgtcacatcatcgatatgatggttgagttgatgcaaccgactatcaaagatatcatctcagatcccgctatgggttctgctggcttcttagtatctgctagccgttacttaaagcgtaagaaagatgaatgggaaaccaatacagataatatcaatcattttcataatcagatgtttcatggaaatgatacggatacgactatgttgagacttggggcgatgaacatgatgctacatggagtagaaaatccacaaatcagttaccttgactcgctgtctcaagataatgaagaagccgataaatatactttggttttagcaaatcctccttttaagggctcacttgactacaattcaacctctaatgaccttcttgcaaccgtaaaaaccaaaaaaacagaattactctttctttctcttttcttgcgaactttaaaaccaggtggacgagcagcagttatcgtacctgatggtgtcctttttggttcgtctaaagctcataaaggaattcgtcaggaaattgtagagaatcataagcttgatgctgtaatctcaatgcctagtggtgtgttcaagccttatgctggagtttcaactgccattctcatctttacaaaaactggtaatggtggtactgacaaagtctggttttacgatatgaaagcggatggtttaagtttggatgataagcgacaaccgattagcgacaatgatattccagatattatcgaacgctttcatcatcttgaaaaagaagcagaacgtcagagaacggatcaatctttctttgttccagttgctgagataaaggaaaatgattatgatttgtctatcaataaatataaagagattgagtatgaaaaagttgagtatgaaccaacagaagtcatattaaagaaaatcaatgatttagaaaaagaaattcaagctggcttggctgaattggaaaaattactcaagtagggaggtggctgtatgaaaaaagtgaagttgggggaagtcttatctctaaaaaaaggcaagaaagccactgtacttgctgaacaaacaactctaagccaacgttatattcaaatagatgatttaagaaataataataatttaaaattcactgaaagtttaaatatgactgaagcactcccagatgatattctgatagcatgggatggagctaatgcaggaacagttggttatggattatcgggagctgttggtagtacaattacggtcttaaaaaagaatgagcgatacaaagaaaaaattatatcagattacttgggagtctttttggaaagtaaatcgcagtatttacgagatcattcaacaggtgcaacaattcctcatttaaacaagaatatattacttgatttacaattagaattgctaggtatcgaagaacaagagaacattatctgtattcttaatacgattaaaaggcttattactaaaagaaaatttcagttagatgaactaaacttgctcgtcaaatcccgatttaacgagatgtttggggaaaataaaatatttgaaagcattgataacttatttgatattatagatggtgataggggcaaaaattatcctaaatcagatgagttgtttagtgaggagtactgtttatttttaaatacaaagaatgttactaaaaacggattttcattcgatacaaagcaatttatcactaaaacaaaggataaattacttcgaaaaggcaaacttgagcgttatgatatagtcttgacaacaagaggtactgttggaaatgtagcgtactacgatgaattaataaaatataaacatttacgtataaattcaggtatggtaatattacgtcccaagacaccaaatctaaatcagaaatttattatccatgttttaaggaataataattatagtcgagtgatatcaggaagtgctcagcctcagttaccaattacaaaattaaaaaaaatacttctccccctccccccactagccctccaaaatgagttcgcagactttgtagtccaggtcgacaaatcacaatttgcttgtgagatagctataaaagtgtggagaaatagcttgaaatttagtataatatagctaaactatttgtttaaagtgagaaaaaaatgggaaattttagctttcttttaaaaaatgacgaatatgaatctttttcaaaaccttgcattgaagctgagaatatgattgctacatcaactgtggctactgcctttatggcgcgtcgtgctttagagcaggctgtccattggatatatagtcacgattcatatttagaagctccctatcgtgctactctatcttctttagtatgggatgatgattttagggatatcgtagattctgaactccacaagcagatagttctgttgattcggtggggaaaccatgctgctcatggtggtgaaattaaggaacgagaagcgattttagctttgcatcatttgtatcagtttgttaattttatcgattattgttacagcaatgagtttgtggagcgttattttgatgagaagtgcttaccactttcagcaaacatcaaataccgagaaactccacaatctatgataaagttacaagacagtttaccagaactgcctgattttcatgaacagatggctgctcagtccgtagaagttcaagagacttatactgaaaaacgtgagactgcagcgcaacggcaagatgtgcctttccatattgatcaattatctgaggcagagacaagaaagctctttattgatatcgatctccgtttagcaggatggatatttgaagaaaactgtcgtgttgagatagccgttgatggtctcaagcacggttcaggaattggttactgtgactatgtactttatggtaaaaatgggaaaattttagcgattgtggaggctaaaaaagcctctgtcaatccagaagtaggggaagtacaggtcaaagaatatgctgaagctttggagaaacatatcggctatcagccaatttgctttattacaaatgggttgaagcactatatacttgatggtccgaaccgccgccagattgcaggcttttactctcaagaagaattgcaattagtgatggatagacgtcatcttcaaaaaccgcttgaggatatttctagtaaaattagggacgatatttccgggcgtcactaccaaaaacatgccattgcaagcgtttgtgaagctttctctgatcatcgtagacaggcacttttggttatggcaactggggcggggaaaactcgtacagcagtttctctagttgatatcttatcacgtcataactgggtaaaaaacgttctcttcttagccgatagaacttccttggttaagcaagcatatgattcgtttagaaaattactcccagatctttccgtttgtaacttcttagaagataaagaaggagctcaatcaagtcgcatggtcttttcaacttatccgaccatgattggagcgattagtggtcaagaagaagtaaatcaacgccctttcactgttgggcattttgaccttatcataattgacgaatctcaccgttctatttatcagaaatacaagtccatttttgattattttgatgcaagaattgtaggcttaacagctactccgcgtcaagatttagataaaaacacctatggattctttaatttggagaatggggttccaacatatgcatatgatttggaagaggctgttaaagacggatatttagtagcctatcattctatcgaaaccaaactgaaactacctacggatggtctacattatgatgatttgtccgaagaagaaaaggaacattttgatagcaaatttgaagacaatagctgtgaaaaagatattgatgggagtgtatttaattcctttattttcaataaaagtacagtagaaattgttttaaatgaactcatgacaagaggaattcagacagcctcgggtgatgaaattggtaaaactattatttttgctaaaaatcatgatcatgcggaatatatcagaggtatttttaacaaccgctatcctgaaaaagggagcgactatgctcaggtgattgattatagtattaagcattatcagaccttgattgatgattttaaaattaaggagaagtatcctcaaattgcgatttctgtcgatatgttagatacaggtattgatgtaccagaggttgttaatttagtcttcttcaagaaagtacgctctaaaactaagttttggcagatgattggtcgaggaacccgtctatgtaaagatttatttggacctgagcaggataaggaaaacttcttggtatttgattatggggacaattttgattattttcgtgcagatccaagagatggagagggtcgtcacattgtttcgctgactcagcgtttatttaatatcaaagtggacttgattcgagaacttcagggactccaataccaagaagatcagtttgcgagagcataccgtcagcagcttgtctcggaacttcaaggtcgtatagagagcttaaatgagttggacttcagggttcgtatggttttagatacagtttatagctataggaaattggaaagttggcagaatctaactgctgttacaagtgaaaccattcaaaaaaatctctctccgcttttatttgatgaagataaagaagatgagatggcgaggagatttgatttgtggttgcttcatattcagttggggcaactgacagctaaatcttccactgttcatatttcccaagtgatgaagacggctagagctctttctgctattggcaatatcccgcaggtttttgagcaggctgaaattatcaggaaagtacaggagcctgaattttggaaagaagttaacttgtctgatttggaaaaaattcgtcttgctattcgagatttattacagtttttggataaaacagaccgtaaaccctactatgttaactttgaagatcgtatactctccactgttcacgagaccacagcatttttgcaggtcaacgatcttcggtcttacaatgaaaaagttgagcattatttgaaaactcatctggatgaggagtccatttctaagctataccataataaaaagttgacatctgatgatatgcttgcacttgaaaaattgctttgggaaaaattaggtagtaaagcagactaccaaagtcattatgaaaataaggcaattccgagattggttcgtgagattattggcttagatagagagtctgccaatcgtattttttctaaatttttgtcggatgagaatcttaatgccaggcagatttcatttgtaaaattgattgtagactacattgtagaaaatggttttttagagacgaaagtgttaacgcaagagccgtttaaatcttatggttctgttcaactactcttccaacaccaactaccagtacttcgtaatattgttcaaatcattgaacttatcaataatcgagctggagaagcggcttaaattctaaagtgattgccatgctgagactcatttaaaattaaaaagagtagaaatttatgctatatatgagaagttttattaggaagaatgtcatcgttttcctagaatacagtatcagttgttaagtggttgataaatttcaaagtagatacttgtaccacgatgtttgttgatcgagttattaacaaaagagctactttgattttaaagaaatagaaaacaaaaagccgagcaagaattcaattgcaggagaaaatgaaataatactcaatgaaaatcaaagagcaaactaggaaactagctgcaggctgctcaaaacactgttttgaggttgcagatggaagctgacgcggattgaagagattttcgaagagtataaatcttcctaggataaagcaaaacgcatagtatcaagggttttcaacacttgatactatgcgttttctgatgttaaagactttctaccaggttttttaaaagcataattgttagttgtagtcatttattattcttcaaagaaaaatggtggggcgaattttttcagttcttcaaagcacttttgagcagtatctgcatcttcacagatgataagacagacatcattaccacaaagggtagcgatagcgtcagggaagctcaaagtatcaatgatagaaccaaaggattgagccagtccaggaagggtttttagtaggacttggtgttgaactgggcgcatccagacaagggcgtcttccatgtagagttcgagacgtttttcccattttgagatggaaccattgttaagaacataataagcgctatcttcttcgcggacttttgataggttcatatttttgatgtcgcgtgagagggttgcctgggttacttgaatgtcgttctcagcaagaagggcttgcaactcagcctgtgtatgaatcttgttttttgtgataagagcgcgtataagttggtggcggtgttctgatttattcataataatgtaactccttttagcaaggtaaggtaagcatggactgagcgaggtcgacagtcaagtggtagtctgtattgtcacggatggtgatttcaaagtcagtagtatagaggactaaacggagagtgtctccttcttttagcttgtaaatagttggctgcagttcaaattgaacgtccatccattcatctgcagtaatatcctctactaacagtaaatcatttctattttgtaaattaaggtaaccttttgtcacgactcgttgtgcctctggtctaaatggcaattcacagagattttccaacatgtgatagcgaccgttgtcaatggttctagcacttaaaatagctggataaggttgtaggtatttcttttgcccaaattctagcagttgggcagataagagccccttgtttgtactggatttgatacgaagattgagctgagcgcgaccgtttaggtggagatctttagtcacaggaaggttaatagtaatctgattggctttcccttgatagagctctgtattgaaggtttggtatgtcttaccatagcgctcaaaatccttatctgggtactggttttgaatagcttgctcttcttgaccaagtgagaaggtttcacagttttcttgcccaccgaagttatcaagtgataaccaagtctgtggagctgtattgtcctgccagataacagtaggaagttgaaagtctgtttcctgtcctagtaatttcttggtcaataaggcatttatggactcacggaagtcaattgattgccaattgttcatgtaaacatgggcaccattatggaaaaagagatgcttgtgtatatgagtaggaagagcatggaacatctggtaaacatgaagtggtttgacattccaatcctgagaaccatgagtaaagacaacctctgcctttactttatgggcattgagcagataattgcggtcatgccaaaactgattgtagtccccagtttttcggtctagctgagctttcactttttctaagtcagcttggtgagcttcattgccacggatatagtcgccagctaagagattacgagaataggttaactcagcaagggagtcaaagtcctcacctggataaccacctgggctagtcaccagaccgttttcacggtagtagttgtaccatgatgaaattcctgcctcggcaatgataacttctaaaccatcgactcctgtagtcgcaagaccattggacatggtacctagataggaaagtcctgttgtagcaacttttccgtttgaccaatcagccttgacttgacgctggcgcgtgtgatcagtaaaggcacggcaacgaccgttaagccaatcgatgacatttttataagcctcgatttgctggtagtctccattagtcatgaaacctgtcgagtctttggtaccaacacctgagacatagagattggcaaagcctctcggaaggaagtagtcgtttagtgtatagctagagttgatgtgagttagcttttcctcagcctctgctataagctcagctttaccttggggttggacgagatttagttgaggtttctctagctcaatcttgtgaggaagcttaacctcaagctcgccctccatcttgtagagagccttgtcactagccttgtcattggttccctgatgataagggctggctgtcatgatggcagggatttttccatcaaaacgagggcgaataatgctaacctttactaggtctgatagccctttttggtcagtatcgacacgagactcaacgtaaacgacttcacgaatgacatcctggttagaaaaagtagccaaactcttgccgttaaagtagtggtagtcattatcctccggaataagaccatcactaacaagttggtcgataagagtatttccttttttggtgcgagtattgagtaactgatagagattttcaatcaagtcaccatatataatgggaaatccagtttctttacgaaaaacgtcactatcttcgaagtcaaccaaataagaaaagcctaaaagttgaaaagcaacagtataaaaaatatctgctgtcagttcatcttctgattgaaaaaatgtcagcaggtctgtttttttatcagctgctaggatagaaagtgggtagttggtgtcttgataagtgaaaaagaaacgacgtaaaaaggtttcaagtgagtctttgtgattggctgtattttgtaaatcaaagccacatttttttagttcagataagacattttcttttggaaaattgatataactatattgattaaaacgcatagaacctccatatagaatgacagttaaggttattatatcaaaaaaaaagcagaaagggaattgttaacttcaaaaggaaataatccaataaaaatgaataaagtactaaattcaatatagagaacagagtaacaataagaataaatagatagggtataaaagttctaggagatttatattatatgctttctatttttatatacaatatagtataaatataaaaatgatgacaaaaatacaaatgaatagaaaataaattagtaagctgatgaaatttttctcaagagaagccatttataggtgaaaatggtataatatagtgagaaggatagaggagaagtgtaaattgatcgcacaactagatacaaaaacagtctatagttttatggaaagcgtcatttcgatcgaaaagtatgtgagagcagctaaagaatacggctacactcatttggctatgatggatattgacaatctttatggcgctttcgactttctagagattacaaaaaaatacggcattcatcctttgctagggcttgaaatgacagtgtttgtagatgatcagggagtgaatttgcgctttttagctctatctagtgtgggctatcagcagttgatgaagctttcgacagccaagatgcagggggagaaaacttggtcagtcctgtcccagtacctggaggatatcgcggtcattgtgccttattttgatagagttgagtcgttagaactaggctgtgattactatataggggtttatccagaaacactagcaagcgaatttcatcatcctatcttacctctttatcgggtcaacgcttttgaaagcagggatagagaagttcttcaagttttaacagcgattaaagaaaatctaccgctcagagaagttcccttgcgttcgagacaagatgtctttatatcagcaagttctttagagaaactattccaagagcgttttccgcaagctttggacaatttagaaaagcttatttcaggcatttcttacgacttggatactagtctgaaactgcctcgttttaatccagctagaccagcagtagaggagttgagagagcgtgctgaactggggcttgttcagaaggggttgactagtaaagaatatcaagatagactagaccaagaattgtctgttattcatgatatgggctttgatgattatttcttggttgtttgggatttgttgcgttttggacaatcgaatggctattatatgggaatgggaaggggttctgcagtaggcagtttggtttcttatgccttagacatcacggggattgacccagtagagaaaaatctgatttttgaacgctttcttaatcgtgaacgctataccatgcctgatattgatattgatatcccagatatttatcgtccagattttatcagatatgttggtaataaatatggtagtaaacatgcggcacaaatcgttactttttcaacctttggagccaagcaagctcttcgagatgtcttgaaacgctttggtgtgccagagtatgaattatctgcaattactaagaaaatcagttttcgtgacaatcttaagtcggcctatgagggaaatctccagtttcgtcagcaaatcaatagtaagttagaataccaaaaagcttttgagattgcttgcaagatagagggctatccaaggcaaacctctgtccatgcggctggtgttgtaattagtgaccaagatttaaccaactacattcctctaaagtatggtgatgaaattccactgactcagtatgatgctcatggagttgaggctagcggacttttgaagatggactttctgggactacgaaatttgacctttgtccagaagatgcaagagttgcttgctgaaacagaaggtattcatctgaaaattgaagaaatcgatttagaagacaaagaaacgttagctttatttgcctctggtaatacaaaaggtatctttcaatttgagcaaccaggtgccattcgtctgcttaagcgtgtgcaaccagtctgttttgaagatgtcgtcgcgactacttctctaaatcgaccgggtgctagtgactatatcaataattttgtggcaagaaagcatgggcaggaagaagtgactgttctggatccagtactggaggatattttggctccaacctacggcataatgctctatcaggagcaggttatgcaggttgcccagcgacttgccggatttagtcttgggaaagccgatattttgcgtcgggctatggggaaaaaggatgcctctgccatgcatgagatgagggcttcctttattcaaggttcattagaagctggtcatactgtggaaaaagcagagcaggtctttgatgttatggagaagtttgcaggttatggttttaacaggtcacacgcctatgcctactcagccttggccttccagttggcttatttcaaaacgcattatccagccattttttatcaggtcatgttaaattcttccaacagtgattacttaatagatgcacttgaagcaggttttgaagtagcctctctatccatcaacaccattccctatcacgataaaattgccaacaaggccatctatctaggtttgaaatccattaaaggagtcagtaatgatttagctctctggattattgaaaatagaccttattctaacattgaagattttatagctaaattacctgagaattatctgaaacttcctctgctagaacctttggtaaaagttggtcttttcgattcatttgaaaaaaatcgtcaaaaagtatttaataacttagctaatctatttgaatttgtgaaagagttgggaagtttgtttggagatgctatttatagttggcaggaatcggaagattggacggaacaagaaaaattttatatggaacaagagcttttagggataggtgtcagcaaacatccactacaagctattgcaagtaaggctatttacccgattaccccaatcggaaatttgtcagaaaatagctatgctattatcttggttgaagttcagaaaataaaagtgattcgtaccaaaaagggtgaaaatatggccttcttacaggcagatgatagtaagaaaaaattggatgtcactctcttttcagacttatatcgtcaggttggacaggaaataaaagagggagccttctactatgtaaaaggaaaaatacaatcacgtgatggccgtctgcaaatgattgcacaagaaataagagaagcagttgctgaacgcttttggatacaggtgaaaaatcatgaatcggatcaagaaatttcacgcattttagaacaatttaaaggcccaatcccagtcatcatccggtatgaagaggaacagaaaaccatcgtttctccccatcattttgtagctaaatccaatgaattagaggagaaattgaatgaaatcgttatgaaaacgatttatcgctaaaaatacggaaaatagaagaattttcaacgtaaatgtggtataatcagtaagaatgttaaaagaaaaaggagcataaccaatatgaaacgtattgctgttttgactagtggtggagacgcccctggtatgaacgctgccatccgtgcagttgttcgtcaagcaatttcagaaggaatggaagtttttggtatctatgacggatatgctggtatggttgccggtgaaattcatcccctagatgcagcttcagtaggggacatcatttctcgtggtggtactttccttcactcagctcgttacccagagttcgctcaacttgaagggcaacttaaagggattgagcaattgaaaaaacacggaattgaaggtgtagttgttatcggtggtgacggatcttaccacggcgctatgcgtttgactgaacatggcttcccagctattggtcttccaggtacaatcgataacgatatcgttggtactgactttacaatcggttttgacacagcggttactactgccatggacgctatcgataagattcgtgatacatcatcaagtcaccgtcgtacttttgtaatcgaagttatgggacgtaacgctggtgatatcgctctttgggctggtattgcaactggtgctgatgaaatcatcatccctgaagcaggcttcaagatggaagatatcgtagcaagcatcaaagctggttatgaatgtggtaaaaaacacaatattatcgtcttagctgaaggtgtgatgtcagcggctgaatttggtcaaaaacttaaagaagctggagatacaagcgaccttcgtgtaacagaacttggacatattcaacgtggtggttctccaactgcgcgtgaccgtgttttggcgtcacgtatgggtgcacatgctgttaaacttcttaaagaaggtatcggtggtgttgcggttggtattcgtaacgaaaaaatggttgaaaatccaattcttggtactgcagaagaaggggcattgtttagccttactgcagaaggtaagattgtggttaacaacccagctacaaa

SEQ ID NO: 52 - DNA, 16593 bp; double-stranded, linear
tcgtaaatatgctctgtttttggattttgtttcttaatctgtttggcaagtgccttcatcatagaaataggaccacacatatagacggttgcatgttcgggcacttctttttgttcaaaattaagatagccgtctttcgtactgtcgattagatggagttcaaaattaggatttttctgagcatagttacggagtaaatctaggtagactgcattttcatctccacggaagctatagtagaagtgaacctgtttatctaaaataggatgttcacggatgtaagagatgaagggggtgatcccaatacctccagcaatccaaacctgattttctcgtccttcttctatgatcatgtgtccgtaagctctgtctagggttactttgctgccggcttgaagattatcatagatattcttggtatggtcgcctgaagttttaacagtaaagtaaagagtttgaccatgacctcctgagatagaaaagggatgcggagcactttcaaagccttcttggaaaatctttagaaaggcaaattgtcctgattgatagttgaaaggtctgctaagatggatttgaatttctctagtatcgtgatttaagcgtttgagatgggtaattttccctagataggggaaggaaatcttttgatatagaaaaatgatataaaaaccagctagtaagcctaaaagggcatagctaccaacaagaaaacttagaagattaaatgtaaggagacgattgcccattatcatgtagatgtgaaagagtcctaaaatataggctaggtaaaccaggcggtgaatccatcgccaagcttcgtattggatgtatttgcctaaataggcgacaaggatgatgctggcaaagatatagatggcaagattgccaaactgagcagctaagcgagagccccacaaaccgcccatactaaagttatgaaagattagtaggatgattgagagaaaggctgtgaatttgtggacggtgtagaccttctccaaactgtgaaaccagctttctagtagtgggagacgagtggctaggataaaagtcagagataggcttgttaaagctagtcctggaatcatgaattggggagaagtgttcatccaagtcaaaagagtcaagataaaactagctatgataaagagtagtcctttgactgatttcatagaaaattccatttcatttagatttcgatttgttgtaaataaatttgttacattttatcatagaaaatgtatggtgtcaaattgaggtctataaatatctactctcatcaaaaaactctccaattgaactggagagtggctgtttatactcaatgaaaatcaaagagcaaactaggaagctagccgcaagttgctcaaaacactgttttgaggttgcagatagagctgacgtggtttgaagagattttcgaagagtgttattctgcagcttgttgccaacgtttggctagcatatgagacaggctagaaattgctaggttaaagctgaagtagatgagggcaatcaggatgtaaagactgaagacctgctctggttcgaaataacggcccatgagaatttggctggctccaaagagttcttgtagggcgataacagagtagaggagactggtatccttaatcacggtaacaaactgagaaatgatggctggtagcattttgcggatggcttgtgggagaatgatgtagtagaggatttgggctgaggtgaagccttgtgacattcctgcttcgtactgtcccttgtctacggcattgagaccgcctcgaataatctcagccaaggctgctgatgtaaagagagtaaaggctgtaatacctgctggtgtggatttcattttgaacaccaaaaagatagtaaaaatccagagaaggttgggaacgttgcgcacaaactcgatataaatactggaaataatgcgtaagacaggatttttgccatttctcgtgacagctagcaccgtaccgatgatagtagagaggatgatggcaatcagagaaatatagagggtcaagccaaatcctttaaagataaagactaggttatctggggttaaaacttctaaaatagattccatagtaacctcctaaagtgaataggcttttttgttggcttgctccatcttgcgaccaaactgggcaacagggaagcatagagcaaagtagagaagagcagcacctaaaaaggctggtatatagtttccgttgagagccgaccaagacttagtcacaaacatcaagtctactccagagatgatagctacagtagaggtgttcttgatgaggttaacaatttggttggtcaatggagggagaatgatgcggaaggcctgaggcaagataatcaagcgcatggcactgatataggtaaaaccttgcgacaaggcggcctccatctgaccactaggaatagactgaatccctgaacgaataacctcagcgatataagcgccgtgatagagtcccacgcagagaacggctgtccaataaattggaatcatgatgatatggtcactgataagaggtaggccataaaaaacaataacaaactgcaccaagaggggagtattttggtaaaattcaacaaagatgcgagctaaaatgcgtaaaattggacgtttactggttgacatggcaccaaagaagatgcccaaaaccatagcgaggataaaggaaccaaccgctagggcaagggtgaagaggaaaccattgaaaaattgtccaaaatcctgaaaataggctgtccaagatgataaatctgtcatggggtgtcctccttaatctgcagtatggctagatggtttgagcttgtaacggtcataaagtttctgcaaactaccatccttgctccatttagtaaccaagttatcaagatagtcgttgagctctgtatttgatttcttggtaacaataccgtagtcagatggcttgaaactatcatctagtagtgctgtccgtttactagtgtagccagatagaatagagcggtcaacggaaaaggtatcgatacgatgagcgtgcagggaagtaatcaattctgggtaggaaccaagttcgacgaatttaaacttcagacctttctttttacccagttcagtaatcaggcgttgggtgatagaaccttgggcgactccgatggttttgccgtttaggtcctcaatctttttgattttggcagatttattgaccaaaaatccagaagcgtctgtgtagtagggactggtaaagttgtagagttttttgcgttcgtccgtgatggtaaaggtcgcgatatccatatcgacctgttcattgtctagaagggggccgcgggtttgtgctgtaaccggcacatagcgaatcttgaccttgagttcatcagctaccatcttggccaagtcggtttcgataccagaataagtaccggtcttgggatctttgtaaccaaaattgggaacgtcttgtttgacaccgacaaccagttcgcctcttttttgaatgtctgcgatacttgtatcagcctggactggtttggcagcagcaaggccgaaaaggctaatcaataatgctgataaaaagaattttttttcataggcgcctccttatttgactttgtcactttcgtggttgataattttgctgaggaattgttgggcacgaggttcgcttggattgtcaaaaaagttatcgacatctgtcgtatctactaaaacttctccgtcggccataaagataatgcggtccgcaacctctcgagcaaagcccatttcgtgggtaacgatgatcatgttcatcccatcatgcgccagtttctgcataactgctagaacatctccgatagtctcaggatcaagagcagatgttggttcatcaaagaggaggagttccggatgcatagcaagaccacgagcgatggcgatccgctgtttttgtccaccagatagcatggcgggataggaatctttcttgtcccacatatttacaaattccagatatttttgggcggttttttcagcttcttttttatcaattcctagaacttcaatgggtgcaagcgttacgttttctaacacagctttgtgtggataaaggttaaaatgttgaaaaaccatgccgacttccttgcgaagaggtaccaaatctttctggctggcaccagcaacttggtgcccattgactaggagacttcctttgtcaacagtctctaaaccattgatcgtacggataagagtggacttcccagagccagaaggtccaagcaggacaacaacttgtcctttttcaaaacggagattgatgttgcggaatgcgtggtagtctccgtaatatttttcgacgtttttaaattctactaaagccatgagagatctctattgtgttatattttataacacggttctacaataaaagaatgttcttgtcaaatcatatctgaaaaaattcactatagtgaaataagaacaggaaaaatcgatcgggacagtcaaatcgatttctaacaatattttagaagtagaggtgtactattctagtttcaatatactataaaatgttataaaaaagcaatctggatagagaaaacgtctaaatcatgttataatgaagcaatagaattcttagaaagagtggatgtctttttgataacacctacttatgaatggcagtttgccctgcaggtagaagatgcggattttacaaagatagccaagaaggctggactgggtcctgaggtggctcggttattgtttgagagagggattcagaaccaagaaagtctgaagaagtttttagaaccttccttggaggacttacatgatgcttatctgctccatgatatggacaaggcagtggagcggattcgtcaggctattgaagaaggggaaaatattcttgtttatggagactatgatgcggatggcatgacttcggcttctattgtgaaggaaagtttggaacaacttggtgctgagtgccgagtttacctgccaaatcgttttaccgatggctatggccctaatgctagtgtttataaatactttatcgagcaagaagggatttccttgattgtgacggtggacaatggggttgctggtcatgaggctattgcattggctcagtctatgggagtagatgtcattgtgacagaccatcattccatgcctgaaaccctgccagatgcttatgctattgtccatcctgaacatccagatgcggattatccttttaaatatttggctggttgtggagttgctttcaagttggcttgtgccctgttagaagaagtgcaagtggaattgcttgatttggtcgctattggaactattgcagatatggtgagtctgacggatgaaaatcgtatcttagttcaatatggtctggaaatgttgggtcatacccagcgcattggtctgcaagaaatgctggacatggctgggattgctgccaacgaagtaacagaagaaacggttggtttccagattgctcctcgtttgaatgccttgggtcgcttggatgatcccaatcctgccattgatttgttgactggatttgatgatgaggaagcgcatgagattgcccttatgattcaccagaaaaacgaagagcgcaaggaaatcgttcagtctatctatgaagaagccaagaccatggtggatcctgagaagaaggttcaggtcttggccaaggaaggctggaatcctggggttctaggaatcgtggctggtcgtttattggaagaattgggacagacagtcattgttcttaatatagaagacggtcgtgccaagggcagtgctcgtagtgtggaagcggtcgatatttttgaagctctggatccccatcgagacctcttcatcgcctttggaggtcatgcaggtgcagcgggtatgacgctggaagttgagcaactctcagatttatctcaggttttggaagattatgttcgtgaaaaaggtgcagatgctggtggcaagaataagttaaacctagatgaagagttggatttggaggcacttagcttggaaacggtcaaaagttttgaacgtttagctccttttggaatggataatcagaaacctattttttatatcaagaattttcaggtcgaaagtgctcgtactatgggggcaggtaatgcccatctaaagctgaaaatttccaagggtgaggcgagttttgaagtggtagcctttggtcaaggcagatgggcgacagagttttctcaaaccaagaatctagagttagcggttaaattgtctgtcaaccaatggaatggccaaactgccctccagttgatgatggtggatgcgcgagtggaaggtgttcaactttttaacattcgtggaaaaaatgcagtcttgccagaaggtgttccagtcttggattttcctggagaactgccaaatcttgcggctagtgaagctgttgtcgtaaaaaacattccagaggatattactcagctgaagaccatttttcaggaacagcatttctctgctgtctatttcaaaaatgatattgacaaggcttattatctgacaggttatgggactagagatcagtttgccaaattgtacaagactatttaccagttcccagagtttgatattcgctacaagctgaaagatttggctgcatatcttaatattcaacaaatcttgctggtcaagatgattcaagtatttgaagaactaggctttgtgacgataaaagatggtgtgatgacagtcaataaagaggcgccaaagcgggagataggagaaagtcaaatttaccaaaatctcaaacaaaccgttaaagaccaagaaatgatggcgctgggtacggtgcaagaaatttatgattttttgatggaaaaagagtagaagttaggaaagagttgggaaatcaactcttttttgaaaacagaccttcattttgaaaatcatcaaaaaaatggtataatggtaggaaaagattcggctgaaagtatcagaacttttagaataagagggtagaattgccctataatcaagataaactaagattttggaggaaaaatgagtaatatcagtttaacaacacttggtggtgtgcgtgagaatggaaaaaatatgtacattgctgaaattggagagtccatttttgttttgaatgtagggttaaaatatcctgaaaatgaacaattaggggtcgatgtggtgattccaaacatggattacctttttgaaaatagcgaccgtattgctggggttttcttgacccacgggcatgcggatgccattggtgctctaccgtatctcttggcagaggctaaagttcctgtatttgggtctgagttgaccattgagttggcaaagctctttgtcaaaggaaatgatgccgttaagaaatttaatgatttccatgtcattgatgagaatacggagattgattttggtgggacagtggtttccttcttccctacgacttactccgttccagagagtctgggaattgtcttgaagacatcggaaggaagcatcgtttatacaggtgacttcaaatttgaccaaacggctagtgaatcttatgcaactgattttgctcgtttggcagagattggtcgtgacggcgtcctggctctcctcagtgattcggccaatgcagacagcaatattcaggtggctagtgaaagtgaagttagggatgaaattacccaaactattgctgactgggaaggtcgtatcatcgttgcagctgtttccagtaatctttctcgtattcagcagatttttgacgctgcggataaaacaggtcgacgtatcgtcttgacaggatttgatattgaaaatatcgtccgcacagcgattcgtcttaagaagttgtctttagccaacgaaattcttttgattaagcctaaagatatgtctcgctttgaagaccatgagttgattattcttgagacaggtcgtatgggtgagcctatcaatggacttcgtaagatgtcgattggtcgccatcgttatgtagaaatcaaggatggggacctagtctatattgctacggctccgtctattgctaaagaagcctttgttgcgcgtgtggaaaatatgatttatcaggcaggtggggttgtcaaattgattacccaaagtttacatgtatcagggcacggaaatgtgcgtgatttgcagctgatgatcaatcttttgcaacctaagtacctcttccctgtccaaggggagtatcgtgagttggatgctcacgctaaggctgccatggcagttgggatgttgccagaacgcatcttcattcctaaaaaggggacgaccatggcttacgagaatggagactttgttccagctggatcggtttcagcaggagatatcttgattgatgggaatgccattggtgatgttggaaatgttgttcttcgtgaccgtaaggtcttgtcagaggatggaattttcatcgtggctattacagtcaaccgtcgtgagaagaaaattgtggctagggctcgtgttcacacgcgtggatttgtttatctcaagaagagtcgcgatattctccgtgaaagttcagaattgattaaccaaacggtagaagagtatcttcaaggagatgactttgactgggcagatctcaaaggtaaggttcgtgacaatctgaccaagtacctctttgatcaaaccaagcgtcgcccagccattttaccagtagtcatggaagcaaaataatcgttgaaataaacagagagaaagtcgagtttcggctttttcttatagaaaaatagaaggagaaaatcatggcagtgatgaaaatcgagtattactcacaagtattggatatggagtggggggtgaatgtcctctaccctgatgccaatcgagtggaagaaccagagtgtgaagatattcccgtcttgtaccttttgcacgggatgtctggaaatcataatagttggcttaagcggaccaatgtagaacgcttgcttcgaggaactaatctcatcgttgttatgcccaataccagcaatggttggtacaccgatacccagtatggttttgactactacacggctctagcagaggaattgccacaggttctgaaacgcttcttccctaatatgacgagcaagcgtgaaaagacctttatcgctggtctttctatgggaggctacggctgcttcaaactggctcttacgacaaatcgtttttctcatgcagctagtttttcaggtgccctcagctttcaaaacttttctcctgaaagtcaaaatctgggaagtccagcctactggagaggtgtttttggagagattagagactggacaactagtccctattctcttgaaagtctggctaaaaaatcggataaaaagaccaaactttgggcgtggtgtggcgaacaggatttcttgtacgaagccaataatctcgcagtgaaaaatctcaaaaaactaggttttgatgtgacctatagccatagcgctggaactcacgagtggtactactgggaaaaacaattggaagtttttttaacaaccctaccaattgatttcaaattagaagagagactgacttagtttgaacttcagcatagggggagtagaactaaaataaaatatgttttcactagacttttcaaacgmaagtagtagaatagtaataaaatactggaggaaagagagtaggaaatgtaccgttatcaaattggcattcccacattagaatatgatcagtttgtcaaagaacatgaattagccaatgtattacaaagtagtgcttgggaggaagttaagtctaattggcaacatgagaagtttggtgtttacagggaagaaaaattactggcgacagctagtattttgattagaactcttccgctaggctataaaatgttttacatcccaagaggacctatattggattatggggataaagaactcttgaattttgccattcagtctattaagtcctatgctcgcagtaagagagcggtttttgtgacttttgacccaagtatttgcctatctcaaagtttaatcaatcaggaaaagacagaatttcctgaaaatctggctattattgatagtttgcaacaaatgggagtaaggtggtcaggaaaaacggaggaaatgggagacaccattcaacctcgtattcaggcgaaaatatacaaggaaaattttgaagaagataaactttccaagtcaacaaaacaggctattcgaacagcacgaaacaaagggcttgagattcaatatggtggactggaactattagattcattttcggagttgatgaaaaaaactgagaagcgaaaagagattcatttgaggaatgaagcctattataaaaaattgttagataattttaaggacaaggcctatatcaccttggccaccttggatgtttctaaacgttcgcaagagttagaagaacagttagcgaaaaatagagccttggaagagacctttactgagtcgactcgaacttcaaaagtagaagcgcagaagaaggaaaaagaacgtttgttagaggaattgaccttcttgcaggaatatatagatgtaggtcaagcgagagttcctttagcggctactttgagtttggaatttggtactacctctgtcaatatatatgctggtatggatgatgattttaaacgttacaatgcaccaattttaacttggtatgaaacggctcgctatgcctttgaacgaggtatgatctggcaaaatttaggtggtgttgaaaactctctcaatggtggactttatcattttaaggaaaaatttaatccaacgattgaagaatacttgggtgaatttacaatgcccactcatcctctctatcctctgttaagacttgctcttgatttccgtaaaacattaagaaaaaaacatagaaagtaagtatatggcactaacaacactcacgaaagaagagtttcagacttattctgatcaggtttcttctcgttcctttatgcaatctgtccagatgggggatttgctagaaaaaagaggggctcgaattgtttatcttgctttgaaacaagaaggagaaattcaagttgcagctctggtttatagcctgcccatgctgggtggtctgcatatggaactcaattcggggccgatttatacccaacaagatgctcttccagttttttatgcagagttaaaagaatatgccaagcaaaatggtgtattagagttgcttgtaaaaccctatgaaacttatcaaacttttgatagccaaggtaatccaatagatgctgagaaaaaaagtattattcaagatttgactgatttaggttatcaatttgatggcttaacaacaggttacccaggtggagaaccagattggttatactataaagatttaactgaattaactgaaaagagtttgcttaaaagttttagcaaaaagggtaaacccttggtgaaaaaggctgaaacctttggcattcggttgaaaaagttaaaacgtgaagaactatcgatttttaagaatataacaaaagaaacctctgaacgtagagaatatagtgataaaagtttagaatattatgagcatttttatgatacttttggagaacaagcggagtttctcatagcaagcttaaatttttcggactatatgagcaaattgcaaggtgaacaaagtaaactagaagaaaacttggacaagttgcgacttgatttgagtaaaaatcctcattctgagaaaaaacaaaatcaactgagagaatattctagtcaatttgaaacgtttgaagttcgaaaagcagaagcgcgagacttgattgaaaaatatggagaagaagatattgttttagctgggagtttatttgtttatatgcctcaggaaacgacttatctctttagtggttcctacactgagtttaataagttctatgcccctgcactgcttcaaaaatatgttatgttggaaagcataaaacgtggaatacctaaatacaacttcctaggcattcaagggatttttgatggaagtgatggtgttttgcgttttaaacagaattttaatggctatattgtacgcaaagcaggtactttccgttaccatccatcgcctttaaaatacaaagctatccagttactcaaaaaaatagtaggacgttaagatgaaaaagtcagtatttagatttcttttagcttcttttagtaaaataattcttatttgctagaaaggtggagagacatgcgctggctttttcgtttgataggggctttcttttcttttgtgtggcgtttgttttggcgtctggtttggatagttgtgctcttatgtgtgcttgctttcggacttctctggtatctgaacggagattttcaaggagcgctaaagcaagcagaacggtcagtaaaaattggtcaacaaagtattgaccaatgggagaaaacagggcaactgcctaagttaagccagacagatagtcaccagcattctgaaggaaggtgggcacaggcctctgctcgtatttacctggatccgcagatggattcacgctttcaagaggcttatttagaagcaatccagaactggaatcaaactggtgcttttaactttgaactcgtgactgagtctagtaaggcggatattacggctacggagatgaacgacggaggcactcctgtggcaggagaggcggaaagtcaaactaatctcttaacagggcaattcttgtccgtaacggtgcggttgaatcattattatttgtccaatccatactatggctactcctatgaacgccttgtccatacggcagaacatgagttaggtcatgcgattggcttggaccatacagatgagaagtctgtcatgcaaccagcaggttccttttatggtatccaggaagaggatgttgcaaacctccgaaaaatatatgagactagtgagtagggtactatctttccctactttttttgctataatggaactatgaacaacttgattaaatcaaaactagagctcttgccgaccagccctggttgctacattcataaggataaaaatggcaccattatctatgtaggaaaggctaaaaatctgcgtaatcgagtacggtcctattttcgtggaagtcatgataccaagacagaggctctggtgtctgaaattgtggattttgaatttattgttacggagtctaatattgaggcacttctcctagaaatcaacctgatcaaggaaaacaagcccaagtacaatatcatgctcaaggatgacaagtcctatcctttcatcaaaatcaccaatgagcgctatccacgcttgattatcactcgtcaggtcaaaaaggacggaggtctttattttggaccctatcccgatgtgggggcagccaatgaaatcaagcggttgctggatcggatattcccttttcgtaagtgtaccaacccgccctctaaggtctgtttttattaccatatcggccagtgtatggcccacaccatctgtaagaaggatgaggcttatttcaagtctatggcccaggaggtgtctgattttctgaaaggtcaggatgacaaaatcatcgatgatctcaagagtaaaatggcagtagcagcacaaagtatggagtttgaacgtgcggcggaataccgtgacctgattcaggctattggaacgcttcgaaccaagcaacgggtcatggcgaaagatttgcaaaatcgcgatgtctttggctactatgtggataagggctggatgtgtgtgcaggttttctttgtccgtcaggtaagctcatcgagcgcgatgtcaatctcttcccctacttcaatgatccagatgaggattttttgacctatgtaggacaattctatcaagaaaaatctcatctagttcccaatgaggtactgattccgcagatattgacgaagaagctgtcaaggctttggtggattccaagattcttaagcctcaacgtggagagaaaaaacaactggtcaatctagccataaaaaatgctcgtgttagtctagagcagaagttcaatctgctagaaaaatctgtcgaaaagactcaaggagctattgaaaatctagggcgtttgctccaaatcccgaccccagtacgtatcgagtccttcgataactctaatatcatgggaactagccctgtttcggctatggtggtctttgtcaacggtaaaccgagtaagaaggattaccgtaagtacaagataaaaacggttgttggaccagacgactatgccagcatgagagaggtcattcgcagacgctatggtcgagtacagcgtgaggctttgactcctccagatttgattgtgattgatggggggcaaggtcaagtcaatatcgctaagcaggttatccaagaggaactgggcttggatattccaattgctgggctgcaaaagaatgataagcaccaaacccatgaattgctctttggagatccgcttgaggtggtggatttgtctcgcaattctcaggaatttttcctcctccaacgcatccaagatgaggtgcaccgctttgctatcactttccaccgccaactgcgctccaaaaattctttctcatctcaattggatgggattgacggtctgggacctaaacgcaagcagaatcttatgaagcatttcaagtctttgaccaaaatcaaggaagccagtgtggatgagattgtcgaagttggggtacctagagtcgttgcagaggctgtgcaaagaaagttgaacccgcagggagaagccttgcctcaagtagcagaagaaagagtagattaccaaacggaaggaaaccacaatgaaccataaaatcgcaattttatcagatgttcatggcaatgcgacggcgctagaagcagtgattgcagatgctaaaaatcaaggggccagtgaatattggcttctgggagatatttttcttcctggtccaggcgcaaatgacttagtcgccctgctaaaggaccttcctatcacagcaagtgttcgaggcaattgggatgatcgtgtccttgaggctttagatgggcaatatggcttagaagacccacaggaagttcagctcttgcgtatgacacagtatttgatggagcgaatggatcctgcaacgattgtctggctacgaagcttgcctttgctggaaaagaaagaaattgacggattgcgcttttctatctctcataatttacctgacaaaaactatggtggtgacttgctagttgagaatgatacagagaaatttgaccaactgctagatgcggaaacggacgtggcagtttatggtcatgttcacaagcagttgcttcgttatggaagtcaagggcaacaaatcatcaatccagggtcgattggcatgccctattttaattgggaggcgttaaaaaatcaccgttcccagtatgccgtgatagaagttgaagatggggaattactcaatatccaatttcgtaaagttgcttatgattacgaagctgagttagaattggccaagtccaaggggcttccctttatcgaaatgtatgaagaactgcgtcgtgacgataactatcaggggcacaatctggaattattagccagcttaatagaaaagcatgggtatgtagaggatgtgaagaatttttttgattttttgtaagagtttcctaaaatagccaatgcaaactaaaaaagcgatttgctggtccaatcgcttttagtatatcttatactcaatgaaaatcaaagagcaaactaggaagctagccgtaggttgctcaaagcacagctttgaggttgcagataaagctgacgtggtttgaagagattttcgaagagtgttattgtaactgagattgatctgggaggtaagaaccacctagataggtattgctgagtttttcaagggttccgtcttgatagagttctttgagcgctttatcaaattgctctttaaactctttttggtcgcttgagaaaatgatataattgctggggctatctgcagaaggtaaatcaacgactgagaggtctaaaccacggtccttgataatcttttgaacggataccttgtcaaaaactaggaaatcaaactctccgttagcaaggtctaggattcgtttaccaatatcctcaccagaaaaattaattgtagcgggattatcagtgtgtttctgattccagttattgatgaattgagcgttagaagttccggtatcctcttgtgttgttttaccagcgatctggtcaagagaagtcaaaggatttttcttgttgctgacaaggacgaggggattgttggaaattggaagcgagtaaaggtatttttcagcacgctcttttgtgtaactcaagttattggccgcagcctgatagtgaccagaatcaagtcctgggaagatgctctcccaggcggttctttggaattgaatctcgtagtcgctgagtttttcatctactgcctttaaaacttcgatatcaaagcctgtcagattgcccttgtcttcgtagtcaaatggtggcacgtcgccagctgtagcaaggacgattgtcttttgagcgctagtctctttgggtgtagcttgattctcacaggcaaccaaaaatggtaggatagctagtaataggctaaattttttcatactgtctccattcaaatgtaaag

SEQ ID NO: 53 - DNA, 3510 bp; double-stranded, linear
gggatatccttatatccttgttcctggaaccattgtgggaattgctcaacagttttttcaccttgaattcctggtgcaatgacagtaagaatttcgaaatcacgatctggtttcgccgctagttccatcaactctggcatacttttcttgcatggaccacaccatgaagcccaaaacttcaagtaaacctttttacccttaaaatcagataacttaacttctttgccatccatggattgcaatgtgaagtctggagcatcttttccaacagcaatttgttgtacagtcgtttgttgttttggctgttgtgctgcttgagtctttttagtttcttcctcaccacaggccatcaatacaactaatgacaagagacttaagccagcaaacattacttttttcatttgtcctcctttattcaaaaattccagctagaacatttacttgtcctaatagtaacaaaattcccattaaaacaatgaggaaaccaccaattttctttagtagcatcatatgacgcttgattttactaaaatatggcatgactagacctgaagctagtgccaataccaagaaaggaagggccatgccagagtgtaaatgagagtataaatcgctccttgccaagcgccattgcctccagaagccgcaagtgctaaaacagaacttaaaactggaccaatacaaggtgtccaaccaaagctaaaggtaataccaagtaaaaaagctgaccaataacgattagaatctgattttttaaaggtaaaacttttttgaacttctaatttcttcaaatgaaaaatttccatctggtgaagacccaaaatgataataatagctcccatgccatatcgaaaccaatttgcatagagaatatgaccaaagtaaccagcaccaaagcctagaataaagaaaatgagagagataccagcgataaagcaaagtgttcgaatcaagcctgaccagagaacctttctcccaaacaaagaaaagctttttgcactttcttgatcatccaataaaatcccagcatagactggcagaagaggaaaaatacaaggagaaaaaaaggataaaacacctgctagaaaaacagagattaaaaatactatcgtttccaataaagaaccaactttcttaataattctaatcctattttactatattcaattttatttgtaagctttctgctacgcaaaatcgtatcgggcactattggaccaatcttttcttttgctagtcaaggcggatcttatcccccaaaatagccaaaaagcaacgacaaggattactcatcgctgcttttgtgaacgaaaatgtcttttaggtctgacatttcataaatcatgttttacttgagtttgtcaaggattgctttaagctcctctactagtttagtttctgtctctgctgagccattttcttctttcacgaaatcaagggtttcttggagaaggttttgggctttggcaaggacttttttatccgctttttctgcatctagctgtcctagaaccttgatcaattccgtgcttaattgctggatttctgactctttcttacggcgaatcagccagaaggcaatcacgcctaggagggcaagtagactgaccacaatcactcctgccggaactgagtttgtttcagtcatcttatctgaatccttactatcttccgttccttgttttgcatccttcttgtcctgtgcaggcttgctgtcgctagcatttgctttcacatctttgagagagtccaaggcagcccagccttcacagactctactgcagtatgcagaccttactctgtcaaggcactatcttccggagctttttgagcatctaggaggacagccttggttgcatcgattttcggatcagatactgttgccaaagctttcaagcgttggtctaactcttgactcaaggcacgaagttcagacttgtcaacttgctcttgagcttgtgtgctcgttgagctagccgaagcgcttgctaccactctaggatcttgagtcggagctgagcttggagctgggacagggcttgcaggttgactaggaacagttatggtatattgaaactagaatagtacatatggacttctaaaacattgttagaattcgattttactgtcctgatcgatttgtcctattcttatttcattttactataataaccgatggtgtggttaatgttggtaagagaaacttctgaaaccaagcttcaaaaaagtcgctcgtcatcgtctcttcgtaagtcattggagcgattaattcaccatttgttagacctgcaaccaaagaaatcctctgatatcttcttccagatactttgcctcttattaactgaccttttaatgagcgaccatattctcgataaaaataagtatcgaatcctgtttcgtcaatctaaacaggtgctaggtgctttaaactattaaaattcttaagaaataaggctactttttctgggtcttgttcatagtaggtgtggttctttttttcgagtgtagcccatagctttgagcgcatagtggatggtagttggatgacagccaaaktcagaagctatttcagtcaaataagcrtctggattgtcagtaagatagtttttaagtctatctctatcaacttttcttggttttgttccttttacttggtggtttagctctcctgttttctcttttagctttaaccagccataaatggtattacgtgagatttggaaaacgtgtgatgcttctgttatactacctattcgctcacaataagagagaacttttttacgaaaatctattgaatatgccataagaagattataccacattgtgtactatttttggttcatttcactataacacaaaatagattattattacataacaaaaaagaggtctaaacctcttaactcaattactccgccagtaggactcgaacctacgacatcatgattaacagtcatgcgctactaccaactgagctatggcggattaaagctaagcgacttccctatctcacagggggcaacccccaactacttccggcgttctagggcttaacttctgtgttcggcatgggtacaggtgtatctcctaggctatcgtcacttaactctgagtaatacctactcaaaattgaatatctattcaatttaagaaaaccgttcgctttcatattctcagttactttggataagtcctcgagctattagtattagtccgctacatgtgtcgccacacttccacttctaacctatctacctgatcatctctcagggctcttactgatatataatcatgggaaatctcatcttgaggtggkttcacacttagatgctttcagcgtttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgt

SEQ ID NO: 54 - DNA, 20986 bp; double-stranded, linear
cggagaaaaacatggctaagtcaaactttgaaaaagtagaatcagttgttggctgggttcgtgataagaaaatcacaggctaccgtatctctaaagaaacgaatgcgcgtgaaatgtctatcattgctctggcgcagggtcgtgcaaaagtaaaaaatatttcatttgaaacagccctaggcctaattgatttctatgaaaaaaattatgaaaaatttgaagattaatctttggataacggcggattcttgaccttcaagtagtagagatagagaatctgccttttcattttgaggacagcaaaaagactgcacggttgatgcagccttttctttttatttgagatagcgttgaaggaactcttttgttcggtcttctttaggattggtgaagaggtcttctggtttaccttcttcagcgatcacgcccttatccataaagataacacggtgagagacatcacgggcaaattccatttcatgggttacgacaatcatggtcaagccttcctgagccaggtcctgcatgattttgaggacttctccaaccatttctggatcgagagctgatgttggttcatcaaagagaatagcgtccggattcatggagagggcacgagcgatggccacacgttgtttttgaccacctgagagttgttttggtttggcttgccagtagcgttctcccatgccgaccttttccaggttttctttggcaatcttttcagcttctgtgcgttcgcgttttaggacagttgtctgagcgacgattgtgttttcaagaacattgagattttcaaagaggttaaaggattggaaaaccatccccaacttttcacggtattgcgtgaggtcatagcctttttcgaggacgttttgtccatgataaaggatttgtccatcagttggtgtttcaagtaggttaatggagcgtaggaaggtcgattttccgcttccagagcttccgatgatagagatgacctctcccttgtggacagtgagtgaaatgtcttttagcacttcgttttgtccataggattttttgaggtgtttaatttcaaggattgcttgtgtcattatttcaaatcctccgtttgcatttggttagcacctgtagtgtaggtatccatgtccattctgcgctcgataaagcgtaggatacgtgttacggtgaaggtgaggacaaagtaaatcacggcgatgattgtaaatgtctggaagtattgataggtttgtgttgccacggtatttcctgagaaataaagttcgacaacagagataacgttcaatacagatgtatctttgatattgatgacaaattcattaccagttgcaggtaggatgttacggactacctgaggtaggacaatcttacgcatggtctggttatgggtcataccaagagcagtcgcagcttcaaattgtcccttgtcaactgctaggataccaccacggacgatttcagtcatgtaggcaccggtattgattgaaacgatgaagatagcagccagtgtacggtcaaggttgatcccgaaagcttgggcagttccatagtagataaccatcgattgaacaatcattggcgtaccacggaaaatttcaatgtagacattgagaacccagccgactagtttttgtaggccgtaaatgactttgttttcagagagaggagcagtacggaagacaccaatggcaagtccaataatgagacctatgatggttccgacgatagagattaaaagagtgataccagcaccacgcaagagttgttgccagttttcagaaagaattttagcaacttggctaaagaaactactgctagtctcttcagttgttgtagcttcggcaggttgttccttgatcatacgatccatcaaggcaacttggtcatcttttgaaatggtttcaatgctggcattgatttggctaatacgattgtcatttttacgaagcccgatagcgatagctgtatcttcttccccagttttgaaaccaggttctacttgaatcatcttgaacttagagttcgcagcttcagcagtcagtgcttctggacgttcagaaacataagcatcaatgacaccagcctcaagagcttgtcgcatttgagcgaagtctcccatggctgtttcttttttagcacctgggatttgtgcaatcaagttataaaggtagaccccttgttgagaagtgatttttgcaccgttaaagtcatccaaagatttagcacttgcgtaggcagaatcttttttgacaagcaaaactggttcgctagtatagtaactgctcgaaaaggcaatttcttgtttgcgttctgcagttggactcatacctgcgataatcatgtcaatcttaccagaagtaagggcagggactagaccttcccacttggttttaacaaccaaaggttctttacctaagtccttagcgattttcttggcgatttgaacatcgtatccgttggcatactgattggtcccatcgattttgacagctccgttgctatcatcatcctgggtccagttaaagggagcatatgctgcttccataccgatgcgtaaatattcatcggcttgagcaacattgacaagtcctagcatcagcaagagacttgtgaaaatagataagtayatgtggctcatgatttctcctattctgatctattaaaaaataactgtctcctattttatcgaaaaatgcgtaatttttcaacataagtaagtctttacttacgaaaaaatgctataatgataagaaagataaaaagggggcttagttgatgaaaaaaacttttttcttactggtgttaggcttgttttgccttcttccactctctgtttttgccattgatttcaagataaactcttatcaaggggatttgtatattcatgcagacaatacggcagagtttagacagaagatagtttaccagtttgaggaggactttaagggccaaatcgtgggacttggacgtgctggtaagatgcctagcgggtttgacattgaccctcatccaaagattcaggccgcgaaaaacggtgcagaactagcagatgtgactagcgaagtaacagaagaagcggatggttatactgtgagagtctataatccaggtcaggagggcgacatagttgaagttgacctcgtctggaacttaaaaaatttacttttcctttatgatgatatcgctgaattaaattggcaacctctgacagatagttcagagtctattgaaaagtttgaatttcatgtaaggggagacaagggggctgaaaaactctttttccatacagggaaactttttagagagggaacgattgaaaagagtaaccttgattatactatccgtttagacaatcttccggctaagcgtggagttgagttgcatgcctattggcctcggaccgattttgctagcgctagggatcagggattgaaagggaatcgtttagaagagtttaataagatagaagactcgattgttagagaaaaagatcagagtaaacaactcgttacttgggtcctcccttcgatcctttccatctccttgttattgagtgtctgcttctattttatttatagaagaaagaccactccttcagtcaaatatgccaaaaatcatcgtctctatgaaccaccaatggaattagagcctatggttttatcagaagcagtctactcgacctccttggaggaagtgagtcccttggtcaagggagctggaaaattcacctttgatcaacttattcaagctaccttgctagatgtgatagaccgtgggaatgtctctatcatttcagaaggagatgcagttggtttgaggctagtaaaagaagatggtttgtcaagctttgagaaagactgcctaaatctagctttttcaggtaaaaaagaagaaactctttccaatttgtttgcggattacaaggtatctgatagtctttatcgtagagccaaagtttctgatgaaaaacggattcaagcaagagggcttcaactcaaatcttcttttgaagaggtattgaaccagatgcaagaaggagtgagaaaacgagtttccttctgggggctcccagattattatcgtcctttaactggtggggaaaaggccttgcaagtgggtatgggtgccttgactatcctgcccctatttatcggatttggtttgttcttgtacagtttagacgttcatggctatctttacctccctttgccaatacttggttttctagggttagttttgtctgttttctattattggaagcttcgactagataatcgtgatggtgttctaaatgaagcgggagctgaggtctactatctctggaccagttttgaaaatatgttgcgtgagattgcacgattggatcaggctgaactggaaagtattgtggtctggaatcgcctcttggtctatgcgaccttatttggctatgcggacaaggttagtcatttgatgaaggttcatcagattcaagtggaaaatccagatatcaatctctatgtagcttatggctggcacagtacgttttatcattcaacagcacaaatgagccattatgctagtgtcgcaaatacagcaagcacctactctgtatcttctggaagtggaagttctggtggtggcttctctggaggcggaggtggcggcagtatcggtgccttttaaagagagctaccatagactgaaaaagtatgatataatggaagatagaaaaaagacaaactataagaaaagtcaatagttttatctaaactatttcttatttcaatttgatgatttggcgatgattttagagcacggcaaaaagcccttgaaaaagtccattttttcaaaggtaatcctgtgttaatttcagaaattacatcactttttgttcgtcaaatggcagctcttttttaggatataaaacagggttcggataagtttttttgcaaggtggatgatggctacattgtaatgttttccttattctaacttagtcttaagataggccttagaagcaggtgaaaagcgagggcatgctttggcagcttgtatgagtgcccaccgcagatgaggggaaccccgtttgaccattcttccagctaaatcaatctgacctgactgataaatagaagaatccagtccagcgaaagcttgtaattgagcaggattatcaaaggcatgaatatttcgaatctcggctaaaatgaccgccctaaacgatccccaatcccagtaaccgtcgtgatgaccgagttgaactcagccatcgagtcattgatacatgtttccgccttgtcaatgagcctcttgtaatgcttgatgatttcgaattcacgagcaggagatgttgttccgatagaacgaggtgcgactgagaggatatcctgaattttagaagcggtcaatcgcttaatttctatcagcttatcaaatcctgcctcaatccttttctgaggattagggtagcgtgtcaagagttggtaggtatattctgaatgctttccaacgattttatccaactcaggaaagatgatatcaagacaacgagtgtattgtactttccaatcagactgtttttcttgagacgatgaatatgtctagccagtatttttaggtctacttgccgattatcgtgttgaaattgttcacgattggggtcagaaagaagtttaagagcgatgccatgagcgtctttcttatccgttttagtcttgcgaagtgataatgatttggcaaattccttgatgagcaaaggattgtaggtgtaaactttatatccttgttcatgcaggaagttcagtagattaaaggcataatgtccagtatcttcaagagcgatgagacagtcttggttgatctgtcgaatagacagatctaagagttcaaaaccagctttattatttgaaaaagtgagtggtttaagaacagtttttcctggaacattcaaggctgtaacatcgtgtttatttttagcgatatcaatgcctacataaagcatgggagtacctccagatatagtatttcaagtctacttggttatccacgaattttttgccttgttaccttagacgagatcaaacgtctatgcgttatcaaactcattaccaattgaaacaaaagctgtggttagagcctttcggaaatcgtcaagcgattggaggaaatgaactaatccatagtggcttattccaagtataccacttgggctttggcagtagctaactgcgctaaatataatatagggagtaatctatgtatcttattgaaattttaaaatctatcttcttcggaattgttgaaggaattacggaatggttgccgatttccagtacaggtcacttgattttagcagaggaattcatccaataccaaaatcaaaatgaagcctttatgtccatgtttaatgtcgtgattcagcttggtgctattttagcagttatggtgatttattttaacaagctcaatccttttaaaccgaccaaggacaaacaggaagttcgtaagacttggagactatggttgaaggtcttgattgctactttacctttacttggtgtctttaaatttgatgattggtttgatacccacttccataacatggtttcagttgctctcatgttgattatctacggggttgccttcatctatttggaaaagcgcaataaagcgcgtgctatcgagccaagtgtaacagagttggacaagcttccttatacgaccgctttctatatcggactcttccaagttcttgctcttttaccagggactagccgttcaggtgcaacgattgtcggtggtttgttaaatggaaccagtcgttcagttgtgacagaatttaccttctatcttgggattcctgttatgtttggagctagtgccttaaagattttcaaatttgtgaaagccggagaactcttgagctttgggcaattgtttttgctcttggtcgcgatgggagtagcttttgcggtcagcatggtggctattcgcttcttgaccagctatgtgaaaaaacacgacttcaccctttttggtaaataccgtatcgtgcttggtagtgttttgctactttacagttttgtccgtttatttgtataagaaaaaccttgaaggggcaactcttcaaggttttatactcttcgaaaatctcttcaaaccgcgtcagctttatctgcaacctcaaaacagtgttttgagcagcnctgcggctagcctcctagtttgctctttgattttcattgagctttaaaatccagtcatggtaatccccaataggcggacacctctttctttcttgcttaattcttcatagagttgcagggctatttggcttatctgactagcatcttgtgttttttgagcaagactttttcgtttggtaagagttgaaaagtcctcgtagcggattttcaaaatgacaatttttccagctttttcttgttgatgtagattgagagcgactttttctgatagaagagtcagctcttttttgatatcttcctcagcaaggagaatcttcccgtaggttttctccttgccgattgatttacggatgcgattggatttgactggagagttgtgaatgccacgagcctttcgatacagatcatagcctagtctaccaaaacggtctattagggttacctcaggaacttcaagtaaatcagcaccagtaaaaacgcccatttgatgaagacgttctactgtcttttttcctactccatgaaatttggaaatatccatttgtttgagaaaatcctcagcctgttcaggtagaatcactgtcaaaccatgtggtttttgataatcactcgccattttagctaagaatttgttgtaagaaacgcctgcggaagcagttagatggagttcttgccagatatctttttgaatgaggcgagcaattttgaccgctgacttgataccgagtttattttctgtcacatccaaataggcttcgtcaatgctcatgggttcaatcaaatctgtatagcgcttaaaaatagctcgaatctggagtcccacagacttgtatttctcataattccctgagataaagacagcctggggacaacgttcataagcttccttggaactcatggcagaatggacaccaaaagctcttgcctcataactacaggtagaaacgactccccgtccacctgtttgccgagggtcgcttccaataatgacaggttttcctctgagtttaggattatccctgatttccactgcagcaaaaaaggcatccatgtcaatatggatgatttttcttgacaaatcatttaacaaaggaaaaatcaacatgcctagcacctttttatactcttcgaaaatctcttcaaaccacgtcagctctatmtgcaacctcaaaacagtgttttgagcaatctgcggctagcttcctagtttgcttttcgatttccattgagtgttactgcttattytcttttattatacccttttttctgaaaaaaagaaaaaaggactttattttttcaaaaatataatacagtttgaaataaaatatagactgttttagaaaagaaagtgtaaaaatagggaattttcacttgttgaaatcggttactatatggtatacttgtcttatgaatgtaacagatgactgttactagaaaaaagaggacattaatatggttgttaagacagttgttgaagcacaagatatttttgacaaagcttgggaaggcttcaaaggcgtagattggaaagaaaaagcaagtgtatcacgatttgtacaagctaactacacaccttatgatggagacgaaagcttccttgcaggaccaacagagcgttcacttcacatcaagaaaattgtagaagaaactaaagcacactacgaagaaactcgtttcccaatggacactcgtccaacatctatcgctgatatccctgctggatttatcgacaaagaaaatgaagttatcttcggtatccaaaacgatgaactcttcaaattgaacttcatgccaaaaggtggtatccgtatggctgaaactactttgaaagaaaatggatacgaaccagacccagctgttcacgaaatcttcactaaatatgtaacaacagttaacgacggtattttccgtgcctacacttcaaatattcgtcgcgctcgtcacgcacacactgtaactggtcttccagatgcatactcacgcggacgtatcatcggtgtttacgcacgtcttgctctttacggtgcagactacttgatgcaagaaaaagtaaatgactggaatgcaatcaaagaaatcgatgaagaaacaatccgtcttcgtgaagaagtaaaccttcaataccaagcattgcaacaagttgttcgcctgggtgacctttacggggttgatgttcgcaaaccagcgatgaacgtgaaagaagcaatccaatgggttaacattgctttcatggctgtctgccgtgtgattaacggtgctgctacatctctaggtcgtgtaccaatcgtattggacatctttgcagaacgtgaccttgctcgtggtacatttactgaatcagaaatccaagaattcgttgatgatttcgttatgaaacttcgtacagttaaatttgctcgtacaaaagcttatgaccaattgtactcaggtgacccaacctttatcacaacttctatggctggtatgggtaacgacggtcgtcaccgtgttactaagatggactaccgtttcttgaacactcttgacaacatcggtaactcaccagaaccaaacttgacagttctttggactgacaaattgccatacaacttccgtcgctactgtatgcacatgagccacaaacactcttctatccaatacgaaggtgtaacaacaatggctaaagacggatatggtgaaatgagctgtatctcatgctgtgtgtctccacttgatccagaaaatgaagaacaacgccacaacatccagtacttcggtgctcgtgtaaacgttcttaaagcccttcttactggtttgaatggtggttacgacgatgttcacaaagactacaaagtatttgatatcgaaccaatccgtgacgaagttcttgaatttgaatcagttaaagcgaactttgaaaaatctcttgactggttgactgacacttacgtagatgccttgaacatcatccactacatgactgataggtacaactacgaagctgttcaaatggccttcttgccaactaaacaacgtgccaacatgggattcggtatctgtggatttgctaacactgttgatacattgtcagctatcaaatacgctacagttaaaccaatccgtgacgaagatggctacatctacgattacgaaacaatcggtgactacccacgctggggtgaagatgacccacgttcaaacgaattggcagaatggttgatcgaagcttacacaactcgtctacgtagccacaaactatacaaagacgcagaagctacagtatcacttttgacaatcacatctaacgttgcttactctaaacaaactggtaactcaccagttcacaaaggtgtatacctcaacgaagatggttctgtgaacttgtctaaacttgaattcttctcaccaggtgctaacccatctaacaaagctaaaggtggttggttgcaaaacttgaactcactttctagccttgactttagttatgcagctgacggtatctcattgactacacaagtatcacctcgcgctcttggtaagactcgtgatgaacaagttgataacttggtaacaattcttgatggttacttcgaaaacggtggacaacacgttaacttgaacgttatggacttgaacgatgtttacgaaaaaatcatgtcaggcgaagacgttatcgtacgtatctctggatactgtgtaaacactaaatacctcactccagaacaaaaaactgaattgacacaacgtgtcttccacgaagttctttcaatggatgacgccttggatgcattgagctaatcaagttcttgaataataaaaaggaaccctcggtcaaacgactgagggttttgtgcttgggatagtatgagcaattccttcggcgcaatatgcaatgtttttgggctctttgtcaactgtagtgggttgaaaaaaagctaagcttgagaaaggacaaatttcgtcctttcttttttgatgttcagggcgataaaaatccgttttttgaagttttcaaagttccgaaaaccaaaggcattgcgcttgatgtctttgatgagtttgttagtggcctcaagtttagcgttagaataaggcaattcaatggcgttagtgatgtagtttttatagcaaataaatgtgctcaaagtggttttaaaggtgcggttgagatgaggtaacgtgtcttgaattaagccccaaaactggtcagtattcttctcttgtagatgaaataggagtagttgatacaggtcatagtaatctttaagttcaggtactagagtaaagattttcttcagacactccctaggagttaaggtctctctgaaagttctagcatagaaaggcttaagagagagtttccgactatcttttaggataaatttccagtaatatttaagagctctgtattccagagatttatcatcaaattgcttcatgatgttgattctagtctgattaagagccctgctcatgtgttggacaatgtggaaacgatcgagaacaattttagcattgggaaataatttcttaatgagagggatataacttccagacatatcaacagtgacgactttaactttttttctagcttctttcgagtacttgaagaaatgatttcggatggttgtttgacgtctgttatcaagaatggtcatgattttcttagtgttgaaatcctgagcaatgaaagccaatttccccttctggtaggagaattcatcccaggagaggatttcaggcaaagtggtgtaatcctcttggaaatgaaattgcttgagcttacgatagacggtagaggtagaggtagaggtagagatggctaatttagaagcgatatgtgtaagagcctctctgttgagtaggagttgggcaattttctgtctcaccatttccgagatttggcaatttttctgaacgagagttgtttcagctacagtgactttccgacaggacttgcattgaaatcgtctctttttcaaatgaatgaggctagggaaaccaccaatctcgataaaagggattttagaaggcttttggaagtcgtatttgatttgttttcctttacagtgtttacatttaggtgggtgataatcaagtgtagcgaagacttcgatatgggtatcgtgctgaatggctttatttaaggtgatgtttttgtcttttattccgatgagtaatgtggtatgattgatgtgttccataagatactttctaatgagttgtttaggcgcttttcattataagtcttatgggacttttttgatactcaaaaagccctataatctccacagtgggatttacccactacagaaattatagagccagaaaaaacacttttgttcactagcagaaactagagagcagaagtgtttttctgttcagatttacccaaaactgggaaatatggggataagaatagagatggcttaggaagcccctttttgtgtgtagacagtacgatgaacttataacaaatagtgagcctttttagcaatcattgcgacccgtttgtcaaaagcctcttttcggatatctacaattgtctgatagatgagacgctgttggctaacatgcaaatctaaggcaatcgtcaaaaagtgatgtttccctttgggatactgctttttaacgtaaggcaggtattctttcgttgtaataataatcaatggctctgtcaaatgctcctctgaaggaggaggactaattagaatattgtatcctgtaacagaggcaactttgtcagtaaaattccgtaaaataatggactttattaagtttacatctgcttgattatttaaaatgataaaaatcgggatagcaggtagtgaggaaaagatggtttctgtcaagtagagtgagaaaaggtacagccgatgctggtcgataactccttcaatcttctgctcagtcatccactcttgaacaattgctttcgaaatatgatacagtggcttgtcgctttcaatcccataatgttcgtaataattataatagggaactagattttgtaaaccaaacaaaaacgttcttgttaagaaagtcagtgctgttaaaaaagaaagagaattcgaaatgtcatttcctaagatattcttgaacttggatagtagatgctttcctcttgtatgctgaagaatcagttgaatagtatgagtctttttttcttgattccatttgtccttggaaaacgaagaattagcagaacaataaaccaaaaagatataatccagttcttcctgagtaaaagtcatgttggcatgtggctctaagtaagtttggcaatgttccatcaaaatcggatacataaagaggttttttaatttttcaaactctttggactcagggaactcaagtggaaattcccgacgtttccaagtgagtgccactagtatgctaaaatgaacatactcgtcaggtgtgatttctaacagttcatgactgagttgagaattagactgcacaatcatatgtgtgacccaatccatacttccatcattcaaatcataaatctcaataccaaaatgaaactggaggagtgcaattaaaaaacgaatgcgatattcaggaccaactacttgatttttcacaaggtccaaacctactgaacgtagtaacaagccacacttttgtcgtacgcggtagcctgttgcgatggaaatatactctttttgtgtaaattcgttaaagctttgattaccttgtagtagaaagaagcggagtatttttaaaatagttgattggttataaagctgatggaagtaataattcgtttgatgagaatggtgttcgattaattgaacttgttgcgtatctaaattaaatgtcaactcttcctcgaatgtttcttgtaattcctgcaaaatgcttaggagacttttagattgtaatgaagttaaagtagacagttcatctagttcaatagaccgaatatccaataatatatttaaaatggtaattttatctgtaattcttttttcaatgtatttgtttagcatagttaccgaatcttagttgcatatagataattttaattattataatacaaaagaaactaattgtcttgtcaaaaaggttgtggaatttccgactttattgataaaacagcatgtaataaaaggcattttaaagatagtaatgagtattggtggagttttatggcttattttttttattagaaaatatttttttatcaaatattgtcgttctataaaaaaatatgtgataaaaatatctattgtgatggaagttgttttaatttatactaggatagttaatagtaatactatactatactatattgtatacaagtgtgtcattgccaggttgagaagatagctataacgcacttttatacgcttttgctacgtttgttagtgaacggattaactcagtgagataaattttatcagaacataagtaatccgtttcttcgtgtatacagattgaaagtacctatgaatcatagaaggattaacttgttctatgaataatgcttaacagggagacacacatgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacggatggcacaactgtttcgcaaaggacagaggcgcaaacaggagaagcgatattttcaaacataaaacctgggacatacaccttgacagaagcccaacctccagttggttataaaccctctactaaacaatggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgaattgacggttagtgggaaaacagtgtatgaacaaaaagataagtctgtgccgctggatgtcgttatcttgctcgataactcaaatagtatgagtaacattcgaaacaagaatgctcgacgtgcggaaagagctggtgaggcgacacgttctcttattgataaaattacatctgattcagaaaatagggtagcgcttgtgacttatgcttccactatctttgatgggaccgagtttacagtagaaaaaggggtagcagataaaaacggaaagcgattgaatgattctcttttttggaattatgatcagacgagttttacaaccaataccaaagattatagttatttaaagctgactaatgataagaatgacattgtagaattaaaaaataaggtacctaccgaggcagaagaccatgatggaaatagattgatgtaccaattcggtgccacttttactcagaaagctttgatgaaggcagatgagattttgacacaacaagcgagacaaaatagtcaaaaagtcattttccatattacggatggtgtcccaactatgtcgtatccgattaattttaatcatgctacgtttgctccatcatatcaaaatcaactaaatgcattttttagtaaatctcctaataaagatggaatactattaagtgattttattacgcaagcaactagtggagaacatacaattgtacgcggagatgggcaaagttaccagatgtttacagataagacagtttatgaaaaaggtgctcctgcagctttcccagttaaacctgaaaaatattctgaaatgaaggcggctggttatgcagttataggcgatccaattaatggtggatatatttggcttaattggagagagagtattctggcttatccgtttaattctaatactgctaaaattaccaatcatggtgaccctacaagatggtactataacgggaatattgctcctgatgggtatgatgtctttacggtaggtattggtattaacggagatcctggtacggatgaagcaacggctactagttttatgcaaagtatttctagtaaacctgaaaactataccaatgttactgacacgacaaaaatattggaacagttgaatcgttatttccacaccatcgtaactgaaaagaaatcaattgagaatggtacgattacagatccgatgggtgagttaattgatttgcaattgggcacagatggaagatttgatccagcagattacactttaactgcaaacgatggtagtcgcttggagaatggacaagctgtaggtggtccacaaaatgatggtggtttgttaaaaaatgcaaaagtgctctatgatacgactgagaaaaggattcgtgtaacaggtctgtaccttggaacggatgaaaaagttacgttgacctacaatgttcgtttgaatgatgagtttgtaagcaataaattttatgataccaatggtcgaacaaccttacatcctaaggaagtagaacagaacacagtgcgcgacttcccgattcctaagattcgtgatgtgcggaagtatccagaaatcacaatttcaaaagagaaaaaacttggtgacattgagtttattaaggtcaataaaaatgataaaaaaccactgagaggtgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatattaccaatgaacctattcctccaaagagagaatatcctcgaactggtggtatcggaatgttgccattctatctgataggttgcatgatgatgggaggagttctattatacacacggaaacatccgtaaagtgtagaaatgataatatctatgttctgaacgatacttttaagaagtagcactcaagaagagatttaagtttacttggtgaaacctgttttattcgtaagtaaactatcattgaaaggggagatgttttcgaaaacttgcacagaaaaaggattattattgtcatgtgtaattcattacattgctcacagttgattttaagagatatgaataaggagaaatcatgaaatcaatcaacaaatttttaacaatgcttgctgccttattactgacagcgagtagcctgttttcagctgcaacagtttttgcggctgggacgacaacaacatctgttaccgttcataaactattggcaacagatggggatatggataaaattgcaaatgagttagaaacaggtaactatgctggtaataaagtgggtgttctacctgcaaatgcaaaagaaattgccggtgttatgttcgtttggacaaatactaataatgaaattattgatgaaaatggccaaactctaggagtgaatattgatccacaaacatttaaactctcaggggcaatgccggcaactgcaatgaaaaaattaacagaagctgaaggagctaaatttaacacggcaaatttaccagctgctaagtataaaatttatgaaattcacagtttatcaacttatgtcggtgaagatggagcaaccttaacaggttctaaagcagttccaattgaaattgaattaccattgaacgatgttgtggatgcgcatgtgtatccaaaaaatacagaagcaaagccaaaaattgataaagatttcaaaggtaaagcaaatccagatacaccacgtgtagataaagatacacctgtgaaccaccaagttggagatgttgtagagtacgaaattgttacaaaaattccagcacttgctaattatgcaacagcaaactggagcgatagaatgactgaaggtttggcattcaacaaaggtacagtgaaagtaactgttgatgatgttgcacttgaagcaggtgattatgctctaacagaagtagcaactggttttgatttgaaattaacagatgctggtttagctaaagtgaatgaccaaaacgctgaaaaaactgtgaaaatcacttattcggcaacattgaatgacaaagcaattgtagaagtaccagaatctaatgatgtaacatttaactatggtaataatccagatcacgggaatactccaaagccgaataagccaaatgaaaacggcgatttgacattgaccaagacatgggttgatgctacaggtgcaccaattccggctggagctgaagcaacgttcgatttggttaatgctcagactggtaaagttgtacaaactgtaactttgacaacagacaaaaatacagttactgttaacggattggataaaaatacagaatataaattcgttgaacgtagtataaaagggtattcagcagattatcaagaaatcactacagctggagaaattgctgtcaagaactggaaagacgaaaatccaaaaccacttgatccaacagagccaaaagttgttacatatggtaaaaagtttgtcaaagttaatgataaagataatcgtttagctggggcagaatttgtaattgcaaatgctgataatgctggtcaatatttagcacgtaaagcagataaagtgagtcaagaagagaagcagttggttgttacaacaaaggatgctttagatagagcagttgctgcttataacgctcttactgcacaacaacaaactcagcaagaaaaagagaaagttgacaaagctcaagctgcttataatgctgctgtgattgctgccaacaatgcatttgaatgggtggcagataaggacaatgaaaatgttgtgaaattagtttctgatgcacaaggtcgctttgaaattacaggccttcttgcaggtacatattacttagaagaaacaaaacagcctgctggttatgcattactaactagccgtcagaaatttgaagtcactgcaacttcttattcagcgactggacaaggcattgagtatactgctggttcaggtaaagatgacgctacaaaagtagtcaacaaaaaaatcactatcccacaaacgggtggtattggtacaattatctttgctgtagcgggggctgcgattatgggtattgcagtgtacgcatatgttaaaaacaacaaagatgaggatcaacttgcttaagtaagagagaaaggagccattgatgacaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaagtatggaagttggatgattcgtattcctatgatgatcgggtgcaaattgtaagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcaaacggtagagcctttggtcattgtagcgaaaaaaacagatacaatgacaacaaaggtgaagctgataaaggtggatcaagaccacaatcgcttggagggtgtcggctttaaattggtatcagtagcaagagatgtttctgaaaaagaggttcccttgattggagaataccgttacagttcttctggtcaagtagggagaactctctatactgataaaaatggagagatttttgtgacaaatcttcctcttgggaactatcgtttcaaggaggtggagccactggcaggctatgctgttacgacgctggatacggatgtccagctggtagatcatcagctggtgacgattacggttgtcaatcagaaattaccacgtggcaatgttgactttatgaaggtggatggtcggaccaatacctctcttcaaggggcaatgttcaaagtcatgaaagaagaaagcggacactatactcctgttcttcaaaatggtaaggaagtagttgtaacatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaacccttgtatatcttgatgcttgttgccattttgttgtttggtagtggttattgtcttacgaaaaaaccaaataactgatattcaatgtacatcattatgaataggatagcaggctgaagggaagaccagagtactctgaggtgatgttaatcaggaatcatggtgatgtggcatgaatcatcaataacggatatgaggctgggcagattgtgccagcctcattgtgggttattgtttgtaaaacgataggactggtctggtaatcatttta

SEQ ID NO: 55 - DNA, 21040 bp; double-stranded, linear
cccagcaaaaagccatccgaagatgacttttttgctatttaatttctgtataagttacttccaagccacgcttaacagctggacgattggcaattttttctgcccattttactagattttgataacttgaggcatccaagaattttgcagaaccttggtaaagatttccttgaactaactgtccataccaagaccagatagcaatatctgcaatcgtatagtcattgcctgcaatataaggtttctgagccaattccttatccaataaatccaactggcgtttcacttccatcgtaaaacggttaataggatattccaatttttcaggagcataattgaagaaatgtccaaatcccccacctagaaaaggtgctgcacctgcttgccagaatagccaattcaaaacttctaccttttccacaggattacttggtaaaaaggctccaaatttctcagcaaggtaaagaagaatatgagcagactcaaagactcttacgttttcagtacctgactggtccaataaggctggaatcttggaatttggattgagcttcacaaagtctgatccgaattgatccccatccatgatagcaatcttatacaagtcgtaagccgcttccttaaaaccagcttctagtaattcttccaataagatagtaaccttcacaccatttggtgttcccagtgaataaagctgaaaagcttgttctccttttggcaagttttgttcgaaacgggcacctgctgttggtctgtttagccccgtaaaagctccttgattactagcttcatcctgccatacggtcggtaattgatatgctgacatccgaaacctcccttaaatcgcattcttgtcaaaaccgagtttgcgttgaataaacttaacgatttcgacgatgataatcattgagaagcttccagccataacaattccccattgtgacaagtctagtttggttacgtggaagattccttcaagcggttctacaacgattgttgccatgagaaggataaaggataccaagatggaccagttaaaggtcttagacttgaatgggccaactgtcaagatggattggtagacagacttgacattgtaggcatggaagagctgaatcaaaccaagggttgcaaaggccatcgttagggcatctgcatgaatagcatgattgtcacccacatgaactgggtaagcaatcgcaaggccataaacactcataacaagagctgcttggagtacaccttgataaatgatagaactcaaaacaccacctgagaagaagcttgccttgcgtccacgtggtttatgattcatgacaccaggttccgcaggttcaacaccaagagcgatagctgggaaggtatccgttaccaagttgatccacaaaagatgaaccggctgtaagacatcccaaccaaacaaggttgataggaagatggttaatacttcagcagtattagcagaaagtaggtactgaatagtcttttgaatgtttgagaagaccttacgtccttcttccactgcgacgataatagtcgcaaagttatcatctgcaagaatcatatcagaagcccccttagaaacctctgtaccagtgattcccataccgataccgatatcggctgttttcagagctggcgcgtcattgacaccgtcacctgtcatggcaacgactttaccttgtttttgccaagccttgacgatacgaaccttgtgttctggagacacacgggcataaacagagtattgaccaacgactttttcaaattcttcatctgacagttcattgagttcagcaccagttaaaacgtgaccttctgtatcgtttgcgtcaatgattcccaaacgtttggcaatggcttccgctgtgtcttggtggtcacctgtaatcataattggacggattcccgcttccttagccacacgaacagcctcagcggcttcaggacgttcagggtcaatcatcccaatcaaaccagtaaaaattaaatcattttcaagctcttcagaagtgagattttctggaatactatcgataatcttataagcacctgcaaggacacgcaaggcttgatgagccatttcagaattgtttgtacgaatgagatttgtaaccttctcatcaatcggagcaatatccccagccttatcacgaagaagacaacgttttaagagttggtctggcgcacccttgactgctacaaggaaacgaccatctggcaatgggtgaactgttgacatgagcttacggtcagagtcaaatggcaattcagctacacgaggatatttctctaagaaacctttgacatcatagcccttgtccaaggcatattggataaaggctgtttcggttgggtcaccaatcaagttaccttccacatcgattttcgtatcattggccaagacaactgaacgaagtagtggcatttcaagacctagttcaatatcatcagctgagtcatgtagaaccgcatcgtagaagactttttcgactgtcatcttgttcatagtcagcgtaccagtcttatcagaagcgatgatttcagttgaaccaagtgtttcaactgctggcaacttacgaacgatggaatgtcgtttggccaaaacttgagtaccaagagaaagaacgatggtaacgatagcaggaagtccttctggaatggctgcaacggcaagggcaacagaagtcaacaactcaccaagtggatttttcccttgaatgaagacacccactacaaaagtaacaagggcaatgaccaagatagcataggtcaagaccttagaaaggttgttcaaattttgtttgagtggtgtatcagtctcatccgcatcttgaagcataccagcaatatgaccaacttcagtgtacatacctgtattgacaacaacacccatcccacgaccataggttacgtttgagttttggaaggccatgttgacacggtcaccaataccagcatctgtcgcaagctcgactgacaagtctttttcgactggtacagattcacctgtcaaggctgcttcttcaattttaagagagttggcttctatcaaacgtaggtccgctggtaccacgtcacctgcttcaagggcaacgatatcgcctggtaccaattctttagagtcaatctctgccatgtgtccatcacgaagaacgcgggcaactggactagacatggatttgagggcttcaatagcttcttcagcttttccttcttggtaaacaccaaaggcagcgttgatgataaccacagctaggatgataatggcatctgcgatatcttccccaccagaagtcacgactgacaagattgctgccgcaactaggatgataatcatcaaatccttaaattgctcgatgaatttgaccaagattgatcgtttctcgccttcttcgagttcattgtgcccaaattcggcaaggcgcttttccgcctcacttgatgacaaaccttgctcggtcgcatccacagcctgcaagacctcttcagggctctgagtataaaacgcttggcgtttttgttcttttgacatgtgtctcctccttgacattgtgtgcaaaacagactctctttctgtcatagcttttcacgacaaacaaaaagaaacctgttaatcataacaagtctcgctgtttaagatagggccggaaagcatacttttcagcataaaattcggaatgacgacactatcacaggtttctgccagctactcccttgagtagtaccattataccaaattttggggagttttcaaagagtaaaaactgccttatttgaatttttccttgaaaaccagtataatggtagaatgctatgtgactagaaaggaagttgaatgaagcaatctatctcaaatctcaagttagctgagcgtggagccattatcagtatttcgacctatttgatcttgtctgcagccaaattagcagctggtcatctccttcattcatccagtttggtggccgatggttttaataacgtatcggacatcattggaaatgtggccctcttaatcgggattcggatggcgcgccacctgcagaccgtgaccaccgttttggtcattggaagattgaagatttggcaagcttgatcacttctatcatcatgttctatgtcggtttcgatgttctaagagataccattcaaaagattctcagtcgggaagaaacggtcattgatcctcttggtgcaactctaggaatcatttctgcagcgattatgtttgtggtctatctctacaatactcgcctcagtaagaaatccaactccaatgcgctgaaggcagctgctaaggacaatctttctgacgctgttacctcacttggaaccgccattgccatcctagctagtagtttcaattatccgattgtggataaactggttgctatcatcatcactttctttatcttgaagactgcctatgatatcttcatcgagtcttcctttagtctttcagatggctttgacgaccgcctgctcgaggactaccaaaaggctatcatggaaattcccaaaatcagcaaggtcaaatcgcaaagaggtcgcacctacggtagcaacatctacctggatattacactagagatgaatcctgacttgtctgtttttgaaagccatgaaatcgcggatcaggtcgagtctatgctggaggagcgttttggcgtctttgataccgatgtccatatcgaaccagcacctatccctgaggatgaaattttagacaatgtctataaaaaattgcttatgcgtgaacaattgattgaccaaggaaaccaactagaagaactcttgactgatgattttgtctatattcgccaagatggagagcagatggataaagaggcttataagaccaaaaaagagttaaattctgctatcaaggacattcaaattacttccatcagtcaaaaaaccaaactcatctgctatgagttagatggtatcatccataccagtatctggcgtcgccacgaaacctggcaaaatatctttcatcaagaaaccaaaaaagaatagagaaatcctttcatgagacgggatttttctattcttttatactcaataaaaatcaaagtgcaaattaggaagccggtcacaggctgtacttgagtcggcaatgtgaagccgacatagtttgcactttgattttcgaatagtcttaactatcaaattcactgagatactcatagcgttcgtatttttcaaggagtgcttcatttttctcatccaattctttttggagagtagccagcttaccaaagtcagagccgttagcctgcatttcctcttcaatagcagcgatacgtttttccaaggtttcaatatcaccttcaatacttgcccactcctgcttttcttggtaggtcatgcgtttcttgtcttctcgaaccttgaccactttttccttttcggccttttgcacttgattggccatatctgtttcaaaagctttttcatcaagatagtcggtgtaatgaccaaagaaaggacgaatcttgccatcctcaaaagcgagaatcttggtcgctaccttatccaagaaatagcggtcgtgactgactgttaaaacgggacctgcaaaaccttgcaagaaattctctaagactgtcaaagttgcaatatctaggtcattggttggctcgtctaaaagaagaacatttggtttttccaaaagcagtttgaggagataaagacgttttttctcaccccctgacaatttctcaatcaaagtcccatgcgtcgaacgtgggaagaggaattgctccagcaactcagcgatggaagtcgtagaaccaccactggtcttgacctcctctgccacttcctgcaggtaattgatcacacgcttgctttcatccaaaccctcaatttgttgagagaaataggcgatgcgaacagtttccccaatcacaacttgtcctgctgtcggctcaagacttcctgcaatcaggttaagtagggttgattttccaacaccattgtccccaacaattccaatacggtctttagcctgaactaagagattaaaattttgcaaaatgggcttattttcataggcaaaggaaacatcctgaaactcgatgactttcttcccaatccgactggtttcaaagttcatagtcaagtctgtctcagcactactgcctgaaacttcctttttcagatcatggaaacgattgatacgagcttgttgcttggtcgcacgcgcctgcggttgtctgcgcatccaggccaattcttgtttgtagagttgttcttttttgtgaagaagagccgcgtcgcgctcatcctgttccgcctttaggcgaacatagtcctggtaatttccctggtactcggtcaagcctgcacgatccaactcgaaaatccgtgttgacaaagcgtctaagaaataacgatcgtgagtgataaaaaggacggtcttcttagaatttttcaaaaagagggtcagccactcaataatcgcaatatccagatggttggtcggctcatccaaaagcaagaggtcgtggttgccaagtaagacttgtgccaactgtacccgtcttctcagaccacctgacaattccccaacaggagtagataagtcttgaatgcccaatttgctaagaacggtcttgacctgactttcgatttcccaagcttggagagagtccatctctgccatgacacgttccaaacgcgcctgcttgtcctcactatagtcgagcataatcaattcatactcacgaatgagctggatttccttgagttcactagatagaaccgtatccaaaactgtctttctatcatcaaaatcaggatcctgagtcaagtaaccaatctggtaatcatttttagctgaaaaaggactgacatccccatcaaatccagaaacaccagaaaggacgtccaaaagggtggtcttgccagtcccattgacaccgattaaaccaattctgtctaagtcatggataataaaggaaatatccctaaaaacggtcttgtcaccaacggatttacttagtttttcaacgataaaatcactcattttttctccctcaggtaagcatggatggcttcacgattattctccaattctccatcgacaatggcaaactcaatctctgttaaaatctctcccaagtctgggcctggctgatagccatattccttgatcaaaataccgccattaatctgaatctctttcttgtcatggatagtcaagctttggtatttttctgtgatggcttgtgggttgacttcttttccttgagcttgacgaagattttcagcctgtaaaagcaaatctatgtcaaagcgataacaatctcgcttgctcaattctccattttcacgcagagccaaaataatcagcaaatcctgaacttgcttggcaaactggcgtgaggtcttccaagatttcaaaaatgactgcgcattttcaatctccaaagcccatagtaaagccgcccaggcttgttcagaggattcaaaagtaaaatcagtctccaaatcaaacagtctgttgagcttgtcctggctagatgccatatcagggagatagtcataagcttgactctcaatcatggaagccaagccccttctccaaaatggagccagcaagagtttatcaaactcgacgaaggtacgctctacagaaattttctccaaaagcggcgtcaaggtcttcatagctttaaatgtttctggctcaagtgcaaaaccaagactagcctgaaaacggaaaccacgcataatccgtaaagcatcttcgttgaaacgctcactagccactccaactgctcgcaagacttgcttttccaaatcttctaaaccatggaacaagtcaacgatttctcctgtctcatccaaggcaaaggcgttgactgtgaaatcacggcgtttgaggtcttcttctagcgatcgtacaaaggaaaccgcactgggtctgcgatagtccacatagacatcctctgtccgaaaggttgttacctcatactcctcatccccatctaagaccaagacggttccatgctcgattccgatatcggctgttcgcggaaaaatctgcttggtctcttctggataagaagacgtcgcaatatccacatcgtggatagggctatggagaagggcatctcgaacagagcccccaacaaaataagcctcaaagcctgcttctttaattttttctaatactggtaaagccttctgaaattcagaaggcatttgcgttaatctcataataagtgttctaatccatagacaagctcatgacgcttgacaacttctttaattcccaaattgactcctgtcatgaaggagatgcgatcataggagtcatgacggagggtcaacccttctccctgattgccaaagatgacttcctgatgagctaccaagcctggcaaacgaactgagtggatgcgcataccatcaaagtcagcaccacgagcaccagcaatcagctcttcctcatctgctgcaccttgctgaattgactctcgaacctctgccatcaactcagctgttttaatggctgttccactcggagcatcctttttcttgtcatgatggagctcaataatctccacatttgggaaatatttggcagcctgcgtcgcaaattgcatgagtaagacagcacccaaggcaaagttaggggcaatcaggccacccaagtcttgggcacgagaaaattcttttagctctgcaatttcttcactcgtgaaaccagtcgttccaactactggagcaaagccattttcaagagcaaaacgtgtattttcgtaggcaacagctggagtagtaaaatctacccagacatccgcttcaaaaccagctaaatcagccttatccttgaaaacaggaataccctgccattctgactcagactcaaaaggatccaaaactgccaccaagtccaagtctggatcagtcaataccatctgacaagcagcctggcccatctttcccttaaaaccggcaataattactcgaatactcatctctactcctgtctaagatacaaagtccgtaagaacacaaagtgaaaataggaattccaatcaagaagtgtctacttcttggaagaactatctttttcacacagggttccaggcgtgttcaattatcaagatacaaaggaccttagctgcctctgaaaaatagggaatggcactgactttccacgaaaggcaagacaggcatcttttttcaagaggcaggtagtccgtgttcaatttctaagatacaaggcatcttaactagcctagaagcgccaactaaatcactggaatataacccagagcaatacttcctgctcctaggtgcgttccaatgacactaccaaatgtagcaagtgaaacatccgaacccaagccaaaatcaagcaagtgctgacgcaattcttcagccttttcaggagcattcccatgaatgacaatgacccggtattgacctgaagccgttgtttccttgataatttcaattaagcgcttggtggccttcttttcagtacgaactttttcgtaaacttcaatcacaccttgatcgttaaaataaaggattggcttaatgctaagcaaattgcccaaaatggcagccccatttgaaaggcgtccaccttttaccaaatgatccaagtcatctaccatgataaaggctgacgtacggctgatttgaatggctagcttatcctgaatgctggcaaaatcatcgccctgatcacgccaattaaagacgctttcaaccatgatgcctaggggagcacttgtaatcaaagtgtctgggaaagcaatggttaagccctcatagtcatcgaccatatactggatattttggtaaaaacctgaaattccagaagataggaaaagccccaaggcatgtgtatagccttgttctttgagcgaagttaagatctcatctaacttggcaatacttggttgactggtcttaggcaattcagaagcctgagccattttttggtaaaattcctcagcagacagattgatgccttcgacatattcctcaccatcaatattgacaggaatatccaagacaaacaagtcttctctttgcaagatctctgcactgagataagcagaggaatctgtgaaaacagctaatttcatattagaactccaaattaattcctggtaagtctaatgcaatttcagtcacttcgtaagtcaaacgattgagcatgttcaaacatggacgagccaaggtttccacctcttcttggttcaattcacttggttcattgacaatacggccatcgatatggtttacttgtgagattgttccactaatgacaaacttatcaaatacaatcataaagctcaagatgacaatcaaggaagtcacttgattttcttggtcatgttggagcaattggaaattcacatccaccttggtttcaggagctccattttcattttcccattcaaaattacgcgcatcaaaatgatactgactaacaaattcttgttcacgtttaagattcatgtctttctccatcggctacaatattataagctattgtaccataattttttattttcatctagttttctaggatttagtcaatcccaatttcagcacgaactacatctgtgatggtatcaacatagtagtttacttcttctgttgtaggcgcttctgccataacacgcaagaggggttctgttccacttggacgaacaaggatacggccgttccccgccatttcttcttccatcttctcgatgatggccttgatagctggcacttccatggccttttccttcatgacgttttccactcggatattaactaatttttgtggataaatcgttacttctgccgccaactctgataagctcttaccagtttccttcatgattttagtcaattgaactgctgataattgaccatcacctgtggtattgtaatccatcaagataacgtgaccagactgttcaccaccaaggttgtagcctgattttctcatttcttcaacaacgtagcggtcaccaactgcagtaactgccttgttaataccttcgcgattcaaggccttgtggaaaccaaggttagacataacagttgtcacaattgtattttgagccaattgtcctttttcagaaaggtattttccgatgatgtacataatcttgtcaccatcaacgatgtcaccattctcatcaacagcaatcaagcggtcactgtctccatcaaaggccaaaccaatagctgacccactttctttgaccacttcttgaagggcttctggatgtgttgaaccaacattaaggttgatgttaagaccgtctggtgtttccccgataaccgtcaattgggcaccaaggtctgcaaagatttgacgggcactggtagaagctgctccattagctgtatccaaggcaaccttcattccatcaagaggagttccagttgaaacaaggtatccttcatacttacgcargcttctggataatctaccaaaattcctaagccttctgcacttggacgaggaagagtgtcttcctcagcatctagcaaggcttcaatttctgcttctttttcatcatctagtttgaagccatcaccgccaaagaacttgattccgttatcaagggctgggttgtggctagcagaaatcatgacaccggcacttgctccttcagtttcaaccaagtaagctactgctggtgttgcaaggacaccaagtttgtatacgtgaatccctactgaaaggagacctgccaccaaggccgattccaacatttcccctgaaatacgtgtgtcacgtcctacaaagactttcggcgcttccgtttcatgttgactaagaacatagcctccaaaacgtcctagtttaaaggctaattctggtgttagttctaggttagcttctccacggactccatcagtcccaaaatatttacccattgttataaaatccttttctatttttaattcgtttttgaactagttgctttcgttgacgaagatgtctccgatgaactgcttgtacttgaatttgatgtgcttgaacttggtgctactggttttgtagtcaccttcattattgtatcaaacggagtgataactgccggtaagacaacaccattgcggtcgattgcctgcaaaggtactgaaccactgtaattacctgttatacgttcgctagttggcaaaacagcgataatcttatcaattctatccaatgtctcttggtcactcgtaatagacacttctttatctgacaccatgacattttcaatttgtacccgactatcaatttgactagggtcaatctctggtacaatctttaccttatccttctgagccttcttaccaatcttgactgtaattttttgcggagtcgccacagcggtcagcccattgggtaaatcttcaatgctcaaaggaacttcaatcgttccaacaccggcatctgttaggtcagcagtaaccttgaatttacgtgtactttcttgcatttcactagctagcgataggcgatttgcaccagtcaagaccactgatacttctgaagcaaaaccgctaataaaatacttatcactattatagcgtatgtcaatagggacatttgttactgtattagtataggtttccgtttttacctgcctagcactggtactgttttgaaaattcgtcgccgtagcatagacaaataagacacaagcaaaaaagagtgaggatatgatatataaactattttttttcatgtttccatcctcctagcaatcgttctttaaaactaagacccacttcctcttttggaagtaagatttcacgtaattctgtttcaaattcatcaagtgttaggttgtgcttaaaccttccattataggttatcgaaattcctcccgtttcctctgatacgacaaaagtcaaggcatctgagacttctgataaaccgatagccgcccggtgtctggtcccaaattccttggaaatccctgtgttttttgtcaagggcagataggcagacgtcacagcgatacgttcttctttgataatcaccgcaccatcatgtaggggagtgttgggaataaaaatgttaatgagaagttctgcagaaatcttagcatccaagggaattcctgtcgaaatatactcctgcaaggtacgtacacgctgaatagcaaccaaggccccgattttacgaggactcatgtattcaacagacttaacaaaggcacgaatcatctgttcctcagcactaataggggcattggaaaagaaatctgtcgctcttcccaaacgttccaaaccagtccgaatctctggagagaagataacaaccgccgcaataaccccataagtaataatttgattgattaaccaagaaatcgtagtcaaaccaatcatatttgcaaggatttgagctaaaataaacaccaaaactccacgtaccaaaatcataatcttggttcctgcaatagcttttgtaaaatggtataaaatataagcaacaatcaaaatatcaatcagattgatagctatcgtccatggacttgcaaacaaactggtccaatattgcagattggataattgttgaaaattcatccctgatatcctccctatcaaaacactttcgtcctattataccattttctggcatttttttccctatcctagtccattttacattgaacaaaaatatgataaaataaactgactaaaaaaaacaaaggagaaactatgtctcaactctatgatattaccattgtgggtggtggtcctgtcgggctttttgcagccttttatgcccacctacgccaagccaaggttcaaatcatcgactctcttccccagctaggtggacaacctgctattctctaccctgaaaaggaaatcctagacgtaccaggcttcccaaacctgactggagaagagttgactaaccgcttgattgaacagctaaatggatttgatacccctattcatctcaatgaaacggttcttgagattgacaaacaagaagaatttgccatcacaacttctaaaggaagtcacctgactaaaacagttatcatcgctatgggtggcggtgccttcaaaccacgtccgctggaacttgaaggggttgagggctatgaaaatatccactaccacgtttctaacattcagcaatacgctggtaagaaagtgacgattcttggtgggggagactcggctgtggattgggctttggcttttgaaaaaatcgcaccaactacccttgttcaccgcagagataatttccgtgccttggaacacagtgttcaagccttgcaagaatcatctgtaaccatcaagacaccattcgcccctagccaactccttggaaatggaaaaacacttgataaacttgaaatcacaaaagtcaaatctgatgaaactgaaaccattgacctagaccacctctttgtcaactatggtttcaaatcttctgtcggtaaccttaaaaactgggggctcgacctcaaccgtcacaagattatcgtcaacagcaaacaggaatccagccaagcaggtatctatgctatcggtgactgctgctactatgacggaaaaattgatctgattgcgacaggcctcggagaagctccaactgctgtcaacaacgctatcaactacattgaccctgaacaaaaagtacaaccaaaacactctactagtttataaaaaagaaccacgagtcacataggattcgtggttttataattcatccgctatcttattgatttttctgagtctgtgattgacaccacttttggtcagaggggtgctgagactatctgctaactgctggatagagtagtctgggtgctgaatcctcagttgcgccacttcctgcaaatctactggcaaattttctaagcccatgatatctttgattttactgatattgttaatggtcttcatgctggcagaaactgtccgagcgatattagctgtctcggcattattagcccgattgaggtcgttacgggtttctcgcaaaatcttaacccgctcaaaatcatcacgtgcctgcatggctcctattactatcaagaagtccataatgtcttctgctcgctggagataggtcacagcccccttcttgcgctcaagcaccttggcatccagtaaaaactgttggagaagggaggcaattccttgcgcgtggtccagataaacagaactgatttccaactggtacttgcctgactcagggtcacgaatgctcccatttgccaagaaagcgccacagagataggcacgacctgcttcctcatccgataaaatcgcctcatcaatacctgtttccaggccaaagaaagagtctgccaagtgcaaatcacttaacaaatcctgcaccttttcatctgtaaaaacggtatagacgcgattcttgcgaagattgctccgttggtggtgacgaatttcagatttgatttcatagagatggagaaaggactcatagaggtgacgggccagtttggcattttctgtcacaactgacaaagtcaagcccgaagtcgagagaccgatgctaccagacattttgataatggcagataattcatgccagctcagatggtgttggcccaggatttcttcttttactgctactgtgaaactcattttttcacctgtataatgcgcatcaactcgtccacaatcaaatctccatcgtggaaggcaccgccattttccagacgaaggaagttagatgaaatcacgcgcgaaacttgcttacaaagacctacaaaatcgtgttccacttgcactaagtattcatcaaaacggttggaattcatgtattcctgaggcactttttcaatattcaccaagacagtgtcgataaaagggcgaccaaggtgacgatgcaagacttccacgtggtcgctatctgtaaagtgttccgtctccccacgttgggtcatgatattgcagacataggcaatttctgccttggtttccaaaagagcccgcccaatttccttaatcacgatattgggcaaaatagaggtaaagagggaacctggccctaggacaatcatgtcactttcaaggatggtctgcactactcgacggctggccagaggcgtatcatcgtttagggcattggtcacatagacattgtcaattatgcctcgatggtctacaatatgactctctccagccacttctgtcccatcctgaaagactgcatgaagggtcaaaggatggtcactggaaggataaattttccctgttgtatggaaaaatttgctcaataactgcatggcattataggttgaaccctgcatttctgacaagccagcaatgatgagatttcccaatggatggccagcaaaggctccggcatcctcagagaaccgatactgaaagaccttctcataaaacttaggcatatccgacatggccacaaggacattacgaagatcacctggcggtgtcaactgttgcatattttttcggagttcacctgaagaaccaccatcatctgccaccgtcacgatagctgcgatttccacatctttttcccgcagactttttagaatgacgggacttccagtccctccaccaatcaccgttatctttggttttctcatgaacggtttaccgtttcctttctgcggtctttgtcgcgatgcccttcattaacagaccaattcttggataagtcctgcgccaagcgtttagcaaatgccacactacggtgttgtccacccgtacatcccatggcaatggtcaaaacggacttaccttccttttggtaacttggcagaatcggctcaatcaaggccaataaatgttgataaaagtcttctgactcaggatggttcatgacataatcataaacaggttcatccacacccgtttggtttctcagttctggtaaataatagggatttggcaagaaacggacatcaaagaccaagtccgcatcaatcgggattccatacttaaatccgaaagacatgacttcgatacggaaagactgggcttgttcttggtctgaaaactgctctgcaagggttttgcgcagctcacgtggagtgagttcagtcgtatccaccacattttggctcatatttttcaaaggtgccaagagttcacgttccaacttgattccatctaaaatacgaccgtctgctgctagtgggtgactccgtctggtttccttgtaacgagcgaccaattccttatcagccgcatccaaaaagaggattttgaaatccaaaccatcttgattttccaactcatccaaaacagcttgaatctctgaaaagaaagaacggctacgcatatccactaccaaggccaacttaggattgtcttccttaatttcaaccagctgcaaaaacttaggcaagagagctggcggcatattatcaatggtgaaataacctagatcctcgaaggactgaatggctacagttttccctgcgccactcatccctgtcacaatcaccaagtgaagttgtttctttgtcatctttttctccttatatcaaaagaagtttggcaacaccaaacttcaactagcttatccaatctctgcgatgacttcaatttcgacttttacatcacgaggaagacgagctacctccacagctgaacgagctgggaattcctctttgaaggccgtttggtaaacctcattaaaaggaacaaagtcgttcatatcgctcaagaagcaagttgttttgacaacatggtcaaagtctgttcctgcttctgccaaaatagcaccgatgtttttcaagacttgctctgtctgttcttggatattctctcctacaatttccccagtttcaggggataggggaacttgaccgctagcaaacaaaaggttgccaacgatttttccttgaacatagggtccgatagcctttggggccttatctgtatgaattgtttttgccattttcttttcctcacaatttttctaagattgcatcccaagcctcatccatccctgccttactgacagatgaaaagaggatgaaatcgtcactcgggtcaaagtttaatttctttttgattgctgattcatgcttgttccatttaccacgaggaatcttgtccgccttggtcgccacaatgatgactggaatctcataatacttgagaaattcgtacatctgcacatcatctgctgacgggtcatgacgaaggtcaactagactgacaaccgcacggagattttcccgagtcgttaagtactcctcaatcatgcacccccacttttcacgttcctttttagaaacacgagcatagccataaccaggcacatccacaaagcgcatcttgtcatcaatgttaaaaaagttcaggagctgggttttaccaggttttcctgatgtacgggcgagattcttacggttcaacatagtgttgataaagctggatttaccaacatttgaacgccctgctagggcaatctctggcagttcatcctgcggatagtgggacttattagctgcactgagcaagatttcagcattgtgtgtattaagttccatagtcacctctaggctgtttctaggatcggtttatccgttccatctacagtttctttagtgatgcgaaccaatttcacattttcctgactcggcacctcaaacatgacatctagcatggtttcttcgatgatggagcgaagtccacgcgcccctgtcttccgttcgattgctttattagcaatctcttgaagggcttcgtcgtcaaattccaactcaacatcatcataagaaagcaaggtttggtattgtttcaccaaggcatttcttggctctttcaagatgcgaaccaagtcatcaacggtcaattgctcaagagccgcaaaaacaggcaagcgtccaatcaactcagggataataccaaatttttgaatgtcttcagcgatgatttcttgcatgtatgagctgttttcgtcaatcgccttattattttgaccaaatccgatgactttttcacccagacgttgtttgacaatttcttcaataccatcaaaagcaccacccacgatgaagaggatattttttgtatccacttgaatcatctcttgttgtggatgtttgcgtccaccttgaggcggtacgctagcaacagttccctcaataatcttgagaagggcttgttgcaccccttcaccagaaacatcacgtgtgatagacacattctcactcttcttggcaatcttgtcaatttcatccacatagataatgccacgctctgcacgttcgatgttaaagtcagcaacctgcaagagtttgaggaggatattttccacatcctcacccacataaccagcctccgtcagagctgtcgcatccgcaatagcaaaaggtacattcaagctcttagccaaggtctgggcaaggaaagttttccctgaaccagttgggccaatcatcaaaatgtttgacttctgcaaatccacatcttctgactcttcgcgtgtatcgtggaaattgatgcgtttgtagtggttataaaccgccactgccaaggcacgcttggcacgatcttgaccaattacatagtggttcaagatatggaggagttcaattggttttggcacctcagacaagtctgccaagacttcctcaaccaattcttctcgaatgatttcctgagctaactccacgcattcattacaaataaaagcattgttgccagcaattattttttgtacttcttcttggtttttgccacaaaatgagcaataaaccatcatatcattttttctatttgtagacatgatttccttccattctatactgtcattctatctaaaataaggtcatgtaaaaagcatgaatactattgaccagattggtaaaggcatttaaccaaaggaggatagaaagcccgtaacgctttttacgaaaagcttgtgctcctgccagaaagcagatgaaacacagaaaagccgtgaatagaccaaataaactccgttccattagacttcctttctcttgcggtattggatggtaaaatcataaggattcttctcatctttggcgtaaaatttgcttgaaactgtctcaaaaagagacaagtcaagttcttcagggaaataggtatctccttccacccgagcatgaatgtgagtgacaatcacttcatcaaggtaaggttcaaaagcctgaaaaatttgcttcccaccgataatgtagagattcttttcttgagcctgataccagtcaagaacagactggacgtcctgaaaagtagcaaccccatctatcttttcttccggattacgcgtcaaaatcaaggtttcccgttttggaagcaagcgacgccccatcccatcaaaggtcacacgccccatcaagatagcatgattcagagttgtttctttaaagtgctgcaattctgctggcaaatgccaaggcagacgattttccttaccaatcacaccctcttcatcctgggcccaaatagctacgattttcttagtcatgcttccatccttttcactgatagtactattttatcaaaaaactcaaaaaaagactggtttggaatagcttacaaaatagaaaaaatctgtaagaaatttcctacagatttatctatgtttccttatttcttacaaaccaggtgcttgtccaagttcggctgcaagcatccaaattgttttatctgtttcagttttagcgcctgcaaagataccgtttgtcacatcgtcaccttcttcatcagtgacatccaaacctttttggaaaagttctgacaagtaacggtagataacaagaacacgttccaagctttcttcaacattacggtattcaccagcttcttcttcgatttcactattttgaaggaactctgtcaatgtagagaatgggcttccaccgagtgtaatcaagcgttcactgatttcatccaattgaccgtcaagagcttccatgtactcatccatttttggatgccatacaaggaaaccacgaccatgcatataccagtgcacttggtgcaaagcaacgtgagctacatacaaatcagcaacagcttggttcaagacttcctttgtttttgccaatgc

SEQ ID NO: 56 - DNA, 2387 bp; double-stranded, linear
attcttaatacgattaaaaggcttattactaaaagaaaatttcagttagatgaactaaacttgctcgtcaaatcccgatttaacgagatgtttggggaaaataaaatatttgaaagcattgataacttatttgatattatagatggtgataggggcaaaaattatcctaaatcagatgagttgtttagtgaggagtactgtttatttttaaatacaaagaatgttactaaaaacggattttcattcgatacaaagcaatttatcactaaaacaaaggataaattacttcgaaaaggcaaacttgagcgttatgatatagtcttgacaacaagaggtactgttggaaatgtagcgtactacgatgaattaataaaatataaacatttacgtataaattcaggtatggtaatattacgtcccaagacaccaaatctaaatcagaaatttattatccatgttttaaggaataataattatagtcgagtgatatcaggaagtgctcagcctcagttaccaattacaaaattaaaaaaaatacttctccccctccccccactagccctccaaaatgagttcgcagactttgtagtccaggtcgacaaatcacaattggcaatccaaaaatctctggaagaacttgaaactttgaagaaatctctgatgcaggagtattttggctgatattctgccattgtaattacggtaatgatttgttataatacttcaaaggaggaaatcagatggtagtaaaaacaagaaaacaaggaaattcaatcaccattacgattccaagtgaatttaatattccaagtggtgttaaatacgaagcgaaattgttaccaagtggtgagattatctttactcctgaagaattggggcagcaggtttcttatgtatctgatgatgcctttgacttaaatttagataaaatatttgacgaatacgacgatgttttcaaagctttggtggaaaaatgacaatctatttgacagaaaagcaaattgaaaaaataaatgctttagcaattcaacggtattctccaaatgagaaaattcaaacagttagtccttctgccttaaatatgattgtgaacttaccagaacaatttgtctttgggaagcctctttatccaacaatttttgataaagcaacgatactatttgtccaattgataaagaagcatgtttttgctaatgctaataaaagaactgctttcttcgttttggtcaaatttttacaattaaacggctatcgtttttctgtaacggtagaagaagcagtaaaaatgtgtgtaaccatcgcagtagaagctttaactgatgaaaaaatgacaagctactccaaatggatttctgaacattctgttagagaaaaggtcaaaaagtaacctagtatgctggatttgaatgagcacaagaaaataaatgaacagacaatattagaattctgtaatgcagaaactgatattgtctctttttattgatgaataagaaagtgagaaattatggaatcaaaagttacaattatcatgcaagaaatgttacctcttttaaataatgaacaattactagcgttgagagagagtttagaacatcatctagtagacggaaaaaagcagcagaagtattcgaataataacctgttgcaactatttattaccgccaagcaggtagagggctgtagctcaaaaacaattcgttattatcagaggacgattgaaaacttgtttaatgctattaaagagtctgtgacacaactcacaacagatgatttaaggagttatttagcaaattaccagtctgaaaaggattgtagtaaggcaaatttagacaatattaggcgtatattgtcttctttttttgcttggcttgagcaagaggatatatcattaaaattcccattcgacggatacagaaaattaagactgagcaaaatgtgaaggaaacttatactgatgaacatttggaaattatgcgtgataactgtgaaaatttgagagatttggcaataatagacctactagcatcgacaggtatgcgtgtaggggagcttgtacagttgaatcgttcagatattgattttgaaaacagagagtgtgttgtctttggtaaaggaaagaaggagagaccagtatattttgacgctcgtacgaaaattcatttaagaaattatcttaacgacagaaaagatagtcaccctgctctttttgtaacgctagttggaaaagtccagaggcttggaattgctggtgtagagattcgcttaagaaagttaggagacaaactcggcatacaaaaggttcacccacataagttcagaagaactttagcgactaaggcaattgataaaggtatgcctatcgaacaagtccaaaaactgctaggtca

SEQ ID NO: 57 - DNA, 10669 bp; double-stranded, linear
atattaaagcgactttctgtgcgctagggaaaaatgttcctgggaatgaggacttggtgaagaggataaaatctgaaggtcatgttgttggaaaccatagctggagccatccgattctctcgcaactctctcttgatgaagctaaaaagcagattactgatactgaggatgtgctaactaaagtgctgggttctagttctaaactcatgcgtccaccttatggtgctattacagatgatattcgcaatagcttggatttgagctttatcatgtgggatgtggatagtctggactggaagagtaaaaatgaagcatctattttgacagaaattcagtatcaagtagctaatggctctatcgttttgatgcatgatattcacagtccgacagtcaatgccttgccaagggtcattgagtatttgaaaaatcaaggttatacctttgtgaccataccagagatgctcaatactcgcctaaaagctcatgagctgtactatagtcgtgatgaataagcaagaaaaaataggtctgttagatatttgacagacttattttttacagaatatagtactacttaaaaaatgttttatgctataattgatgaataaaatagaaggagaagcatatgaatacctatcaattaaataatggagtagaaattccagtattgggatttggaacttttaaggctaaggatggagaagaagcctatcgtgcagtgttagaagccttgaaggctggttatcgtcatattgatacggcggcgatttatcagaatgaagaaagtgttggtcaagcaatcaaagatagcggagttccacgtgaagaaatgttcgtaactaccaagctttggaatagtcagcaaacctatgagcaaactcgtcaagctttggaaaaatctatagaaaaactgggcttggattatttggatttgtatttgattcattggccgaacccaaaaccgctcagagaaaatgacgcatggaaaactcgcaatgcggaagtttggagagcgatggaagacctctatcaagaagggaaaatccgtgctatcggcgttagcaattttcttccccatcatttggatgccttgcttgaaactgcaactatcgttcctgcggtcaatcaagttcgcttggcgccaggtgtgtatcaagatcaagtcgtagcttactgtcgtgaaaagggaattttattggaagcttgggggccttttggacaaggagaactgtttgatagcaagcaagtccaagaaatagcagcaaatcacggaaaatcggttgctcagatagccttggcctggagcttggcagaaggatttttaccacttccaaaatctgtcacaacctctcgtattcaagctaatcttgattgctttggaattgaactgagtcatgaggagagagaaaccttaaaaacgattgctgttcaatcgggtgctccacgagttgatgatgtggatttctagaaaatcataaaaagaattgtacattattctaatttttgatataatagtcagcaggaaagaaagtcttatggcgttcttcaagcgagcttgggatagtgggagccaagtagggcaaaataaagggctggcgctttctgtagtattttcaaaaacaatgaagtaataaattagggtggaaccgcgtttctgacgcccctaggttaaatcaacctaggattgtcagatgtggttcttttgcttattcagtctattgtgtgaaagaaaggagagccgtggacaacctttatcttgtaaaagacgatagtcaactagctacatttcgtgattttgtagtaagaaatactgaaaagttgaaagattatcaatcttttttaaagaatgaacttgcagtctgtgatttaccgcaagctgttatttggtcagattttaatgctgctacacagattattagggaaagtgctgttccaacctatacaaataatagacgagtggttatgacgcctgatttagctgtttggaaagaattgtatttgtatcagttgatggactacgagtgttctgagcaaactcaagcaatagaaagtcactatcattctttatctgaaaatttcctcttacagattgtaggacatgagttagctcattggtcggacattttttagatgattttgatggttatgactcttatatctggttcgaagaggggatggttgaatatattagtcgcaagtatttcttgacagaagaggaatttcaagcggaaaaaatttgtaatcaatctctcgtagaactttttcagaagaagtatagttggcattcattgaatgattttggttcttcgacttatgataagaactatgcaagtattttttatgaatactggcgcagctttttgacagtagataagttggtagaaaatttaggtagtgtacaagcggtcttagattcttatcatttatgggcaaatacagaaaaaacttttcccttgttagattggtttgttcagcagaaattaattgaaaaagaaatataaaaactaaaggagtaaacaatgtctaagaaattaacatttcactgcatcagtggcagagacctccttacagtcgggctgctccacgctcagcactagagtgcctgagctagacgcagtactaactcgtcttgcctcgtatgatcgacgaggcagactcgtgtcgcaagtaattattttttattaaggagtattcaatgtctaagaaattaacatttcactgcgtcagtggcagaaacctccttacagtcggactgccctacgctcagcactagagtgcctgagctagacgcagtactaactcgtcttgcctcgtataatcgacgaggcagactcgtgtcgcaagaaattattttttattaaggagtattcaatgtctaagaaattaacatttcaagaaattattttgactttgcaacaattttggaatgaccaagattgtatgcttatgcaggcttatgataatgaaaaaggtgcggggacaatgagtccttacactttccttcgtgctatcggacctgagccatggaatgcagcttatgtagagccatcacgtcgtcctgctgacggtcgttatggggaaaaccctaaccgtctctaccaacaccaccaattccaggtggtcatgaagccttctccatcaaatatccaagaactttaccttgagtctttggaaaaattgggaatcaatcctttggagcacgatattcgttttgttgaggacaactgggaaaacccatcaactggttcagctggtcttggttgggaagtttggcttgacggaatggaaatcactcagttcacttatttccaacaagtcggtggattggcaactggccctgtgactgcggaagttacctatggtttggagcgcttggcttcttacattcaagaagtagactctgtctatgatatcgagtgggctgatggtgtaaaatacggagaaatctttatccagcctgagtatgagcactcaaaatattcatttgaaatttcggaccaagaaatgttgcttgaaaactttgataagtttgaaaaagaagctggtcgtgcattagaagaaggcttggtacaccctgcctatgactatgttctcaaatgttcacatacctttaatctgcttgacgcgcgtggtgccgtatctgtaacagagcgtgcaggctatatcgctcgtatccgtaacttggcccgtgtcgtagccaaaacctttgtcgcagaacgcaaacgcctaggctacccacttttggatgaagaaacaagagctaaactcctagcagaagacgcagaataaagagagtgacaaattacgaaaatgggcgaacagagtgagccctgagccagttgccgcagtgatgaaggtatccttagtgaaactaaggatactaggcaaaattggagacttttggctccaattttagcaatgaaacaacgaagttggttgcttgcgtgccaatcacataaggcaaactggaaaataaaaagatacttttcggagaaaaaacatgacaaaaaacttattagtagaactcggtcttgaagaattaccagcctatgttgttacgccaagtgaaaaacaactaggcgaaaaaatggcagccttcctcaagggaaaacgcctgtcttttgaagccattcaaactttctcaacaccacgtcgtttggctgttcgtgtaactggtcttgcagacaaacagtctgatttaacagaagatttcaagggtccagcaaagaaaattgccttagatagtgatggaaacttcaccaaagcagctcaaggatttgtccgtgggaaaggtttgactgttgaagatatcgaattccgtgaaatcaagggtgaagaatatgtctatgtcactaaggaagaaattggtcaagcagttgaagccattgttccaggcattgtggatgtcttgaagtcactgactttccctgtcagcatgcactgggcgggaaatagctttgaatacatccgccctgttcacactttaactgttctcttggatgagcaagagtttgacttggatttccttgatatcaagggaagtcgtgtgagtcgtggccatcgttttttgggacaagaaaccaagattcagtcagcattgagctatgaagaagaccttcgtaagcagtttgtaatcgcagatccatgtgaacgtgagcaaatgattgttgaccaaatcaaggaaattgaggcaaaacatggtgtacgtatcgaaattgatgcggatttgctgaatgaagtcttgaatttggttgaatacccaactgccttcatgggaagttttgatgctaaataccttgaagttccagaagaagtcttggtgacttctatgaaggaacaccagcgttactttgttgttcgtgatcaagatggaaaactcttgccaaacttcatttctgttcgtaacggaaacgcagagcgtttgaaaaatgtcatcaaaggaaatgaaaaagtcttggtagcccgcttggaagacggagaattcttctggcgtgaagaccaaaaattggtgatttcagatcttgttgaaaaattaaacaatgtcaccttccatgagaagattggttctcttcgtgaacacatgattcgtacgggtcaaatcactgtacttttggcagaaaaagctagtttgtcagtggatgaaacagttgaccttgctcgtgcagcagccatttacaagtttgacttgttgacaggtatggttggtgaatttgacgaactccaaggaattatgggtgaaaaatacacccttcttgctggtgaaactccagcggtggcagctgctattcgtgaacactacatgcctacatcagctgaaggagaacttccagagagcaaggtcggcgcagttctagccattgcagacaaattggatacgattttgagtttcttctcagtaggattgattccatcaggttctaatgacccttatgcccttcgtcgtgcaactcaaggtgtggttcgtatcttggatgcctttggttggcacattgctatggatgagctgattgatagcctttatgcattgaaatttgacagtttgacttatgaaaataaagcagaggttatggactttatcaaggctcgtgttgataagatgatgggctctactccaaaagatatcaaggaagcagttcttgcaggttcaaactttgttgtggcagatatgttggaagcagcaagtgctctcgtagaagtaagcaaggaagaagattttaaaccatctgttgaatcactttctcgtgcctttaacctggccgagaaggcagaaggggttgctacggttgattcagcactatttgagaatgaccaagaaaaagctttggcagaagcagtagaaacactcattttatcaggacctgcaagtcagcaattgaaacaactttttgcgcttagcccagtcattgatgctttctttgaaaatactatggtaatggctgaagatcaggctgtccgtcaaaatcgtttggcaatcttgtcacaactaaccaagaaagcagctaagtttgcttgttttaaccaaattaacactaaataaaatttgataaacggactttatcttattacaaaggagaagaaatggatccgaaaaaaattgctcgtatcaatgagcttgctaaaaagaaaaaaacagaaggcttaacaccagaagaaaaagtggaacaagccaaactacgtgaggagtacatcgaaggttatcgccgcgctgttcgtcaccacattgaaggaatcaaaattgtggacgaagaaggaaacgatgttacaccagaaaaactacgccaagtacaacgtgaaaaaggattacatggccgtagtcttgatgatccaaattcataataatactcttcgaaaatcaaattcaaaccacgtcagcttcaccttgccgtacttaagtacagcctgcggctagcttcctagtttgctctttgattttcattgagtatatgtattctttcttttaacaaagatagatgaaacgataacaaagagactagcagtttgtgtttgctagtcttttttcgctaaaaaaggaaccataatggttcctaaaaactatcattagtaacttgcaccggctgtagcgtctgcgtcaccaccgtggcctccagcatcccctgaatcagaagcgccagaagtagcatcggcgtctccatgacctccggcagcaggagcaaatggtccgctaccacccaccaaacgttgaccagtctcttttaggtaccagtcaagccatggttggaagttaaagacgatttcattgataccagcgtatgatccatcaggatagtacattgcttggtagttgtgagtgttgataacacctgcaggagaacctggaacgatcgtacggacgtattcttggtttccgttgcgaagtgttccgataacccactctacgttcttcatacgtgctggtggaagagaaccatgaacagtcgacatacggctacctgattgaggtggtacacgtttagcgaacatagtgtctggatcttggtgagcgttgttgtagtagaggaattggttgttgtcgtcagcgtatgtcaattcaaatggcatagctttcaagaacatatcaatttggttaactgttaggataccgtggtccaatttgacataggtatcaccagaaacagcaccagtgaatgctgcaactttttctacccattctggatcgtcagggtcaacttctgtgatggttgtagcgattggttttccacaatccaagtcttctgattcgattggttttggttttttcaatttcgaaacgactcctacgtatttaacaaagttatctaagcaagtttcaaggaatttaacagtgccttcgttggtgatatttccgttgttatcaaaagcttccttagctttaccaagaaggaattcgttacctggaagcgtgtaggcattaacacctggagcatcaaggattttacgaaggtgaacttgagcacgtgatgttccttggtcatagtatgatgcacccacaatcataacaggcttgttttcaaatggatgaacttcgtatgaaagccattcaagtacagatttgagtgaagctgagatagtgtggttatgctcaggagtagcaatgataacaccatctgcacgagtaattttgttatataaataacgtaattggaaactttcatcccatttttcatcttggttaaacattggaacttcgtcaatttcaagaacttctaattcaaatttgagtttgaagtagcgacggataaattccaagagcttacggttatatgattgatcgtagtttgatccaacaagtccaacaaatttcattctttttggtctcctatcttacaaattttcccagtcaaagtcttcagcatctttgcgaagtaattcttgtgcattacgtaatttttctgtgatttttacaaagatacggaagtcatcaaagatggcatccaatttcttgataacatcaaggtcaaccaagtcgccacttgggttaaatgcttgaagagagtgtgagagcaagaattcatctggaagaacatttgccttgatttcaggagcattcaagatttgacgaagttgcaattgggcacgagatgaaccaagcgtaccgtaagaagcacctgtaatcatgattggtttgttcaaaagtgggtaaataccataagacaaccaagcaagagcgctcatcaaaacagctggaatagagtgatcatactcaggagtaccgataataacgccatctgcctcttcgattttagcagcaatttccaatatttcagcaggtacttgcttgtcagctggtttgttgaagacaggaatggccttgatttcaacaagttcaatttcagctttgtcagtaaagtgtttttgcatgtattgaagcaattgacggtttgtagaacgttttgaatttgttccaacaatagcaataagttttaacatgagatttcctttctctttttacataatacaattttaaaattccattgaaacagttgtctctatagagtaggaattcctgaagaacagcttaggtggccttctttatcgatgaggatgacttcgatgccctccaaactttcgacttgccagaggatagaagcaggtctttctccaaagagtcgagtcgtccagatttcgccatcgactgatttatcagagatgattgttagactcgctagttccgtttcaacaggatatcctgtttgactgtcaaaaatgtgatggtaatcttgtccatcgacggtcaggtgacgttcataaatgcctgaagtcacgacagatttattgacaacagggatggtcattaaatgatttcccctaggattggctgggtcttgaatcccgatttgccatgggttatcccctcttgcctgattttttccaatggtcaggatattccctcccagattgatcaaggcagaagtcaccccctctttcctaagaaattgggcaaccttatccgcactgtatcctttggctaaacaacctagatcgatcttcattcctttctgttttaaaaacacagtagaagtagaagaatctaactcgataccatgaggattgattagaggcagcaccgattcaatttcttgaggctgggcgaccttggcatctgaaaaaccgatacgccaggtttgaattaagggaccaatgctgatattgaggtggctagagagcgctaggctatgctctaacccaagtgaaatcagctcaaacaggtctggatgaaccgtgacgggggctattcctgcttgataattgatttccatcaactcagattcttgactattggcgttgaagcggtattcaagttctttgagcaagtcaaaggatttttggagaaagatatcggcttgctcatccactaatgaaatagtgatagtagtccccattagccgttcagaatgtgaacgaagagtcaagctaccaactcctttctcttatagaaaataagttgtaatatcaaataatcatctaaattgaagcccttacatttcattttcatgttattataataccataaagttagaattttcacaaacaaaatttggaaaaagtcaagaaatatgctcataaaattcatcaggcttgaaaacaggataaatggggaattatttttgataaaaaatgctgaaataatagtaccccccttgtaaacgctaacggtaaatggtatactagtaaggtaaatttagaatgaaggcaggaaatttttatgagtaaaatcgttgtagtcggtgctaaccacgctggtacagcatgtatcaataccatgttggataattttggaaatgagaacgaaattgttgtatttgaccaaaactctaacatctctttcctaggatgtggaatggctctttggattggtgaacaaattgacggtgctgaaggcttgttctattctgataaagaaaaattggaagctaaaggtgctaaagtttacatgaactcacctgttctttcaatcgactatgataacaaagtagttacagcggaagttgaaggaaaagagcacaaagaatcatacgaaaaattgattttcgctacaggctctacaccaatcttgccaccaatcgaaggtgttgaaattgttaaaggaaaccgcgaatttaaagcaactcttgaaaacgtacaattcgtgaaattgtaccaaaatgctgaagaagttatcaataaactttctgacaagagccaacacctcgaccgtatcgccgttgttggtggtggttacatcggtgttgaacttgctgaagcctttgaacgtcttggaaaagaagttgtccttgttgatatcgttgatactgtcttgaacggttactatgacaaagacttcacacaaatgatggcgaagaacttggaagatcacaacatccgcttggctctaggtcaaactgttaaagcaatcgaaggtgacggtaaagttgaacgcttgattactgacaaagaaagctttgacgtggatatggttatccttgcagttggtttccgtccaaacacagcccttgcaggtggtaagatcgaactcttccgcaacggtgccttccttgtagacaagaaacaagaaacatctatcccagacgtttacgctgttggtgactgtgcgactgtttatgacaatgctcgtaaagatacaagctatatcgctcttgcttcaaatgctgtgcgcactggtaacgttggt

SEQ ID NO: 58 - DNA, 7542 bp; double-stranded, linear
cgcgctaatagatactttatgatagaataaagaacaagattgacaagtaagaggaaacattatgcaaaatcaaacactcatgcaatactttgaatggtatctgccccacgacggtcaacactggacgcgtctggctgaaaatgctccacacctagctcatctggggatcagtcacgtctggatgccaccagccttcaaggcaaccaacgaaaaagatgtcggctatggggtctatgacttatttgacttaggagagttcaaccaaaaagggactgtccgcaccaagtatggtttcaaagaagactatcttcaagccattcaagcccttaaagcacagggaattcaacctatggccgatgtagttctcaaccacaaggctgctgccgatcacagggaagcctttcaggttatcgaagttgatcctgtagaccgtacagttgaacttggagaacccttcaccatcaatggctggactagttttaccttcgatggtcgccaagatacctataatggcttccactggcattggtaccacttcaccggtacagactacgatgccaaacgcagtaaatctgggatttatctgatccaaggggacaacaagggctgggccaacgaggaattggtcgataacgaaaacggaaactacgactacctcatgtatgccgacctagactttaaacatcctgaagtcatccaaaacatctatgactgggctgattggttcatggaaacgactggtgtagctggtttccgtttggatgccgttaagcatattgactctttctttatgcgcaacttcatccgcgatatgaaggaaaaatacggtgacgatttctatgtttttggtgaattttggaacccagacaaggaagccaatctggactatctcgaaaaaacggaagaacactttgaccttgtcgatgttcgtctccaccagaatctctttgaagccagtcaagctggcgcaaactatgaccttcgtggcattttcacagatagcctggttgaactcaagcctgacaaggctgtgacttttgtcgacaaccacgatacccaacgaggacaagcccttgagtctaccgttgaagaatggttcaagccagcagcctatgccctcattttgttacgccaagacggccttccatgtgtcttttacggagactactatgggatttcagggcagtatgctcaagaagatttcaaagaaatccttgaccgcctcctagccatccgaaaagatttggcctatggagaacaaaatgactactttgaccatgctaactgtatcggttgggtacgttcaggtgctgaaaatcaatccccaatcgcagtccttatctcaaatgaccaagaaaacagcaagtcaatgtttgtcggtcaagaatggactaatcaaacctttgtagatttacttggtaaccaccaaggtcaagttacaattgatgaggaaggttatggacaattccctgtctcagctagatccgtaagtgtctgggcagtcaataccatctaatagctcataataaccaagctaggtccaagcggatttggcttttttgtattcacaaaaagacctacccaaatggatagatctttacttgattacaatttacctgctactgcatccaacaattcttggatcttaggttggttgcttcctcctgccatggccatatctggtttaccaccaccacgtccatcgatgattggtgctaattctttgacaaggtttcctgcatgaaggtcttttgtcttgcttgctacaaggacattgactttgtcaccgatagcggcaactaggacaagaagatcagagtagtctttttgtttccagttatctgcaaaagtacgaagggcaccggcatcggatacagacacttgactagcaatgtaacgatgaccgttgacttccttaacatctttgaagatatcgcctgcggctgcagctgcggctttttctttcaactcagcattttctttttgaagttgacgaagttgttcttgaagtccttctaccttgtgaggtacttccttgacttgaggtgctttcaaggttgctgcgatagctttaagagcatcctcttgttcacgataggcttcaaaggcttccttaccagtcactgccaagatacggcgagttcctgaaccgattccttcttctttgacaattttgaagagaccaatctcagaagtgttgtcaacatgagtaccaccacaaagttcaatagagtagtcaccgatagtcacgacacgaacttccttgccgtatttctcaccaaagagggccatagctcccatttctttagcagtgtcaatatccgtttcaactgtcttcacttcaagtgcttcccaaattttctcgttaacttgctgttcaatcgcacgaagttcctcagcagttactgcttggaagtgggtaaagtcaaagcgaaggaattcaacttcgttaagagatcctgcctgtgttgcgtggtttccaaggatattgtgaagggcagcgtgaagcaaatgagtcgcagtgtggtttttcatgacacggtgacggcgattgctatcaattgccaaggtatattcttggttcaaggcaagcggtgcaaggacttcaactgtatgaagggcttgaccatttggggctttctgaacattggtcacagtagccacaaccttacctgactcatccaagatttgtccgtagtcagctacctgtccacccatttcagcataaaatgacgtttccgcaaagataagagaggcagttccttctgaaacagctcctacttctgcattgtcagcaacgatagctaccaatttagaagacaattggctagcattgtagttgaagacactttctacagtgatgttttgaagagtttcattttgcatacccattgagccacccttgacagctgacgcacgcgcgcgttcttgctgttctttcatggctgcttcaaaaccttcacggtctacagtcataccagcttcttcagcgatttcttcagtcaattcaactgggaacccataagtatcatagagtttgaagacatctgaaccagcgataacagattgacctttttctttcaagtctgctacaatgccttgggcaaagtgttgacctgagtgaagggtacgggcaaatgattcttcttcgctcttaacgattttctcaataaagtcacgtttctcaagcacttctgggtagtagctttccatgatttttccaacagttggaaccaatttgtaaaggaaaggctcgttgatacccaatttttgaccatgcatagaagcacgacggagaagacgacgaagaacataaccacgaccttcatttcctggaagggcaccatcaccgatagcaaatgaaagagaacgaatgtggtctgcgataaccttgaagctcatgttgtcgccatcttggtcataaaccttaccagacaatttctcgacttcacggataatcggcatgaagaggtccgtttcaaagttggtcttagccccttggataacggccaccaaacgctccaaaccagcgcccgtatcaatgttcttatgtggcaattccttgtattcgctacgaggaacagcagggtctgcgttaaattgtgacaaaacgatgttccagatttcaatataacggtcgttttcaatatcttctgcaagcaggcgaagaccgatattttctgggtcaaaggcttccccacggtcaaagaagatttctgtatctggtccagaaggtcccgcaccgatttcccagaagttgtcctcaattggaatcaagtgacttggatccactcccacttcaatccagcggttgtaagaatctttatcgtctggatagtaggtcatgtaaagtttttcagcagggaaatcaaaccattcagggcttgtcaaaagctcataagcccaagtgatagcttcgtcacggaagtaatccccgatagagaagttccccagcatttcaaacatggtatggtgacgcgcggtcttccctacgttttcgatgtcgttggtacggatagccttttgggcattggtaatacgtggattttcagggataatggtcccgtcaaagtatttcttaagggttgctaccccagagttgatccacaaaagagttgggtcatttacaggaaccaaacttactgatggttctactgagtgacctttggtcgcccagaaatcaagccacatttggcgtacttgtgcactagatagttgtttcatattgtctccttattcacttgtttaatgtgattggctttccagcatttccacatagtcaatcgcgacacagagggaaatgactaggtctgcataagcgtcttcaagaaccgttacggtataggtagaagtcagatggaagagttccttcttaatttccgcaatcaactgatcgcgatcatccagcaatttgaaattcaaatcccagatattgccctcgatacgaagacctagattatcaaactcatacttatctcgccagaaggtcaacttcttacgaatgacaaaactcgagccatcccgaagctgaatttcaaaacgaggaagcaaggtcaagatttctttactaatctcactgacttgttcaccagccgcatcatagatggtaaaggttttaggaatcttaaaaaatgatccctccacctgataggcaatttctcccctgtcatccttgatagcgaagcgttcgcctccaagacgaaacttttgtttgacaagaaatgttttcatcaacacctccaaaaatcaaaagacaagctcatatcacgaagggcgaaaaaccgcggtaccaccttcattcaatgaacttgtcattctcttgttcttatgcaattgtatgattgagtagcatgacttcctagcttagatggctcgcagcaccgccatttctctggactaagacaagtgaaaatcaattctcaactttcttattataacgtttttttaagcttgcgtcaactggaaatgatctccgttgaattagaccaattccctacatctctgattactttttcaggatatattttttcttactgccatttttctttttatcccaaattttcatattactaaacacagctactagaatatttccaaatataaaggtgcctatcacccaatatatggactcagttgttaggtattgtcgatccaagccatcctttaaatggaatagtatagcagtttggttaacaatcataaaggttggccagaaactttttttgaaaaaagtagacattttcattatttgttgccgctttctgtaaggttaatactcaataaaaatcaaaaagcaaactaggaagctagcctcaagctgtacttgagtacggcaaggcaacgctgacgtggtttgaagagtataggcttagtatactactaggcaagcaaataaacaaataaacaactagaatagaaaaagatagggctctaaaaactgacttctattccttaaaaacgaaccagcttgactgattcgtcttcttacgtttatctcctacttccgatacattttaaactgtaggaagaggtcgctatatttccctgtccatttatggtcaaatttctcataaacttctaggtgtttcatggtttcaacatcgggatagaaggccttatcttcctttgtttcctctgggagcaattccttcgctggtaggtttggtgttgaatagccgacatactccgcattttggagagcattttcaggtttcaacataaagttgataaaggcataggctgagttttggtttttaactgttttgggaatgaccatattgtcaaaccaaagattgctggcctctgtcggtaccacataacgtagattttcatttttttctaacatttggctggcttcaccagagaaggtcacgccgattgcaacattattctgaatcatatagcccttcatctcgtccgcaacgatagccttgatatttggagtcagtttgtagagcttatccactgtctcttccaactgctgcagatccttggagttgaggctgtagccgagggaattgagtcctagtcccagcacctcacgcgccccatcaaagagcatgatagaattcttatactccggcttccaaaggtcatcccaatgctcaggcgcttcatctaccatggtttcgttgtagacaattcctaaggttccccagaagtaagggatggagaatttattacctgggtcaaaggactggttgagaaactctggtccgatattttcgattccttcaatttttgaataatcaagcggaaccaagaggtcttcgtccttcatcttgttaatcatgtattcacttggaatggcaatatcgtaggtcgttccaccctgctttatcttagtgtacatggcttcgttggagtcaaaagtctcgtactgaacttgaattcctgtttcttctgtaaactgagtcaagagttcaggatcgatatagtctccccagttatagataaccaatttttgactatctcgactattgattttactatctaaatgagtcgcaattccccacaagacaaggataatcgctgcaattcctgctaaaaatgaatagatttttttcatgcttgctcctccttctcacgagagataaagtaataacctacaactaggataatactaaagagaaagactagagcagacagggcattgatttctaaggaaatccccttgcgagcacgagagtaaatctcgactgatagggttgaaaagccatttcctgttacaaagaaggtcacggcaaagtcatctaacgaataggtgaaggccatgaaataaccagtaatgatagacggagtcaggtaaggaagcatgatttccttgaacatctgaaattgactagctcccaagtcataggccgcatgaatcatgtcgccattcatttccttgagtcgaggcaagaccatcaagaccacgataggaatggagaaggccacgtgactagatagaacggtcaaaaagccaagtgaaaacttgagttgggtaaagagaatcaagaagctagcaccaatcataacgtcaggcgcaaccatgaggatattattgagtgatagaaaggcttcttggtatttcttacgagactggtagatgtaaatggcaccaaaagtcccgataatggtcgctatcaaggctgataggaaggccaagaaaaatgtctgagccaaaatcagcatgagtctcccatctccaaacatggtttcaaagtgagtccagctaaaacctgtaaagctattcatatcatcaccagcattaaaggcatagccaatcaagtaaaagataggcaggtagaggaccagaaagaccagtcccagataaaggttggcaaattttttcatcgttctctcctttccttagtcacccacatggtgatgaacatggtcaggatgagaatcacaccgatggttgaacccataccatagttgtcattggttagaaaattctgctcaatagccgtccccaaggtgataacgcgttcccaccaatcaaacgggtcagcatgaagagactcaaacttgggataaagaccgactgaaccccgg

SEQ ID NO: 59 - DNA, 9223 bp; double-stranded, linear
aaaaccaaattccggtattttaacctatgctgtaaataccatgaagtctgtcatgacagatcaggtctataacattaaggttgagacagaaaatggaaattatgttggtgaagctagccatgttttggtccttttgacaaattacttcgctgataagaaaatctttgaagaaaacaaggacggctatgccaacattttgattctgaaagatgcctctatattctccaaattatccgtcattcctgatttattaaaaggggatgttgtcgcaaatgataatatcgagtatatcaaagcgcgtaatattaaaatctcttcagatagtgaattggagtcagatgttgacggagataaatcagataacctacctgtagaaatcaaagtcctagctcagcgagtagaagtattttcaaaaccgaaagaggattagtatatagagaaagccttttttaaggctttttgtatactttaaaagatagttcctttaacaacggacattccttgcaaatagttttacaaaaatagtatactggattcattgagtttgaaaacgtttgcgtaaaatttgaatgaatactttaggagacaaattgatggaattgagtgctatttaccataggcctgagtcggagtatgactatctttataaggataagaaactccatattcgaattcgaactaagaaaggggacattgaaagcatcaacttgcactatggggacccttttatctttatggaggagttttatcaggatacaaaagaaatggtcaagataacttctggtaccttatttgaccattggcaggttgaagtgtcagttgactttgcacgtatccagtatctctttgagctcagagatacagaaggtcaaaatattttgtatggcgataaagggtgtgtggaaaattctctagaaaatcttcatgcaattgggaatggatttaagttgccttagcttcatgagattgatgcctgcaaggttcctgactgggtttcaaatacggtatggtatcagatatttcctgaaagatttgccaatggcaatgctctattaaacccagaagggactttagactgggattcatctgtcacacctaagagcgatgatttctttggtggtgatttacaggggattattgatcatatgaattacttgcaagacttgggtattactggactatatctttgtcccatctttgaatctacaagcaatcacaagtacaatacgacagattactttgaaattgaccgtcattttggagacaaggagacctttcgggaactggtggatcaagcgcatcatcgtggcatgaaagtcatgctggatgcggtatttaatcatattggttcgcaatctcttcaatggaaaaatgtcgtcaaaaatggtgaacagtctgcttataaggattggttccatattcaacaattcccagtgacaactgaaaagctagttaataagagagacttaccctatcatgtttttggtttcgaggactatatgcctaagctaaatacagccaatccagaggtcaagaattatcttttaaaggttgcgacttattggattgaagagtttaatatcgatgcttggcgtttggatgtggctaatgagattgaccatcagttctggaaggattttcgtaaggcagttttagctaaaaatcctgatctttatatcctaggagaagtctggcatacatctcagccttggctaaatggagatgagttccatgccgtcatgaattatcctttatctgatagtatcaaggactatttcttacgaggaattaagaagacagaccagttcatcgatgaaatcaatggagagtctatgtattacaagcagcagatttcagaggtcatgtttaatctcttggattcacatgatacagagcgaatcctgtggacggccaatgaagatgttcaactggttaaatcagccttagcctttctctttttacaaaaaggaacaccgtgcatttattacggaaccgagctagccttgactggaggaccagatccagattgtcgtcgttgtatgccttgggaacgtgtatcaagtgacaatgatatgctgaactttatgaagaggctgattaaaattcggaaatacgcgtcagtaatcatttcgcatggcaagtatagccttcaagaaatcaactctgatctagtagctctggaatggaaatacgaaggacggatcctcaaagcaatattcaaccaatcaacagaagattatcttttagagaaagaagcagtagcactagcaagcaattgccaagaattggataatcagcttgtcatctctccagatggatttatgattttctaaaaactagttgatgaagattatggtacatttcataccttatatagtataataaggctagttactaaacttgtaaaggagaacttaaatgaattgtagaggacatgaaacaagacaaagaattgttagagattttgaagttcagcctaaagcacatattaagctgttagcaaatcaacaaaaacatagtgatgcaggagcaactattgaagatgaatattatgtatttatcgctgagagtaaaattgatggcaagaaggaagttattcagtgttgcatgggtgcggcaagggattttttagaactaattaatcacaaagggctacctctttttaatccgcttgtaggtgattctcatgtaaataatagacaagaatatgacaatacagggagtggaaatttataacctgaaaagtggaatgaaactgcaaagcagctttataatgctataatgtggttgattattttatggaatgctaagccggatacacctttatttaattttaaagacgaagtaattaagtataaaacatatgagccttttgaaagcagtataaaaagagtaaatactactataaagaatggtagtaaagggaaaactctgactgagatgattaatggctacagagcggataacgatattagagatgaaatttgtaactttaatattctgaaaaataaaattcgtgatatgaaaaaccaacaaggaaatacaatggaatcttacttttagttattgttgaattttgggtattctataaaatatcctaattgagatttaaatagtagactatacaatatagttaaaatatcagtaaaaacaacactttattgaggtattggatacgctttgctaatagcctaataatcacatgtggagtgttgctacaacgaaaaaggtgataatccttgatttcaagctattttataagcattttgtctttgtagataaaggcaattttgacaataaaaatcctaaaaggtgaatcgttatagatgtatttgtagatatcgtttgcgcatcgaaaaaattaatacaagaataaatatttatagctctttaggtgacttttatagaagtaaagtttaggatagaaaaacaagaaataacgcaccatttttggtgcgttatgcttttttatgctataatggatttataaaaataaaggagtttgctatgattggaaagaacataaaatccttgcgtaaaacacatgacttaacacaactcgaatttgcacggattgtaggtatttcacgaaatagtctgagtcgttatgaaaatggaacgagttcagtctctaccgaattaatagacatcatttgtcagaagtttaatgtatcttatgtcgatattgtaggagaagataaaatgctcaatcctgttgaagattatgaattgactttaaaaattgaaattgtgaaagaaagaggtgctaatctattatctcgactctatcgttatcaagatagtcagggaattagcattgatgatgagtctaatccttggattttaatgagtgatgatctatctgatttgattcatacgaatatctatctagtagaaacttttgatgaaatagagagatatagtggctatttggatggaattgaacgtatgttagagatatctgaaaaacggatggtggcctaatggaaatccaagattatactgatagtgaattcaaacatgctttagcaaggaatcttcgttcactgacaagaggaaaaaagtccagtaagcaacctatagcgattttgcttggagggcaaagtggtgccggtaagactacaattcatcgtattaaacagaaagaatttcaaggaaatattgttatcatagatggtgatagttttcgttctcagcatccacactatttagaactgcagcaagaatatggcaaagacagtgtagaatataccaaagattttgcaggaaaaatggtagagtctttagtaacaaaattgagtagtttgagatacaatcttttgatagagggaactttacgaacagttgatgttccaaagaaaacagcacaactcttgaaaaataagggatatgaagtacaattggccttaattgcgacaaagcctgaattgtcgtatctaagtactcttatccgttatgaagaactgtacattatcaatccaaatcaagcacgcgcaactccaaaagaacatcatgatttcattgtaaatcatctagttgataacacacgaaaattggaagaactagctatctttgaaagaattcaaatttaccaacgagatagaagttgtgtatatgattcaaaagaaaatacaacttcagcagcagatgttcttcaagagttactctttggggagtggagtcaggtagagaaggagatgttgcaggtgggggaaaagagacttaatgaattacttgaaaaataaacaattgatatttttaggagaatagaaatgagagggtttaataacaagataaagtctgtttatcaagaactaacaaattccaaagagaaattcggtagctttcacaagactttaattcatttgcatacacctgtttcttatgattacaagctattttctaattggactgcaacgaaatatagaaaaattactgaagatgaactatatgatatattttttgaaaataagaaaataaaagttgataagacaattttttttagtaattttgataaggttgttttttctagttcaaaagaatatattagttttcttatgttagcagaggcaatcataaaaaatggaatagaaatagttgtagtaactgatcataatactaccaaaggtattaaaaagttacaaatggcagtctcaatcataatgaaaaattatccgatttatgatatacatcctcatattttacatggagtagaaattagtgcagcagataaattgcatattgtatgtatatatgattatgaacaagaatcatgggttaatcaatggttaagtgaaaatattataagtgagaaagatggaagttatcaacattcactgactataatgaaggatttcaataatcaaaaaatagttaactatattgctcatttcaatagttatgacattttgaaaaaaggttctcacttatcaggtgcatataaacgaaaaattttttctaaagaaaatacacgattttggagtttaatattaactcgaaagaatcttcgcaacaacttgatattctctataaagaagttggtgtattaagtttgggacaaaaagttgtagccatgcttgattttttattagcatatagtgattattctaaagacttcagaccattgattattgatcagcctgaagacaatctagacaatcgttatatttacaggcatttagttcagcagtttagagatgtgaaagctcaacgtcaaattattttagcaacacataatgctacaattgtaacaaattctatgacagatcaagttgttattatggagtcagatggagttaacggatggattgaatcacagggatatgttagtgaaaaatatataaaaaatcatatcatcaatcaattagagggaggaaaagattccttcaagcataaaatgtctatatatgagacggctttatcagagtagagtcagaaaaagtaggttagaaatttagcctacttttttctttgtccgacaggcatagtgtacatctgaggtccaagtcctctgtggatatttgctgcagatgaaaccaatagcgactcctaagcctgaatatcgtgaggtaggggggataggaaggaattagcgaaatcaaggttctacaaacagaatcgtgacttgaagccatatatagcggatgaggaactctaaaatccaaataggtgtcgtaacctatatacgtaaattacgagagtaaactaggaaagatgtacggcttattccgtgagcgtttaggacgtagtacaacgaatcatgggagtcagctgaacacatagtattgaagaaatttctgtaatggaaatggagcgaagaagtgaacaattaaatgaatacctctctaattaaatttgtcaattctaattcctggtatgaaaagacagtgacctgaaaatgtaaacgatgggagctgatcataaatataggacggtacatgcagtggtgttagagattagtccttacttgatttgtgataacttccccaaatttcttctgctatacttttctcaacttttaaaaatccaactaagaattttacctgggggtttgggggcggagcactaagttatcttatcgttagctgtcaaaactggtaggttttgataggctggcgatatgatttttgggatattgtggacacaatatctgagctcgcaaagccttacaagaatgaaaatcagttgttggaaaagtgtactgacattgtatggtagctcacattgtcagtacaagtattttggaaaggaagtagcagtatgaaacgagatgtgcgtgatattcggaaacaatttcgtttaacagaagcagaagaaaagcaaattctagctttgatgagagagcggggagagactaatttctctgattttcttcgtaaaagtttactttcctctgatttacaaaaacagatggagacatggtttgccctctggcaatcccaaaaactagaacaaatcagtcgtgacgttcatgaagttttaatcttggcacagtcagaacgtcaagtcacccaagagcatgtatctattctcttaacgtgcgtgcaggaattgattcaagaggttgcaaacaccatacccctcagtaaagaatttcgtgagaagtacatgaggtaagcacatggaacatcgttaccgaaccaatctcaagaaagtgtttttgtctgatagtgagttgaaccaactaaatataaatatcgatcaaagtggttgtaaatccttttctgaatatgcgagacgaactctactcgatcctggtatgaattttatcacgattgacacaaacggttaccaagatttagtgtttgagttaaagaggattggcaataatatcaaccagattgctcgaagtgttaatcaatctcagttaatttctggtgaagaattgcaggagttgaaaaaaggaattggtgaattgataaaagaagttgataaggaatttaatctgcaagcgcagaagctaaaggagttccatggtcatcactaaacactttgccattcacggaaagagttaccgcagaaagcttatcaagtacattctcaatcctgagaaaaccaataatcttgccttggtgtcggactatggcatgaagaattttctggactttcctagctatgaggaaatggtgcagatgtatcatgaaaatttcatcagcaacgatacgctttacgattttcgccacgacaggatggaagaaaatcaacgaaaaatacacgctcaccacatcattcagtctttctcgccagaggatcatatcactcctgaacaaatcaatcggataggttatgagactgtgaaggaattaactggtggcaaatttcgttttatcgttgcgacccatgttgataaagaccacctgcacaatcacatcattatcaattcagtagatagcaattctgacaaaaagctcaagtgggactacaaggtggagcgaaatcttcgcatgatttctgaccgtttttctaaaatcgcaggtgctaaaatcattgagaaccgctattctcaccagcggtatgaagtctatcgtaagactaatcacaagtatgaactcaagcagcgactctattttttgatggaacattctagggactttgaggatttcaaaaagaatgctccgctactacatgtggagatggatttccgtcacaagcatgccaccttttttattacggactcaactatgaaacaggtggtgcgtggcaagcaactcaatcgcaagcagccttacacagaagaattttttaagaactactttgccaaaagagaaatagaaagtctcatggaatttttattgctgaaagttgagaatatggatgatttacttcagaaagcaaaactttttggactaactatcaatcctaaacaaaagcatgtttcttttcaatttgcaggagtggaggtaaaggagacagagctagaccagaaaaatctttatgatgtagagtttttccaagattattttaaaaatagaaaagattggcaagctccagaaactgaggatttcgttcaactttatcaagaagaaaagttatccaaagaaaaagaacttccaagcgatgagaagttctgggagtcctatcaagagttcaagagtaacagagatgccgttcatgaatttgaggtggagttgtcactcaatcaaattgaaaaagtagtggatgatggaatttacgtcaaggtcaagtttggtattcgtcaggagggacttatctttgtgccgaacatgcagcttgatatggaagaggataaggtgaaggttttcatcagggaaaccagctcctactatgtctaccacaaagacgctgccgagaaaaattgttatatgaaaggtcgaaccttaattagacagttcagctatgaaaatcaaaccattccattacgcagaaaagcgacagtcgatatgattaaagagaagattgcggaagtggatgctttgattgaactggaagtagaaaatcaatcttatgtcacgattaaagatgagttagtgcatgaactagcagcgtctgaattgagaatcaatgagttgcaagaacgaatgtcaaccttgaatcaagtagcagaatatctactggcttcagttgaaagtaagcaagaaatgaaattaaatctttcaaaactgaatataactgagaatatcagtgctaatattgttgagaaaaaattgaagagcctggggaatcaactggaattggaaaggggcaggtatgaaaagatggtagt

SEQ ID NO: 60 - DNA, 6827 bp; double-stranded, linear
tctgctggctaccatcatctgacttgggcaagaccaaagtcttagttacaactgtattcttctcagcattttcaataactggcaatgccgactgaagcgtatctttttctgtttttgtagctggtccagtttcttttttctgtccgcaaccaaccaggacaaaaaggaaagctagactaacaagaactatttttttcatttctttcttctttctttttgaaattaaaatagaataagactgggaagtgctcccagccttgatgtttatagagctgcacgcaaacgtgcttctgcattttctacattacggacagagcgtggtaggaaggcacgaatatcgtcttccttgtagccaacttgcaggcgtttttcatctacaaggattgggctctttaaaattctcggtgtttccataatcagattgagaacttcattgacactcaaatcttcaatatccactccaagggctttggcatagcgatttttagacgaaacgatgctggctattccgttatctgttttggttagaatatccagtaattcttctctcgtaattccttctttaccaaggttttgttctttataacttaactggtgggcattgagccaggtttttgcttttttacagctagtacaacttgagactgtataaattttaatcatgtacctacccctttcgctacatgttactatcagtttagtctattataccataaaaaacatccgacttgcgacctatttttaattttttttgacttttttcgtcattttcgtacttttttcttgacaaacaactaaatgactatcaactcttttggagctagggtcaataattcacaacctgtctctgtaatcaggatatcatcctcgatacgaacgccatatttgccttcgatatagatacctggttcatcggtcaaggccatacctgtcttaatagtttctgtagaagtctgactaaagtagggttcctcatggatatccagaccaataccgtggccaatgccgtgagtaaagtagtcaccataacctgcctcaatgataatatcacgagggattttgtcaaagtcacggaaacctaagcctgccttagcttggtcaatcaaggcttggttagcttttagaaccgtattgtaaatctctgcctgctcatcgctaacatgccctagatagatagtccgggtcatatcactgacatagtggtcatagagacagccgaagtccatggtgatggcttctcccaactccactggtttgtgcattggatgggcatggggtttagaagaattgataccgctagctaggatcgtatcaaaagataagccagatgctcccaactcacgcatgcggaaatcaaggaagttggcaatctcaatttcagtttttcctggtttgataaagtcaagcgcatcgcggaaagcttggtctgagatagaacaagccttgcgaatcgctgcaatctctgcctcatccttaatcatacgaagaccttccacaaactgagtttgtggaagcaagttcaaacctgcaaaagctgcctgcatacggtggtaataagacactgaaatctcatcttcaaaaccgatacgagtcaagcccatgtccttaacaattcctgcaatgacagccaattcatcacgatcagccacaatctcaaaaccactggtttcttgcttagctgcgatgatatagcgagagtctgtcactaagacctgacggtcacgactgataaagactgttccgtttgagccccaaaaaccagtcaaataatagacgtttttaagattgttgatgatgataccatctagttctttttcttgcattttagctagaaatgcttgtacgcgtttattcatgatgtaactttcctttcaaatagtgtcctgtatagctggcttcgttggcagctacttcttctggagttcctgttacgatgatggttccaccaccgacaccgccctcaggtcccaagtcaatgatatggtctgccgtcttgataacatccagattgtgctcgatgacgaggactgtattgccatcgtctacaaagcgagctaaaaccttgagcaggcgagcaatgtcctctgtatgaagccctgtcgtcggctcatccagaatgtagaaagattttcctgtcgatcgtttgtggagttcgctagctaacttcatacgttgggcttctcccccagaaagggtggtagctggctgtcccaaggtcacatagcctagccctacatccttgatggtctggagtttgcgttgaattttcggaatgtgttggaaaaattctaccgcatcgttgaccgtcatatccaagacctgcgaaatattcttttccttgtagtgaacttctagggtttcactgttatagcgggttccgtggcaaacttcacaagccacataaacatctggcaagaagtgcatctcaatcttgataatcccgtcacctgagcaagcttcacagcgacctcccttgacgttgaaactgaagcgccccttcttgtagcctcgaatcttggcttcatttgtctgagcaaaaaggtcacgtatatcgtcaaaaactcctgtataggtagctgggttagacctcggcgtccgtccgatagggctctggtcaatatcaatcaaacggtcgacatgctcaatccctgtaatagtcttaaacttaccaggtttgtctgaattacggttgagcttctgggcaatggcttttttgagaatgctgttgattagagtcgatttccctgaacccgacacacctgtcactgcgataaattttcctagtggaaagcgagccgtgacattttgcaagttgttctcacgcgctcctatcacttcaataaaacgaccatttccgacacggcgctcttctggtactgggatgacacgtttgcctgacaagtactgacctgtgatagacttgctgttgcgagccacttgcttaggtgtacctgctgcaacaatctcaccaccaaaaacaccggcaccaggaccaacgtcaatcagataatcagcctcacgcatggtatcttcgtcgtgttccaccacgataagagtattgcccaagtcacgcatctttttcagactggcaatcaggcgatcattgtccctctggtgaagaccgattgacggctcgtctaggatatagaggacacctgataggttggaaccaatctgggttgccaaacgaatgcgctgactttccccacctgaaagggttcctgctgaacgtgacagggttagatagttaagacccacattattaaggaaggtcaaacgatccttgatttccttgagaatgggacgagcaatgatggcttcattttcagacaaagttaactggctcaccaagtccaagtggtcagcgatagacaggtctgagatttctccaatatgtggcccttgctggccgcccacacggacagacaaggcctggtcattgagacgatagccttgacaggttccgcaggtcagctcattcatgtagagacgcatctgagtgcgagtgtaatcgctattggtttcatggtaacgacgtttgatattattgataactccctcaaacggaatgtcgatatcgcgcacgccaccaaattcattctcatagtggaaatggaattccttaccatctgacccatagagaatcaagttcttatcttcttctgacaggtcctcaaaaggcttatccatagccactccaaagactttcatggcctgctctaacatgtttggatagtagttggatgagataggattccaaggtgctagcgctccctcacgtaaggttttgctagcatctggcactaccaaatcagtatccacctccagcttgatgcccaagccgtcacactcactacaagagccaaaaggagcattgaaagaaaagagacgaggctctaactctgggacagtaaaaccacaaactggacaggcataatgctcagagaacaacaactccgagtcgtccatggtgtcgataatgacataaccttctgcaatacgaagggcagcctcaatggaatcaaagagacgactacgaatgccctccttgataacaatacggtcaaccacgacatcgatattgtgttgcttgctcttagacaactctggcacttcggtcacatcatagacttccccatccacacggacacgaacatacccgtctttctgaaccttctcgataacactcttatgttggccttttttcttgcggatgacaggagccaagatctgcaagcgctggcgttcaggtaactccaaaaccttatcaacgatttgctccacagaagaagcattgatagctccatgtccgttgatacagtaaggcgtccccacacgtgcgtagaggagacgcagatagtcattgatttcagtcgtcgttcccaccgtcgagcgaggatttttactagtcgttttctggtcgatggaaatagctgggctgagaccatcaatggcatctacatctggtttttccatatttcccaagaactgacgagcgtaggcggacaaactctctacatagcgacgttgtccctccgcatagagagtatcaaaagccagactggacttccctgaacctgacaagccagtcacgacaaccaacttgtctcgcggaatctccacatcaatattttttaaattatgggcacgcgccccatgaatgacaattttatcttgcatctttgttctttctagtccattattgcttaccattataccaaaaaaagtgagattctattacccaaaaggccgattttgtagtataatagtacagtgtgaaaaaatctgaaaaatgagaaaggataagggatatgaaacaagtttttctctctacaacaactgaatttaaagagatcgatacgcttgaaccgggtacttggatcaatctcgtcaatccgactcaaaatgaatcactcgaaatcgccaacaccttcgatattgatattgctgaccttcgagcaccgctcgatgcggaagaaatgtctcgtattaccattgaagacgagtataccctgattatcgtagacgtgccggtcacggaggaaagaaataaccgcacctactacgtaaccatcccgcttggtattatcatcactgaggaaaccattatcactacgtgtttggaaccactacctgtccttgatgtctttatcaaccgtcgattgcgtaatttctataccttcatgcgttcacgttttatctttcaaattctttatcgcaatgcagagctttacctaacagcccttcgttcaatcgaccgcaagagtgaacaaatcgaaagtcaactgcatcaatcaactcgtaatgaagaattgattgagctcatggaattggaaaaaactatcgtctatttcaaggcctccctcaaaacaaatgagcgcgtgattaagaaattgaccagttcaaccagcaatatcaagaaataccttgaggacgaagacctgcttgaagacaccctgattgaaacccaacaggccatcgagatggcagatatttatggaaacgtcttgcattctatgacagagacctttgcctctatcatttctaacaaccagaacaacatcatgaaaaccttggcccttgtgaccatcgtcatgtccatcccaaccatggtcttttctgcctacgggatgaactttaaggataatgaaatccccctaaacggagagccaaatgccttctggttaatcgtctttatcgcctttgctatgagtgtctcgctcactctctatctcatccataaaaaatggttctaagaggagttcctatgtctcaaattgatctacaaaaattaactaagaaaaaccaagagtttgtccacattgctacccaacaattcatcaaagatgggaaaacagacgctgaaatccagactatttttgaggaagtcattccccaaatccttgaggagcaatctaaaggtacaactgcccgttccctatacggcgcaccaactcattgggctcatagcttcactgtcaaagagcagtacgaaaaagagcatccaaaagaaaatgatgacccaaaactgatgattatggactcagctcttttcatcactagcctctttgcccttgtcagcgccctcacaaccttctttgcggcagaccaagctttcggctatggattgattactcttctattagttggactggttggtggatttgccttctacttgatgtactactttgtttaccaatactatggaccagatatggatcgcagtcaacgtccacctttctggaaatctgtactagttatcctagcttctatgttcctttggttgcttgtcttctttgcaacaagcttcctaccagctagccttaacccagtactggatccattgccactagctattattggagcagccctcctagcccttcgcttctatctcaagaaacgcttgaatatccgtagtgcaagtgcaggaccaacacgctatcaagaataagaaaacgataaaagcaactgcaggtgcggttgctttttcacttacttttttgagttatattcaatgaaaatcaaagagcaaactaggaagctagctgcaggttgctcaaagcacagctttgaggttgcagataaaactgacgtggtttgaagagattttcgaagagtattaaaagtattcttctgaaatcccacatagctttctcttatattttgtgataaaataggctcaatctatttctaggaggatgagatatggtttctactattggtattgttagtttatctagtggcattatcggagaggattttgtcaaacacgaagtggacttgggtatccaacgtctcaaggatctgggactcaatcccatcttttt

SEQ ID NO: 61 - DNA, 11864 bp; double-stranded, linear
ctggctagttgcatagagcaaagttgcttcttcatcaacaaaaccgttcatttcaaaataggaaagcagctcatcaggactctccaaacgaatccctttgtaatccagctcaactgccacctctttcaaggctgcaagaagaagtgttcccaggccctgtctctgatggtcaaactcgatgactaaagaatgtacttttagacattgcggattgtctgactggggacttgataaaatatagcctaaaagttgattttcatccctagctagaagaaaggtatccgcacacttacggatactttcttctaaaatatgggaaagttgctgcttttcagctggaaaagacgaggtctgaagtgcccctatctcaggcaaatcagacttgcttgcctgaatgatcttaattggaatttccatgggaacatcctattgaacattgcttgtcaagttagacaagagacgctcaaatgagtattcataggtttggatgtctcctgctcccataaagacgtaaacagcattgtcatggtctaggagtggagaaacattttcaacagtaatcacttggtgttttttgttgattttgttggctaggtcttctaccttaacgtcaccatgatctacttcacgagccgagccataaatttgcgctagataaacagcatctgcttggtttaaagcatgggcaaagtcgtccaacaaggcaatggttcttgtaaaggtatgcggttgaaagactgctacaatttccttgcttgggtatttctgacgagccgcatccaaggtcgcaataatttctgttggatggtgggcaaagtcatcgataatcactgtatcattgacaattttctcagtgaaacgacgtttaacaccggcaaatgttttcaagtgctcacgcaccaagttcaaatcaaatcctgctgtgtaaagaagaccaataacggctgtcgcattcatgatattgtgacgaccaaaggttggaatgtggaattgccccaagttttgtccacggaaatgaacggtgaaggttgaaccagttattgaacgaagaagatcactagctacaaagtcattgccttcagcttcaaaaccataataataaattggtgcatcagacgtaatcttacgcaattcagcatcttcaccatagacaaaaagacccttggtgatttgtttggcatagtcgttaaaggcattaaaaacatcctcgagacttgtgaaataatctggatggtcaaagtcaatgttggtgataatagagtattctgggtggtaaggcatgaagtgacgctcatattcgtcagattcaaagacaaaatatttggcattggccgaaccacgacctgtcccatctccaatcaagaagctggtatctgtaatgtgagacaagacatgagacaacatacctgtcgttgaagtttttccatgtgctcctgctactcccatgctaacaaagtcacgcataaagctacctagaaactcatggtaacgtttgtagctgataccattttggtccgcataggcaatttcgacgttgttatctggacgaaaggcatttccagcgataatttccatatcaccgtctagatttttttcatcaaaaggaagaatggtaattcctgcctgctcaagaccgcgttgggtaaagtagtacttttcaacatctgatccctgaaccttgtgccccatctggtgcaacatcaaggccaaggcactcatccctgatcccttaattccgataaaatgatatgtctttgacatgttttctcccctattctgtcattctggtcagattcaactcttgggcaacccgacgttcttgttctgtttgtttactttttttattgtagatttggctcttctttagaaaatcataattgtttttctttggagcaggtgctgacacttcttcattcttggtagggatagaatgaacttcttccgccaagatataatgagactgggtcaatttttggctatatttgacaaattcaccaggattttccttttggaaaggagctgtcggttgattgccctgtctaactagactgggctgagaatgacgtctcgcaaggctgaaatcctgagttaggtagttagcagagcgtttctttttcaagtccgcacgcgcttcttcacgcgccacctccgcatagctctttccttcttttttaacccctaaaggagcctttttaggtttttcgacttgcttttcaatcggttttactggtttttcttcagcaataggagcccattctaaataatttttatctcgatactcacccttgatattactgatcagatcagactcatcatagagattcatgactggcatttcagtcaacatgacctcgtcatctgacaccaatggaaatcgttcttgtttcattttctatttcctttcaacacttcattatagcgtattgtcttgatttttcaagtgctggcttcagaaattcccaaaatttctctaatttctgctagggtcagactaccacgtgactctgtgccgtccaatacttgtgacaccagatgtttcttttgttcttggagttcctgaattttttcttcaatggttcccttggtcaccaagcgatagacctcaaccgtttcttcctgacccatccgatgggcacggccaatggcttgcgcttccaccgcaggattccaccaaaggtcaaccaagatcactgtatctgcacctgtcaggttcagaccgaccccaccagccttgagggaaatcagaaaggcatctctttctccttggttaaaggccttggtcatgtcttgtctttccttggctggggttgaacccgtaattttaaaggaagtcaggcccaagtctggcagttcttgttcaattttttccaacattcccttgaactgagagaaaatcaagacacggtgtccgccgtctgccacctgtaccagtaggtctcggagactatctagtttgccgctggctccctgataatcttccataaacagggcaggagtgtcacatatttgacgcaagcgcatcaaaccagataaaatttccacacgacttcgctgaaattcctgttctgacacttgagccagatggtctcgcatctgttgtaactgggcaaggtaaatagccttttgctggtcttccagttcatttttataaaccacctcaatcaagtctggcaattcagtcagaacttcttctttcttgcgtcgcatcacgaaaggcttgataaactgagccactcgctctgctggcaatttcataaattctttcttgcttggcaaaagtccaggcatgacgatttggaaaatagaccacaactcacccagatggttttcaatcggagttcctgacaaggcaaagaccgacggcaccacaaattgtctcaaggtctgggcaatcttggtctgggcatttttcatgacctgagcctcatctaagaaaaggaagtcaaaggccatcccttgataaaactcactgtcctgacggaaggtggcatagctagtcacatagatttgatggctctcggcaagaatctcctcacgacttgctttcaaaccatgaacaacagtcacatccaactgtggagcaaatttctgaaactcatctgcccagttgtaaatcaaacccgacggagcgagaatcaaaacccgactttcttttgtcacttgactagtcaaaaaagcaatggtctgaagggttttcccaagtcccatatcatcagccaaaatcccaccaaaaccataatgatggagcatctgcaaccagccaattcccttttcctgataatctcgcaagtcagccttgacctgagttgcttgcaaaggaaagtcctctggatgcgtcaaatcctgggccagattctggaattcttgtgaaaaagaaacacggtctcgcccttcaaagagatgagctaaactgtaggccaaggatttccgagcctgcaaggtcccatcttttaattcaaattgccccagttcctgtagattttggcgaattttcttggtttcttcatcgaaaaagtaaacttgattagacgaatcaatataaaaatcctgattggcaaccaaggcctgcatggcttggtcgatttcctcctggacaatattttgaaaatcaaactggatttccaagagacctcccttggaggcaatctgcacctgaggactcgctaggctataaagctcttctagtttatctgataggtcaacatgcccgagtttttcaaagactggaatgatatcatgaaaaaaatgatagacagactccgcttttaaggcctgacgccaagattgaaaatcggcctcaaagcccgcagccaaacagacttggaaaattctttcttctaagtctgcgtcacttgaaaagggtaattcttctagctcttgtcggctagatacctgtctatttccataatcaaactgaatttctaaacgaatccgattatcttcttccctgtcaaagtaaaaagagggcgcaaaagttttgatttgtagacgttctggagctgaaacggtgcccatctggataaaaagagtcagacaggaggccaatttgtctcgatcactgctatcaaattgcaggtatttctttccttgttgacccacaggtaacgctttaatttccttgagaagacgcatctgctggtctgttaaaaaataaacctgacctttatggaaaagtactgctccctgataaaagacattgaccctaggactctcactgatttccatttcaaaataatccgagtattctgttactgtaaaggcaaatagattggcatcagcatgcatatcctgaaaaagcagggtttggtagctatccacttgatggtcaaattgaaaatggggcaaggccatcagtaaattcacaccctgctcaaaaaaggtcagagggaaaaagaggtgccgaccttggttttggaaaaagaggtctggaaccagcccttcctccgttagtccgtgcaagaaagtcaaaagttcttggctggcatcatcaaaggcttcccaagaaagagactcctcataaatcttgccaatcatatacgactttctctgctcgacaatccttaaaaaaagtggaatatcccgaatgacatagtatttttggctattgatttggccgattctcagagtccacaagatatgattggttcctgcttccacctgacccacagctgataactcataggcgcattctgattttggagataaaattcgatccaaaaacttgccacccaaggtcaccttggtttcaacagcctctttttcttcatgaccttcttccagactccacaagatttcctgaccacgctcatcatttttcagaaaatgctctagcgctgccaaatgcacacagtagcccctcttttgaaaaaaatcacaggcacaaaaaaccaaatcatcctctaaactatagcgcagttcttcttctgcaacgcgagcgtagagccgattgttcttttccttgatgatatcaaccttaccagtttcataaagggcaacaccttcgatacgaattttccccggaatcaatttagccatattttcacctttaccttatctttttattataccatattttcgcctatgaaaatagccttctaggaagacttttctcctagaaggctggatttttaacgtttggcaaaagtagccacaatccgctgacagacttcttgcaacagagatttgggcatagctatattgatgcgggcatggagacttccttcctctccaaaatccaaaccacggttgaggataaccttggcttcatttctcaacaactcttgcaatgtttcatcagtcaggtcataagctgaaaagtcaagccaaatcaagtaggtaccttgcggtttcatgaccttgattttagtctcttttccaaatagatccatcacataattgatgtggtcttcaaagacttgcttgagttcctctagccaatctttaccgtatcgataggcagcttctgtcgccaaataacccaagcctgaaatttcatgctgattattggccaacaggcgtttctggaaagccagtctcaacttaggattttcaatgactgcataggaattttttgttccagcaatattaaatgttttagtggcactgctcaagacgatagcaaaatttttgaaggcaggattgatggtattgaaagactggtgtttgtgaccaaagagggtcaaatcttggtgaatctcatccgaaactaacaaaacaccgtgtttttggcagagttggccaatcttctccaacacttctttttcccaaacacgtccaccaggattgtgagggttgcaaagaacatagagtttaacctcctcttccaccaaatccttttcaagttggtcaaagtcaatctcaaacagactatccttttccactaaggaattagtaatcaatctacgattattcaacttgacactgcgagcaaagggtgggtagacaggcgtgttaattaaaaccgcctcgccttcttttgtaaaggtttgaatagctgttgagatggctggtaccacaccctcgataaagacaagagcctctttgtcaaagttgtaaccgtattgtgtagcttcccacttttgaacttccttaattaagtcttcactggcataggtataaccataaaccagttggtctgcgtaagtttgcacggcttggcggatttcaggcaagaccacaaagtccatatccgctatccaagctggtagaacttcactatccgtttctgtttctttccatttataggtatggtgccctaaacggttgggcaggcttgtaaaatcatattttcccatctttgtcttatccttctatggcttggcgcaaatctgcaatcaaatctctagcatcctcaatcccaatagacaaacgcaagaggtcatctgtcaaaccataagaatggcgtacctctgctggaatatcagcatgagtttgagtcgttggataagtaataagactttccactccacccaaactttccgcaaaagagaagaccttgagactgttcaaaatatgaggaatgcgtgtttcatcggctactttaaaggaaatcatgcctccacgaccagtgtagagaacttccttaactgctggagaatccttcaaaaaggcaaccacttcttgggcgttagctgttgagcgctccatacgaagagacaaggtcttgagaccacgaagcaactggtagctgtcaaatggagacaagactgcccctgttgtattaagattgtaaaaaagcttctcgtatagttctaaactattggtcacaaccactccagccaagacatcattgtggcctgctagatacttggttgctgaatggagaacgatatctgctccatcttcaatcggacgttggtagatagggctatagaaggtattgtccaccaccactttggcacccttagcatgagccaattttgctagtttttcgatatcaaattccaacatcaagggattggttggggtttcgatatagagaacatccacatccttttctaactcggcaatcaactcttcttctgtattggcataggtaaaatggaaatgaccttcctgctccacttggttaaaccagcgaaaagaaccaccgtaaagatcacgcactgccaagaccttacttcctactggaaagacgctaaaggccagtacaatagctgacatccctgagctagtcgctagggcatagtctgctgactcaatagccgccaagacttcctcagccttactacgagttggatttttagtgcgcgtatagtcaaacccagtagatcgaccaaactctggatgctgataggtcgttgaaaaatgaagtggtgtcaccaaagcacctgttgcctcatcagacttgatccctgcttgtgctaaaattgtgttaatgtgtaattccttgctcatacaattcctccaaatctatagtaactattgtaccacttattttgtatccttcgttttcttgttttcaagagctagttatagtttcaaactatataaaaagggagtttttcctgctccctttaatagactataaaatggtgaatctcaaaagacaccttcactctatcatttgctcctgcacaaaacgagcataacgctcatgattttccagtagttccttatgagttcctgagccagtgattttcccctcctctaagaagaaaatacaatccacatcttttaccgttgacaaacgatgcgctataatcacaaccgtcttctcctttagtacagaatagaggctactgataatcgcatactcagaatccgcatcaagattagcagtggcttcatcaaatataagaatttcagcatcttttaagtaggctctagctatttgaagtctttcgttcgcccccctgacaagagtcgtccgcgttcaccaacttcagtatctagtccctctttcatggagcgaatctcatcacctagtgatactaagtctagcactttcatcaattcatcatcagttactaagcgattcaaaccgagacaaagattgtcacgaatactgccagataagactgcattattttgtgaaacccaagcgattttacttctccattcttttaagttaaaatcatatatacttgattgctccattagaatatctcctgaaagcggtttataaaaccgctctaacaaacgcacaatcgttgattttcctgatccagatggtccaacaaaagcaattttttgccccttgaaaattgaacaagtaatatcctttaagacaggtcgattttcatcataaccaaaatagacatggttaaaattcaaccctcgtcctgataccgattttcctccctcaaatttttctttaggaactgcaagcaagttctccagtgcaactgaagatcccttgctcctagaataaacagttacaaaattagctatattactaataggattaagtaattgaaagaggtaaatcaaaaacgaaaccaaggttcccacagatatatatcctgcgctgacccgataacccccataggttagcatcacagctatagtcgcaaagataaataagagagcaaacggggtctcaaaagaagtaaccctatctgatttcagtgaattgttttgtaccctttcaatacaattatccaaaacatcctgtacacttttctctgcttggttagtcttaattaattcatgttcttgaatcttttcagtcaattgccctgttaaatttcctcctgtaaacgacgactatacttttcactgatattggaaaggggcaagataataaacatcatacaaggaagagtgatgaataaaagtagagaaagattccaatcaagactaaataagactacaatggaaccaagtaccataactaaactcagaataatatttgggaaagtcgtaattaaaaactcacgaatgacactcgtgtcattgacaatggcagaagtcaactccccactttggctcttatcaaagaaggatttctctacataaatcaacccctctatcacttttttcctgatttttgctatctttttttcacccgattgactaaacagatagtaaccaatagaagaaaacaaggcttgaccaataaaaatcaaaaacgattgaaatactttggagcctatattttcaatagaactcccatctattaaatcctttaagataaggggaagcaacaaagcaagtagactagacagaacaagtaagaaactccccataatcaccttagtatctactcttaataattttaatttcataaatactccttataatatttcaacggataaagtcgggaataactcaatttgaggataaaatctaataaatcttcctataacaaaacgcataacatctaggattttatatacctgatattatgcgtttttaagcacaaagacttcttacacaaacttatctacaattagattttatttgacatgttttgccaattcttcttgggcttttttattggattcttctttttctttcaaccatttttctctggcttttgcatattcgtctgttgtgacaatcttatcttgtactttgaggtatttatatgattcaaccccttttgtaccggttaaaccataggcagcagcaaatggtacggttcttctcaatgatggtgttcccccacgcgaaacacttggaagaactaaagaactatcaatcaaccaagcttgaatatcagcatatttctcataacgtttggccggatcttgctctttattagcttcttccaacatttgagtatagacatccagtccaactgccttagccttgtcattggcctcaccaggctctagtccaagattttgcagaaatcctccactattagtattaaaaatatcgagataggttgacgggtcttgataatcaggtccccaaccgccatgatataaatcataatctttctgagcagctgtttgagcaaagtagcctgaactgtcaaactcatctgatgttaattgctgaatgtcaatcactacattatcagaacctaaaacagattcaattgattgtttgatagaactaactccttgtatgcctactttatctgttacttccacagtcttatccaagtggattgggaattgaacaccctttgcttcgagttctttcttagcttccgcaaacttagccttggctttctcaggattgtagtaagggtcttgaccatccgcaaagttgataccttgccattccttaccatagttgaccatcttagaggctacaacttcaccaaagtcttttcccttgatactgacaaagtttggaggaaccactaggttacgcaaaatctttgttgcaccttctttcccttcagactgagccccataagatgttctgtcaaaagcaaaattgatagcctgacggaagtttttattgagaactgcttcctgagtcgatttcttttcaatgtcacttgttttagaagtataattgtaagacttcctatctaggttaaaattaaagaaatatgaagttgaattttgcatactatagatgatattgtttttgtatttttctttaatcccttcatagctggagctgttaggaaaaagacgagccgtagtataagcaccagctgtaaaattacgttccagtgattcttggtcgctaccatcatagtaggtcaatttcacatcgtctacaaagacattcttagcatcccagtaattagggtttttcttatattcaatagcagattttgagacaagtgctttcatcaagaaaggtccattgtacaaaatactagatggatccgccttcccaaaatcatccccttttgatttcaggaaatctgcattaacaggaaaaagtatcgttgcaagtgtttttgaattccagtaaagttctggtttaaccaaagtatattgaaccgtttggtcatcaagtgccttgacaccgacagttgaaaagtcgcttgttttaccagtgatatagtcatccaaaccagcaacagagtcctgcactagatacaaggcttctgattttttatcagctgcatattgcaaacctgtcacaaaatcctgggcagttacaggcgcatattcttctccctcagaagtaaaccacttggcatccttacgaagtttgtaggtataggtcaaaccgtcctgagaaacagtccaatcctctgctaatgatggaataatattcccatattggtcattttctaataacccgtctaccaaatttgcaacaatatcggatgttgctgcgcggttttctgctagatagttcaagctagatggatcacttgaataaacatagttgtaggtttttgacgccgtgctagaatttccacacgcgctcaataaaactcctgtacccaggacaagacctgccaaggttagatatttgctcttagactttttcatttccgg

SEQ ID NO: 62 - DNA, 2412 bp; double-stranded, linear
taactgcactaaacataatataaggagagaaaatgtctgcaatagaacgtattacaaaagctgctcacttaattgatatgaacgatattatccgtgaagggaatcctactctacgcgcgattgctgaggaagtcactttccccctatctgaccaggaaatcatcctaggcgaaaagatgatgcaattccttaaacattcccaagatcctgtcatggctgaaaaaatgggactccgcggtggtgttggactggctgctccccagttagatatctcaaaacgcattatcgctgttttggtacctaatattgttgaagaaggcgaaactccacaggaagcctacgatttggaagccattatgtacaatccaaaaatcgtctctcactctgttcaagatgctgctcttggcgaaggagaaggttgcctgtctgttgaccgtaacgtgcctggctatgttgttcgccatgcccgcgttactgttgactactttgacaaagatggagaaaaacaccgtatcaaactcaaaggctacaactccattgttgttcagcatgaaattgaccacattaacggtatcatgttttacgatcgcatcaatgaaaaagacccatttgcagttaaagatggtttactgattcttgaataaagaaaatcccgttgcaagacggggttttgtgttataatagaggcatgaaaacaaatgatattgtctatggtgtccacgccgttaccgaagccctccttgcaaatacaggaaacaaactctacctccaagaagatctccgaggtaagaatgttgagaaagtcaaggaactagctacagaaaagaaggtgtccatttcttggacatcaaaaaaatctctctctgagattactgaaggtgctgttcatcaaggttttgttctacgagtgtctgaatttgcctatagcgagctagattacatccttgcaaaaacacgccaagaagaaaatccacttctattgattctagatggtctaaccgatccccataatctgggttctatcttgcgaacagccgatgcgaccaatgtttcaggtgtcatcattcccaagcaccgtactgtcggagtaactcctgtcgttgccaaaacagccacaggtgctattgaacacgttccaattgcccgagtgaccaacctcagtcaaaccttaggataaacttaaggatgaaggtttctggacctttggaacggatatgaacggtactccttgccacaagtggaatacaaaagggaaaatcgccctcatcattggaaatgaaggaaaaggtatctctagcaacatcaaaaaacaggtcgatgaaatgattaccattccgatgaatggacatgttcaaagccttaatgccagtgttgctgcggccattctcatgtacgaagttttccgaaatagactataaaaaagtttccagtcatctgattggaaacttttttatgattaactatgttctgtaatgaatttataggcttcttgaccagcgatagctccatctccaaccgctgttgttacttggcgaaggtctttcaagcgaacatctccaactgcaaagataccgtcgactgcagttttcatgtggttatctgtcacaatccatcctgcctgatcttggatattcaattctttaacaaaatcgctaagagggtccaaaccaacatagataaagacaccaccgaaggcttgttctgtcacttgacctgttttcacattttcaaatacgactgattctactcggttttcacccttgatttcccttactacagaatcccagataaagctgattttttcattcgcaaaggcgcgatcttgtaaaaccttttgggcacgaagttggtcacgacggtgaacaatggtaacagtcttagcaaaacgagtcaagaagagggcttcttcaacagctgaatctccaccaccaactaccaataaatcttggtcacggaagaaagcaccatcacacacagcacagtaagaaacaccacgactgttcagttcttcttctccaggcactcccaaaggacggtgtttagaaccagttgctacgataactgtacgtgtttcatatgtttggtcatcagtcatcactttcttaaaatcaccatggcttcgacattttcaacataaccataaatgtgctcaacaccaagattttcaagtggttcaaacatcttttcagccaattcaggtccactaatattagcgtatcctgggtaattttcgatatcagatgtattattcatctgaccacctggcagaccaccttcaatcaaagctacttttagattgcttcgagcagcatacaaggccgcagtcatccctgcaggtccagcaccgataataatagtatcgtacatatagattccttctttcttggtgtaactatctttattctaactctg

SEQ ID NO: 63 - DNA, 7760 bp; double-stranded, linear
ccgatttggtggaatttttgtctcatcatttagaaggtgttgcaagagcagagtttaccttggtgcttcataccaaattgggagaagcctctgttttggcaaatattgtagatgtaaacaaggatgaatggattttaggaacagttgctggtgccaataccttattggttatttgtcgagatcagcacgttgccaaactcatggaagatcgtttgctagatttgatgaaagataagtaaggtcttgggagttgctctcaagacttatttttgaaaaggagagacagaaaatggcgatagaaaagttatcacccggcatgcaacagtatgtggatattaaaaagcaatatccagatgcttttttgctctttcggatgggtgatttttatgaattattttatgaggatgcggtcaatgctgcgcagattctggaaatttccttaacgagtcgcaacaagaatgccgacaatccgatccctatggcgggtgttccctatcattctgcccaacagtatatcgatgtcttgattgagcagggttataaggtggctatcgcagagcagatggaagatcctaaacaagcagttggggttgttaaacgagaggttgttcaggtcattacgccagggacagtggtcgatagcagtaagccggacagtcagaataattttttggtttccatagaccgcgaaggcaatcaatttggcctagcttatatggatttggtgacgggtgacttttatgtgacaggtcttttggatttcacgctggtttgtggggaaatccgtaacctcaaggctcgagaagtggtgttgggttatgacttgtctgaggaagaagaacaaatcctcagccgccagatgaatctggtactctcttatgaaaaagaaagctttgaagaccttcatttattggatttgcgattggcaacggtggagcaaacggcatctagtaagctgctccagtatgttcatcggactcagatgagggaattgaaccacctcaaacctgttatccgctacgaaattaaggatttcttgcagatggattatgcgaccaaggctagtctggatttggttgagaatgctcgctcaggtaagaaacaaggcagtcttttctggcttttggatgaaaccaaaacggctatggggatgcgtctcttgcgttcttggattcatcgccccttgattgataaggaacgaatcgtccaacgtcaagaagtagtgcaggtctttctcgaccatttctttgagcgtagtgacttgacagacagtctcaagggtgtttatgacattgagcgcttggctagtcgtgtttcttttggcaaaaccaatccaaaggatctcttgcagttggcgactaccttgtctagtgtgccacggattcgtgcgattttagaagggatggagcaacctactctagcctatctcatcgcacaactggatgcaatccctgagttggagagtttgattagcgcagcgattgctcctgaagctcctcatgtgattacagatgggggaattatccggactggatttgatgagactttagacaagtatcgttgcgttctcagagaagggactagctggattgctgagattgaggctaaggagcgagaaaactctggtatcagcacgctcaagattgactacaataaaaaggatggctactattttcatgtgaccaattcgcaactaggaaatgtgccagctcactttttccgcaaggcgacgctgaaaaactcagaacgctttggaaccgaagaattagcccgtatcgagggagatatgcttgaggcgcgtgagaagtcagccaacctcgaatacgaaatatttatgcgcattcgtgaagaggtcggcaagtacatccagcgtttacaagctctagcccaaggaattgcgacggttgatgtcttacagagtctggcggttgtggctgaaacccagcatttgattcgacctgagtttggtgacgattcacaaattgatatccggaaagggcgccatgctgtcgttgaaaaggttatgggggctcagacctatattccaaatacgattcagatggcagaagataccagtattcaactggttacagggccaaacatgagtgggaagtctacctatatgcgtcagttagccatgacggcggttatggcccagctgggttcctatgttcctgctgaaagcgcccatttaccgatttttgatgcgatttttacccgtatcggagcagcagatgacttggtttcgggtcagtcaacctttatggtggagatgatggaggccaataatgccatttcgcatgcgaccaagaactctctcattctctttgatgaattgggacgtggaactgcaacttatgacgggatggctcttgctcagtccatcatcgaatatatccatgagcacatcggagctaagaccctctttgcgacccactaccatgagttgactagtctggagtctagtttacaacacttggtcaatgtccacgtggcaactttggagcaggatgggcaggtcaccttccttcacaagattgaaccgggaccagctgataaatctacggtatccatgttgccaagattgctggcttgccagcagaccttttagcaagggcggataagattttgactcagctagagaatcaaggaacagagagtcctcctcccatgagacaaactagtgctgtcactgaacagatttcactctttgatagggcagaagagcatcctatcctagcagaattagctaaactggatgtgtataatatgacacctatgcaggttatgaatgtcttagtagagttaaaacagaaactataaaaccaagactcactagttaatctagctgtatcaaggagacttctttgacaattctccacttttttgctagaataacatcacacaaacagaatgaaaaggagctgacgcattgtcgctcccttttgtctattttttaaggagaaagtatgctgattcagaaaataaaaacctacaagtggcaggccctggcttcgctcctgatgacaggcttgatggttgctagttcacttctgcaaccgcgttatctgcaggaagtcttaggcgccctccttactgggaaatatgaagctatttatagtatcggggcttggttgattggtgtggccgtagtcggtctagttgctggtggactcaatgttgtcctcgcagcctatattgcccaaggagtttcatccgaccttcgggaggatgccttccgtaaaattcaaaccttttcttatgctgatattgaacaatttaatgcgggaaatctagtcgttcgaatgacaaatgatatcaaccagattcagaacgttgtcatgatgaccttccaaattcttttcagacttcccctcttgttcatcggttcgtttatcctagcggttcaaaccttaccttctctgtggtgggtgattgttctcatggtagtcttgatttttggtttgactgctgtcatgatgggaatgatggggcctcgttttgccaagtttcaaacccttcttgagcgcatcaatgccattgccaaggaaaatttacgtggcgttcgtgtggtcaagtcctttgtccaagaaaaagagcaatttgctaagtttacagaggtctcagacgagcttcttggtcaaaacctttacattggttatgccttttcagtagtggaaccctttatgatgttggttggttacggggcggtcttcctctctatttggctggtcgcgggaatggttcagtcggatccgtctgttgttggttccatcgcttcttttgttaattacctaagccagattatctttaccattgttatggttggatttttgggaaattctgtcagccgtgccatgatttccatgcgtcgtattcgagaaattcttgacgcagagccagctatgaccttcaaggatatcccagatgaagagttggttggaagtcttagctttgaaaatgtgacctttacctatccaatggacaaggaaccgatgctgaaagatgtgagctttactattgaacctggtcaaatggttggtgtagttggagcgactggtgcaggaaagtcaaccttggctcaattgattccacgtctctttgatccacaggacggggccattaaaatcggtggcaaggatattcgagaagtgagtgaaggaaccctgcgtaaaacagtttccatcgttctccaacgtgccattctttttagtggaacgattgcagataacttgagacaggggaaggggaatgctactctatttgaaatggagcgcgcagccaatattgcccaggctagtgaattcattcatcgtatggagaaaacctttgaaagtccagttgaagaacggggaaccaatttctctggtggacaaaaacaaaggatgtcgattgcgcgtgggattgtcagcaatccacgtattctgatttttgatgattcgacctcagccttggatgccaaatcagagcgcttggtgcaagaagctttgaataaggacttgaaggggacgacaaccattattattgctcaaaaaattagctcggttgtccatgcagacaagatcttggttctaaatcaaggacgattgattggtcaaggtacgcatgcagacttggttgccaacaatgccgtttaccgtgaaatctatgaaacacagaaatgaaagacaaactataagaaaagtcaatagttttatctaaactatttcttatttcaatttgatgatttggcgatgattttagagcacggcaaaaagcccttgaaaaagtccattttttcaaaggtaatcctgtgttaatttcagaaattacatcactttttgttcgtcaaatggcagctctttttttaggatataaaacagggttcggataagtttttttgcaaggtggatgatggctacattgtaatgttttccttgttctaatttagtcttaagataggccttaaaagcaggcgaaaagcgagggcatgctttggcagcttgtatgagtacctaccgcagatgaggggaactccgtttgaccattcttcctgctaaatcaatctgatctgactgataaatagaagaatccagtccagcgaaagcttgtaattgagcaggattatcaaaggcatgaatatttcgaatctcagctaaaatgaccgcccctaaacgatccccaatcccagtaaccgtcgtgatgaccgagttgaactcagccatcaagtcattgacacatgtttccgccttgtcaatgagcctcttgtaatgtttgatgttttcattacacgagataaaacgtctatgcgttatcaaactcattaccaattaaaacaaaaagctgtggttagatcctttcggaaattgtcaagcgattggaggaaatgaactaatccacagcggcttattccaagtataccacttgggctttggcagtagctaactgcgctaaatataatataaggaggagtaaaatgaagacagttcaatttttttggcattattttaaggtctacaagttctcatttgtagttgtcatcctgatgattgttctggcgacttttgcccaagccctctttccagtcttttctggacaagcggtgacgcagctagccaatttagttcaagcttatcaaaatggcaatccagaacttgtatggcaaagcctatcaggaatcatggtcaatcttggcctgctggttttggttctatttatctctagtgtaatatacatgtgtctcatgacgcgcgtgattgcagaatcgaccaacgagatgcgcaaaggcctctttggtaagcttgctcagttgacggtttctttctttgaccgtcgacaagatggcgatatcctgtctcattttaccagtgatttggataatatcctccaagcctttaacgaaagcttgattcaggtcatgagcaatattgttttatacattggtctgattcttgtcatgttttcgagaaatgtgacgctggctctcatcaccattgccagcaccccattggctttccttatgctgattttcatcgtgaaaatggcacgcaaatacaccaacctccagcagaaagaggtagggaagctcaacgcctatatggatgagagcatctcaggccaaaaagccgtgattgtgcaaggaattcaagaggatatgatggcaggatttcttgaacaaaatgagcgcgtgcgcaaggcaacctttaaaggaagaatgttctcaggaattcttttccctgtcatgaatgggatgagcctgattaatacagccatcgtcatctttgctggttcggctgtacttttgaatgataagtctattgaaacaagtacagccctaggtttgattgttatgtttgcacaattttcacagcagtactaccagcctattatccaagttgcagcgagttggggaagccttcagttggcctttactggagctgaacgaattcaggaaatgtttgatgcagaggaggaaatccgacctgaaaaggctccaaccttcactaagttgcaagaaagtgttgaaatcagtcatatcgttttttcatacttgcctgataaacctattttgaaagatgtcagcatttctgcccctaaaggccagatgacagcagttgttgggccgacaggttcaggaaaaacgactattatgaacctcatcaatcgcttttatgatgttgatgctggtggtatttattttgatggtaaagacattcgtggctatgacttagatagtcttagaagcaaggtgggaattgtattgcaagattcggtcttgtttagcggaacgattagagacaatatccgatttggtgtgccagatgctagtcaggaaatggttgaggtagcagcaaaagcaacccacattcacgactatatcgaaagtttgcctgataagtacgatactcttattgatgatgaccagagcatcttttcaacagggcagaagcaattgatttcaatcgctcgaaccctgatgacagatccagaagttctcattctcgatgaagcaacttcaaacgtagatacggtgacagaaagcaagattcagcatgccatggaggtggttgtagcaggtagaactagtttcgtcattgcccaccgcttgaaaaccattctcaatgcagatcagattattgtccttaaagatggagaagtcattgaacgtggtaaccaccatgaacttttgaagctaggtggcttttattcagaactctatcacaatcaatttgttttcgaataagaaagaagttgtcctatgtgggcagctttttcttgtccataaaaaatgtttatcacagccttaaaaaaaacatattagacgaaagtcattttgagtgatatgataggactatcgttagcattcgaaaggagaggcatcatggctagaacggttgtaggagttgctgcaaatctatgtcccgtagacgcagaaggcaaaatcattcattcatctgtatcttgtagattcgcagagatcattcgtcaagtcggtggtctccctttagtcattcctgttggtgatgagtcagttgtacgtgattatgtggaaatgattgacaaactcattttgacaggaggccaaaatgttcatcctcagttttatggagagaaaaagaccgtcgagagcgatgattacaatctggtccgtgacgaatttgaattggcactcttgaaggaagcgcttcgtcagaataaaccaattatggcaatctgtcgcggtgtccaacttgtcaatgttgcctttggtggaaccctcaatcaagaaatcgaaggtcagg

SEQ ID NO: 64 - DNA, 2723 bp; double-stranded, linear
gaggttttaattcacttacctctsccgtatctttatttaaaatgaattcttttacggttgtatttcttgcaaaatcttttacaacaatcttaatgtttagtgtcttgtctattatttgtttaatatcattaaatgatgtatattcttttccatttatataaatatgttgttcttgaatctcaccatcgaatccattatttcttttatcattgatgttaaagactacagattttccatcagcatattcgatactagtatttcccttaggatcaatgtttacttcgggtttaacattatcatataaaaactgatagtggactccaactgctttagcattcaaatcgctatagccagtttgaagataaacatttccatccatatctgttaccttatctggaaatccgtttgctttatagtctttcattccccagtccatgatgtcaccgtctttaacattcagcttaatattaaaatctctagtgttatcaatgtgtaaatctccgtagattaaataattatctacaaccgattcattaactctcaattcccagttaaaaccacccttatcagaaatcttacctcttaaataaaattctggatttcgtacataaattttattagatttagatggattaaagtagttcttatccattgaaaggtttactggtttggtatcaataaataacatggagccatcttcttttatagcttctacattgaacttatcctctccagtgtattctttatcatccttaccaaataatacaagtttagaagaatctgtcacaagatttccgtctttatcgatagcttcccctttatcgttcattttaaatgtaaacacttgataccttataatgttaaagccgtccaaagccgacattaatacagattgggtacttcttccatcttcaacatttctactatcagcataaattgttgtttctgaaagggctcttagattaggattggccttttgtatttttgctatatcttccttgctatagactccatttccttctaacatatccgtttttccaggattataggtagtcacttttagtgcatagccttttcttagaatgatattatcctttaacagatattgttgtttttctgaatcagaatagattttaccagattccattttagttaaattgtctggtttgttttttgaaagatctccttcccctaattctatgacattcccataacttgatacatagggatattctgatttagtttccttaattttttcaggcattctaattttaatttcagcttttttctgatcattatctttaacaaataatctcatatctcctgcaaaagctaatccatccacaatatcattaatattagcgtatagatcaaatgtcatcgtttttgagtggaaatcatacttggtcgctttgatttctatagatttatagttattcccataatataccttggcatttttagaaacattacttatctttccaagaatttcaaagtgtccatctttagacggacttagaacaccataaatttttgatttgatttcgtcaagtttctcagtttcatattctagatcagtcccatcatcgtaggctattatatttcctttatcatcgtatttataatcgtattcctccattctcttaccagtttcacttgtaaaatcatcaacttctctaaatttctttttaatgagtttctttaagtctttattttcaaagtctctaattgttgaaatatttctatcaatagtaaaactagatttttctttaatagactcttcattttcttgatgatgatgttctaccccagttgtatctttttttagactaccctcttttccatttcctaaatttttaaatttagattctgcaatctcgccaagcttttgatatttagatgaatcttgatcaggatctactagataataggaaatcatccccttttcatcagcctgattagcaaatttaattctatgaatctttgtgaaattgctagaaccatctaatgcaatgacttcaatgatttttccccttaaatctcccgcacctttaatttcataaatggtatttccgtctttatcaagttttctatttcttccttgaccctcacctgcgtaagttacttcaagatttttttcaacctctccatcttcattaacaagagcggcgccagcataccaaacttcgttcgcaatctcgtcaaatttttcaggatgttctttttgatctctcgcaaatagcgtttcattcttatactgatcttttaccttatgataagtatcctttgtaatcaacttaattttttcaggatttgaaaaatcaaccgaaacaatcttaggggcggtgttatcaatttttacaggaatataggaaacctgccatgggtaatctttagttaatctatatttaaatttatagaaatattgaccttccgcaatcggttcaaattgacctcttatcttagtagcaggatcttgattatccttactttctggtgcattttcttctctacctctaggattatagatgagtccatcccacttcaagtcaccccaaacttttagtttagatgatttgattccctttgcatcattgcttttagaatttaaaattcctctaataaagtgttctctcgaaatgacttttaagtctctttgattttctccctctttatttgtatttactattgaaatcaatccttcttctgcacttcttaataca

SEQ ID NO: 65 - DNA, 11831 bp; double-stranded, linear
aaaaaagtgggaatgactcaaatcttcactgaagctggcgaattgatccctgtaacagttattgaagcaactccaaacgttgttcttcaagttaaaactgttgaaacagacggatacaacgctatccaagttggtttcgatgacaaacgcgaagtattgagcaacaaacctgctaaaggacatgtagcgaaagctaacacggctcctaagcgcttcattcgtgaattcaaaaacgttgaaggcttggaagttggtgctgaaattacagttgaaacattcgcagctggagacgttgttgacgtaacgggtacttctaaaggtaaaggtttccaaggtgttatcaaacgccacggacaatcacgtggaccaatggctcacggttctcgttaccaccgtcgtccaggttctatggggcctgttgcacctaaccgcgtattcaaaggtaaaaaccttgcaggacgtatgggtggcgaccgcgtaacaattcaaaaccttgaagttgtacaagttgttccagaaaagaacgttatccttatcaaaggtaacgtaccaggtgctaagaaatctcttatcactatcaaatcagcagttaaagctggtaaataataaagaaaggggaaatcagtcacaatggcaaacgtaacattatttgaccaaactggtaaagaagctggccaagttgttcttagcgatgcagtatttggtatcgaaccaaatgaatcagttgtgtttgatgtaatcatcagccaacgcgcaagccttcgtcaaggaacacacgctgttaaaaaccgctctgcagtatcaggtggtggacgcaaaccatggcgtcaaaaaggaactggacgtgctcgtcaaggttctatccgctcaccacaatggcgtggtggtggtgttgtcttcggaccaactccacgttcatacggctacaaacttccacaaaaagttcgtcgcctagctcttaaatcagtttactctgaaaaagttgctgaaaacaaattcgtagctgtagacgctctttcatttacagctccaaaaactgctgaatttgcaaaagttcttgcagcattgagcatcgattctaaagttcttgttatccttgaagaaggaaatgaattcgcagctctttcagctcgtaaccttccaaacgtgaaagttgcaactgctacaactgcaagtgttcttgacatcgcaaatagcgacaaacttcttgtcacacaagcagctatctctaaaatcgaggaggttcttgcataatgaatttgtatgatgttatcaaaaaacctgtcatcactgaaagctcaatggctcaacttgaagcaggaaaatatgtatttgaagttgacactcgtgcacacaaacttttgatcaagcaagctgttgaagctgctttcgaaggtgttaaagttgccaatgttaacacaatcaacgtaaaaccaaaagctaaacgtgttggacgttacactggttttactaacaaaactaaaaaagctatcatcacacttacagctgattctaaagcaatcgagttgtttgctgctgaagctgaataatctaaggaggaaatatcgtgggaattcgtgtttataaaccaacaacaaacggtcgccgtaatatgacttctttggatttcgctgaaatcacaacaagcactcctgaaaaatcattgcttgttgcattgaagagcaaggctggtcgtaacaacaacggtcgtatcacagttcgtcaccaaggtggtggacacaaacgtttctaccgtttggttgacttcaaacgtaataaagacaacgttgaagcagttgttaaaacaatcgagtacgatccaaaccgttctgcaaacatcgctcttgtacactacactgacggtgtgaaagcatacatcatcgctccaaaaggtcttgaagtaggtcaacgtatcgtttcaggtccagaagcagatatcaaagtcggaaacgctcttccacttgctaacatcccagttggtactttgattcacaacatcgagttgaaaccaggtcgtggtggtgaattggtacgtgctgctggtgcatctgctcaagtattgggttctgaaggtaaatatgttcttgttcgtcttcaatcaggtgaagttcgtatgattcttggaacttgccgtgctacagttggtgttgtcggaaacgaacaacatggacttgtaaaccttggtaaagcaggacgtagccgttggaaaggtatccgcccaacagttcgtggttctgtaatgaaccctaacgatcacccacacggtggtggtgaaggtaaagcaccagttggtcgtaaagcaccatctactccatggggcaaacctgctcttggtcttaaaactcgtaacaagaaagcgaaatctgacaaacttatcgttcgtcgtcgcaacgagaaataatattaaactagtcgcttaagcaactagtaaatccgccagctcggtagcgctccataggagtgcaagccgctgtggtacaacatttaaaggagaaaatataaaaatgggacgcagtcttaaaaaaggacctttcgtcgatgagcatttgatgaaaaaagttgaagctcaagctaacgacgaaaagaaaaaagttattaaaacttggtcacgtcgttcaacgatcttcccaagtttcattggttacactattgcagtttatgacggacgtaaacacgtacctgtttacatccaagaagacatggtaggccacaaacttggtgaatttgcaccaactcgtacttacaaaggtcacgctgcagacgacaagaaaacacgtagaaaataaggagaacataaatggcagaaattacttcagctaaagcaatggctcgtacagtacgtgtttcacctcgtaaatcacgtcttgttcttgataacatccgtggtaaaagcgtagccgatgcaatcgcaatcttgacattcactccaaacaaagctgctgaaatcatcttgaaagttttgaactcagctgtagctaacgctgaaaacaactttggtttggataaagctaacttggtagtatctgaagcattcgcaaacgaaggaccaactatgaaacgtttccgtccacgtgcgaaaggttcagcttcaccaatcaacaaacgtacagctcacatcactgtagctgttgcagaaaaataaggaggtaaaatcgtgggtcaaaaagtacatccaattggtatgcgtgtcggcatcatccgtgattgggatgccaaatggtatgctgaaaaagaatacgcggattaccttcatgaagatcttgcaatccgtaaattcgttcaaaaagaacttgctgacgcagcagtttcaactattgaaatcgaacgcgcagtaaacaaagttaacgtttcacttcacactgctaaaccaggtatggttatcggtaaaggtggtgctaacgttgatgcactccgtgcaaaacttaacaaattgactggaaaacaagtacacatcaacatcatcgaaatcaaacaacctgatttggatgctcaccttgtaggtgaaggaattgctcgtcaattggagcaacgtgttgctttccgtcgtgcacaaaaacaagcaatccaacgtgcaatgcgtgctggagctaaaggaatcaaaactcaagtatcaggtcgtttgaacggtgcagatatcgcccgtgctgaaggatactctgaaggaactgttccgcttcacacacttcgtgcagatatcgattacgcttgggaagaagcagatactacatacggtaaacttggtgttaaagtatggatctaccgtggtgaagttcttccagctcgtaaaaacactaaaggaggtaaataaccaatgttagtacctaaacgtgttaaacaccgtcgtgagttccgtggaaaaatgcgcggtgaagcaaaaggtggaaaagaagtagcattcggtgaatacggtcttcaagctacaactagccactggatcactaaccgccaaatcgaagctgctcgtatcgccatgactcgttacatgaaacgtggtggtaaagtttggattaaaatcttcccacacaaatcatacactgctaaagctatcggtgtgcgtatgggatctggtaaaggggcacctgaaggttgggtagcaccagttaaacgtggtaaagtgatgttcgaaatcgctggtgtatctgaagagattgcacgtgaagcgcttcgacttgctagccacaaattgccagttaaatgtaaattcgtaaaacgtgaagcagaataaggagaaggcatgaaacttaatgaagtaaaagaatttgttaaagaacttcgtggtctttctcaagaagaactcgcgaagcgcgaaaacgaattgaaaaaagaattgtttgaacttcgtttccaagctgctactggtcaattggaacaaacagctcgcttgaaagaagttaaaaaacaaatcgctcgcatcaaaacagttcaatctgaagcgaaataatagactagggaaggagaaatttcaatggaacgcaataatcgtaaagttcttgttggacgtgttgtatctgacaaaatggacaagacaatcacagttgtagttgaaacaaaacgtaaccacccagtctatggtaaacgtattaactactctaaaaaatacaaagctcatgatgaaaacaatgttgccaaagaaggcgatatcgtacgtatcatggaaactcgcccgctttcagctacaaaacgtttccgtcttgtagaagttgttgaagaagcggtcatcatctaatcaaacctgaaaggagaaaactgaaatgattcaaacagaaactcgtttgaaagtcgcagacaacagcggtgctcgcgaaatcttgactatcaaagttcttggtggttcaggacgtaaatttgcaaacatcggtgatgttatcgtggcatctgtaaaacaagctactcctggtggtgcggttaaaaaaggtgacgttgttaaagcagttatcgttcgtactaaatcaggtgctcgtcgtgctgatggttcatacatcaaatttgacgaaaacgcagcagttatcatccgtgaagacaaaactcctcgcggaacacgtatctttggcccagttgcacgtgaattgcgtgaaggtggcttcatgaagatcgtgtcacttgctccagaagtactttaatttttaggaacaaactagtcccctagcttcaagctagggtgcccttatgggcgtaagaaaaatcaaggagaaacctaatgtttgtaaaaaaaggcgacaaagttcgcgtaatcgctggtaaagataagggaacagaagctgttgtccttactgcccttccaaaagtaaacaaagttatcgttgaaggtgttaacattgttaagaaacaccaacgtccaactaacgagcttcctcaaggtggtatcatcgagaaagaagcagctatccacgtatcaaacgttcaagttttggacaaaaatggtgtagctggtcgtgttggatacaaatttgtagacggtaaaaaagttcgctacaacaaaaaatcaggcgaagtgcttgattaatcacgaaggaaaggagaagtataatggcaaatcgtttaaaagaaaaatatcttaatgaagtagttcctgctttgacagaacaattcaactactcatcagtgatggctgtgcctaaagtagataagattgttttgaacatgggtgttggtgaagctgtatcaaacgctaaaagccttgaaaaagctgctgaagaattggcacttatctcaggtcaaaaaccacttatcactaaagctaaaaaatcaatcgccggcttccgtcttcgtgaaggtgttgcgatcggtgcaaaagttacccttcgtggtgaacgtatgtacgaattcttggataaattggtatcagtttcacttccacgtgtacgtgacttccacggtgtcccaacaaaatcatttgatggacgcgggaactacacacttggtgtgaaagaacaattaatcttcccagaaatcaacttcgatgacgttgacaaaactcgtggtcttgacatcgttatcgtaacaactgctaacactgacgaagagtcacgtgcattgcttacaggccttggaatgccttttgcaaaataatataggaggtaaatctaatggctaaaaaatcaatggtagctagagaggctaaacgccaaaaaattgttgaccgttatgctgaaaaacgtgctgcattaaaggcggcaggggactacgaaggtttatctaaattacctcgcaacgcctcaccgactcgtttacataatcgttgtagggttacggggcgcccacattcagtttaccgcaaatttggtctgagtcgtatcgcttttcgcgaacttgcgcataaaggtcaaattcctggtgtaacaaaagcatcttggtaatttaagatatcaagagcgtcaaaactccaagtaaaaataggaaacttgacgaagaaactaaagtttctaggaaagtttatctttttcacacagagtttagcccgggttcaattgggcttgccaatttgaacacgagctacagctttggcaaaaaagaccaatttgctttggagcattgcttctgcattaaattgtctatttttgctcgtgctgttacgctctttgtatcatgtattaactagcaagtgcaacttgcaaactactagtaagaggagaaaaacaaaatggttatgactgacccaatcgcagacttcctaactcgtattcgtaatgctaaccaagctaaacacgaagtacttgaagtacctgcatcaaacatcaaaaaagggattgctgaaatccttaaacgcgaaggttttgtaaaaaacgttgaaatcattgaagatgacaaacaaggcgtcatccgtgtatttcttaaatacggaccaaatggtgagaaagttatcactaacttgaaacgtgtttctaaaccaggacttcgtgtctacaaaaaacgtgaagaccttccaaaagttcttaacggacttggaattgccatcctttcaacttctgaaggtttgcttactgataaagaagcacgccaaaagaatgttggtggtgaggttatcgcttacgtttggtaaaatcaagatacaaagctcgtaaagaacaaagcaaaattaggaagttggagaagtttgtttacaaacaagccaacttatctattttgcacagttcttagagcgtgttcagttcagctcttgaactaaataagtatctgaaccccgtgaaaactggccgttctggcctgacaatttaacaggagaaaataaacatgtcacgtattggtaataaagttatcgtgttgcctgctggtgttgaactcgctaacaatgacaacgttgtaactgtaaaaggatctaaaggagaacttactcgtgagttctcaaaagatattgaaatccgtgtggaaggtactgaaataactcttcaccgtccaaacgattcaaaagaaatgaaaactatccacggaactactcgtgcccttttgaacaacatggttgttggtgtatcagaaggattcaagaaagaacttgaaatgcgtggggttggttaccgtgcacagcttcaaggatctaaacttgttttggctgttggtaaatctcatccagacgaagttgaagctccagaaggaattacttttgaacttccaaacccaacaacaatcgttgttagcggaatttcaaaagaagtagttggtcaaacagctgcttacgtacgtagccttcgttcaccagaaccatataaaggtaaaggtatccgttacgttggtgaattcgttcgccgtaaagaaggtaaaacaggtaaataatgttgagtggttgatcatcaaccaccaacctattttccaactttgtgcatagcacacgatttaaaactaaagaggtgaaaactgtgatttcaaaaccagataaaaacaaactccgccaaaaacgccaccgtcgcgttcgcggaaaactctctggaactgctgatcgcccacgtttgaacgtattccgttctaatacaggcatctacgctcaagtgattgatgacgtagcgggtgtaacgctcgcaagtgcttcaactcttgataaagaagtttcaaaaggaactaaaactgaacaagccgttgctgtcggtaaactcgttgcagaacgtgcaaacgctaaaggtatttcagaagtggtgttcgaccgcggtggatatctatatcacggacgtgtgaaagctttggctgatgcagctcgtgaaaacggattgaaattctaataggaggacactagaaaatggcatttaaagacaatgcagttgaattagaagaacgcgtagttgctgtcaaccgtgttacaaaagttgttaaaggtggacgtcgtcttcgtttcgcagctcttgttgttgttggtgaccacaatggtcgcgtaggatttggtactggtaaagctcaagaagttccagaagcaatccgtaaagcagtagatgatgctaagaaaaacttgatcgaagttcctatggttggaacaacaatcccacacgaagttctttcagaattcggtggagctaaagtattgttgaaacctgctgtagaaggttctggagttgccgctggtggtgcagttcgtgccgttgtggaattggcaggtgtggcagatattacatctaaatcacttggttctaacactccaatcaacattgttcgtgcaactgttgaaggtttgaaacaattgaaacgcgctgaagaaattgctgcccttcgtggtatttcagtttctgatttggcataagaaaggggataaaatggctcaaattaaaattactttgactaagtctccaatcggacgcattccatcacaacgtaaaactgttgtagcacttggacttggcaaattgaacagctctgttattaaagaagataacgctgctatccgtggtatgatcacagcagtatctcacttagtaacagttgaagaagtaaactaatgaagttttaggggatgtgcactgtaccatcccctaaaactagatatagtcatctatgatgacatcgtataggcgagttgatgggggagacaaccttttctcccttatcggcgctagcattttacaaaagaggagaaaataaaaatgaaacttcatgaattgaaacctgcagaaggttctcgtaaagtacgtaaccgcgttggtcgtggtacttcatcaggtaacggtaaaacatctggtcgtggtcaaaaaggtcaaaaagctcgtagcggtggcggagttcgccttggttttgaaggtggacaaactccattgttccgtcgtcttccaaaacgtggattcactaacatcaacgctaaagaatacgcaattgtgaaccttgaccaattgaacgtctttgaagatggtgctgaagtaactccagttgttcttatcgaagcaggaattgttaaagctgaaaagtcaggtattaaaattcttggtaacggtgagttgactaagaaattgactgtgaaagcagctaaattctctaaatcagctgaagaagctatcactgctaaaggtggttcagtagaagtcatctaagagaggtgacctatgttttttaaattattaagagaagctcttaaagtcaagcaggttcgatcaaaaattttatttacaatttttatcgttttggtctttcgtatcggaactagcattacagttcctggtgtgaatgccaatagcttgaatgctttaagtggattatccttcttaaacatgttgagcttggtgtcggggaatgccctaaaaaacttttcgatttttgccctaggagttagtccctatatcaccgcttctattgttgtccaactcttgcaaatggatattttacccaagtttgtagagtggggtaaacaaggggaagtaggtcgaagaaaattgaatcaagctactcgttatattgctctagttctcgcttttgtgcaatctatcgggattacagctggttttaataccttggctggagctcaattgattaaaactgctttaactccacaagtttttctgacgattggtatcatcttaacagctggtagtatgattgtcacttggttgggtgagcaaattacagataagggatacggaaacggtgtttccatgattatctttgccgggattgtttcctcaattccagagatgattcagggcatctatgtggactactttgtgaacgtcccaagtagccgtatcacttcatctatcattttcgtaatcattttgattattactgtattgttgattatttactttacaacttatgttcaacaagcagaatacaaaattccaatccaatatactaaggttgcacaaggtgctccatctagctcttaccttccgttaaaagtaaaccctgctggagttatccctgttatctttgccagttcgattactgcagcctgcggctattcttcagtttttgagtgccacaggtcatgattgggcttgggtaagggtagcacaagagatgttggcaactacttctccaactggtattgccatgtatgctttgttgattattctctttacattcttctatacgtttgtacagattaatcctgaaaaagcagcagagakcctacaaaagagtggtgcctatatccatggagttcgtcctggtaaaggtacagaagaatatatgtctaaacttcttcgtcgtcttgcaactgttggttccctcttccttggtgtgatttccattttaccgattgcagctaaagatgtatttggtctttctgatgttgttgcctttggtggaacaagtctcttgatcattatctctacaggtatcgaaggaatcaagcaattggaaggttacctattgaaacgtaagtatgttggtttcatggacagaacagaataaaagtatttactgaatcagtaaatactgagggagtggaggtttaaactctgacatttgtaagagttggatctcccctcttctattttgtttttaaatcggggtgaaaagactttttgcttctatttaaaaataaaataaggagatcaaatcatgaatcttttgattatgggcttacctggtgcaggtaagggaactcaagcagcaaaaatcgtagaacaattccatgttgcacatatctcaacaggtgatatgttccgcgctgcaatggcaaatcaaactgaaatgggtgttcttgctaagtcatatattgacaagggtgaattggttcctgacgaagttacaaatggaatcgtaaaagaacgcctttcacaagatgatattaaagaaacaggattcttattggatggttacccacgtacaattgaacaagctcatgccttggacaaaacattggctgaacttggcattgaactagaaggtgttatcaatattgaagtgaaccctgacagccttttggaacgtttgagtgggcgtatcatccaccgcgtaactggagaaactttccacaaggtctttaacccaccagttgactataaagaagaagattactaccaacgtgaagatgataagcctgagacagtaaaacgtcgtttggatgttaatattgctcaaggagaaccaatcattgctcactaccgtgccaaaggtttggttcatgacatcgaaggtaatcaagatatcaatgatgtcttctcagatattgaaaaagtattgacaaatttgaaataaagcgtttttcacacttgcaaaaatccgctacaaatgttatactgagatagtctgacttataattgttgtctctgtgtctagaggcatcgaatcgaaatttatggaggtgcttttgcgtggcaaaagacgatgtgattgaagttgaaggcaaagtagttgatacaatgccgaatgcaatgtttacggttgaacttgaaaatggacatcagattttagcaggg

SEQ ID NO: 66 - DNA, 10726 bp; double-stranded, linear
cccggcatttgaaagctattcgtgaaggatttatgatggcaatgcctttgattttagtcggctctttatttcttattctaatcagttggcctcaagaggcttttacaaattggctgaatagtgttggattgctaagtatcttgacaactatgaatcagtcaacagtagcgattatctccttggtcgcttgtttcggtattgcctacaggttgtcggaaggatatggtacagatggtccgtcggcagggatcatagccttatccagttttgtattgatggcacctcgtttttcgagtatggtttatgataaaaatggggagcaggtcaagcagttatttggcggcgcaataccattttctagcctgaatgcatcttctttgtttatggcgattactattggattggttacagcagagatttatcgtatgtttatccagcgcggaattacgataaaaatgccaagtggtgtcccagatgtagtaagtaaatcattttcagctcttttatctggttttactacttttgttttgtgggctttggtcttaaaaggtcttgaagcggcaggagttgcaggaggtctcaacggactcctaggtgcaattgttggaacaccgcttaagttaattgcaggaacgcttccaggtatgattctatgtgttattgtaaactcattcttttggttctgtggagttaatgggggacaagttttaaatgcttttgtagacccagtttggttacaatttactacagaaaaccaagaagctgtggctgcaggacaaacactccaacacattattacattaccgtttaaagatttatttgtatttattggtggcggtggagcgactattggtcttgcgatttgtctcttcctatttagtaagagtcgtgcgaataaaacattaggtaagctagctattataccgtctatttttaatatcaatacagctattctatttacgtttccaacagttttaaatccgattatgctgattccgtttattgctactcctacaatcaatgccttgattacctatgtatcaatggctgtaggattagtaccctatacaacaggtgtaatccttccgtggacaatgccaccgattataggaggcttccttgcaacaggggctagttggcgaggagctctattacaagttgttttgattttggtttctgtagcaatttattatccattcttcaaaattgcagataaacgcaatcttgaaaaagaaaaagctactgttggagggaaataagatggttatcagagtatttgatcaacagaaaaatacttattctagctttgccttagaggaattaagttactatatgaatcgggtctttaagactaacatagagcttgtcgaggagaaggaagcggatatttttgtaggattagtcaataaagaggacagaaaagaccatgttcttatctcattagacaagggtaaggggagaattgagtctaatacaattgtaggtttacttattggaatttaccgaatgtttcatgaatttggggttgtgtatactagaccagggcgcagacatgactttgttccagagttacgatttgaagattttttagataaacagctatctatagatgaaacagccagttactatcataggggagtatgtatagagggagcggattcatttgaaaatatactagatttcattgattggctacctaagattgggatgaacagttttttcatccagtttgaaaatccttactcttttttgaaacgttggtatgaacatgaatttaatccatatctaaataaagaacaattttcaaatgaattagtacaagaattgagtgataggttggataaagaattgcaaaaaagaggtcttattcatcatcgtgttggtcatggatggacaggtgaagttttaggttactcttcaaaatttggctgggaatcaggtcttagtatttcagaggagaagaaaccctatgtcgctgaaataaacgggaaacgagaattgtttaatacggctccgattttaaccagcctggatttttcaaatccagatgtagctgataagatggtagaaattatcaaggattatgccaagaaaagacctgatgttaactacttacatgtatggttgtcggatgctcgtaataatatttgtgaatgcgaaaactgtagacaagaattggtttcggatcagtatattcgtattctcaatcaattggatagggctttaacgagtgagggattagatacaaagatttgttttctgctttatcatgagttgttatgggcacctcagaaagaaaaattagataatcctgaacgctttaccatgatgtttgcaccgattacaagaacatttgaaatgagttatgcagatgtagattttgacaattccatacctacgcctaaaccttatatgcgtaataaaattatacttccgaattctcttgaggaaaatttatcttatctttttgagtggcaaaaagcatttaaaggagatagtttcgtatatgactatcctttagggcgtgctcattatggcgatttaggctatatgaaaattagtcaaactatttacagagatgtatcttatctttccaacctacatttgaacgggtacatttcgtgtcaagaattacgtgccggattccctcataattttcctaattatgtcatgggggaaatgctctggaagaagacaagaagttatgaagaattgattgaagaatacttttctgctttgtatggggaaaattggcagtctgttgttgaatatttagaaaaattatccatttattcctcttgtgattattttaatgcaattggcagccgtcaaagtgatgttttagcgaatcattattatatagcttacaatctagctgataattttttaccaattattgaggaaaatatttctaagttattaaatagtcaaaaggatgaatggaaacagctcagttatcatcgtgaatatgttgttaagatggcgaaggctttatatcttcaagcaactggaaaaacaaggcaagctcaagatgaatggagaaatgtgttgaattatatccgtgggcacgaattgctatttcaatctaatttggatgtttatcgtgtaattgaagtagcaaaaaattacgctggtttccacttataaatcataagtatagaaaatgaactaaggtattcagagaagattgatcctaaatattatgaaatttaaggatttttaagatatttagggtcaactttctatttatatcgtagcgaagtcattttaataatgatgtgtaaaagatggatcaagattgaggaggaagaaagatgaaatcaaaagaagaaataaatatgcttggttttacaattgtcgcttacgcaggagatgcaaggtcagatttgatggatgctttggcgtttgcgagagatggatattttgaacaggcaagagaattggttgagtctgcaaacgactcaatagtgtctgcccatcgagaacagactaatttattagcggaggaggcatatggagataattttgaagtgagctttattatgattcatggtcaagatactttgatgacaacgatgctattgtatgatcaggtaaagttttttattgatgaatatgaacgaattcgaaagattgaagaacatattggtttgcaatgaggattagtcatggaaaatttacaggttaaagccttaccgaaggagtttttattaggaactgctaccgctgcttatcaagtagagggtgcaactagggtagatggcaaaggaataaatatgtgggatgtttatttgcaagaaaatagtccgttcttaccagatccagctagtgatttttattatcgttacgaagaggatatagctttggcggcagaacatggtttgcaggctttgcgtttatctatttcttgggttcgtatatttcctgatatagatggggatgctaatgtattagctgttcattattaccatagagtttttcagtcttgcttaaaacataatgtgattccgtttgtttctttacatcattttgattcgcctcagaaaatgttagaaacaggggattggttgaacagagagaatattgatcgtttcatacgatatgctcgcttttgtttccaagaatttacagaagtcaagcattggtttacaatcaatgaactgatgtctcttgctgcaggtcaatatataggaggtcagtttcctccaaatcatcattttcaattatctgaagcaattcaagcgaatcataatatgttgttggcgcatgctcttgcagtcctcgaatttcatcaattagggattgagggaaaggtaggttgtattcatgctttaaagccaggctatcctattgatgggcaaaaagaaaatattttggcagctaaacggtatgatgtttataataataaatttctattagatggaacttttttgggctactacagtgaggacacgctttttcacttgaatcaaatattggaagctaataattctagctttattattgaagatggtgatttagaaattatgaagagagctgcacctcttaatacgatgtttgggatgaattattatcgttcagaatttattcgtgaatacaaaggtgaaaatagacaagaatttaattcaacaggaataaaaggacagtcttcttttaaattaaatgctctaggtgaatttgtaaaaaaacctggtattccgacaacagattgggattggaatatttatcctcaagggttatttgatatgttgcttcgtatcaaagaagaatatcctcaacatccggtcatttatttaactgaaaatggtacagcccttaaagaagttaagccagagggcgagaatgatattattgatgacagtaagagaatccgttatattgagcaacatttacacaaagttttagaggctcgagatagaggagtcaatattcaaggctattttatatggtctttgcaagatcaattttcttgggcgaatggctacaataagcgatatggtcttttctttgttgattatgaaacacagaagagatatattaagaaaagtgctctttgggtaaaagggctaaaacggaattaaggttagcgatttgactgatgtttaatatgttttaaatatgaggttgaattttttataggaggagttttatggataagctagtcgctgccattgaaaagcaacaagggaaatttgaaaaaatttctactaataactatatgatggctattaaagatggattcattgctactatgcctttaattatgttttcaagctttttgatgattattattatgattcctaaaaatttcggagtagagttaccgagtccagctattgtctggatgagaaaagtgtatatgttaaccatgggagttttgggtattattgtttcagggactgttggaaagtcattagttggaaatgttaacagaaaaatgcctcacggaaaggtaataaatgatatttctgcaatgttggcagccatatgtagttatctggtattaactgtaacgcttgtagttgatgagaagacgggatctacaagtttgtcgacaaactatttaggatctcaaggattgataacttcgtttgtcagtgcctttattactgtaaatgtttaccgattctgtattaagcgagacattactattcatttacctaaggaagttcctggggctatatcacaagcttttagagatattttccctttttcttttgttttacttattagtggtttgttagatattgtatctcggtttagtttagatgttccttttgcccaagtatttcaacaactattgactcctatttttaagggggcagaatcatatcctgctatgatgttgatttggtttatgtgtgctttgctttggtttgttggaattcatggaccatctattgtcttacctgctgttacagctttgcaactgagcaatatggaagagaatgctcaacttcttgcaaatgggcagttcccttatcattctttaacacctaatttcgggaattatatcgctgctattggaggaacgggggctacctttgttgtaccatttattttgattttctttatgcggtctaaacaattaaaatcggtaggtaaagctacaattactcctgttttatttgcggtaaatgaacctcttctatttggtatgcctgttattttgaatccctatctttttgtcccttttttgatgactccaccagtgaatgtatttctaggaaaggtctttattgatttctttggaatgaatggattttatatccagttaccttggacctttcctggtcccttgggattgttaattggaacgaattttcaacttatctcctttgtatttttatctttgattttagttgtcgacatattgatttatttgccattctgtagagcgtatgatagacagttactggtgaaagaagatattgcaagctcaaatgatattattttagaggaggatacaagtgaaataattcctggtgagatagatgaaataaaaagtaaggagttgaaagtactggttctttgtgcagggtctggaacaagtgcgcaattagccaatgcaattaacgagggggctaacttaacagaggttagagtgattgcgaattcaggagcgtacggagctcattatgatattatgggtgtttatgatttaattattctggccccacaagttcggagttattatagagagatgaaggtggatgcagaaagattaggtattcagatagttgctaccagaggaatggaatatattcatttaacaaagagtccaagtaaagccttacaatttgtattggagcattaccaagctgtgtagtaagtttttccatcttttatttgagtaaagattttgtttacagataggcttggatttaaaaacgttcccccttttttaatataagaatccctctttcacaattgtaaaaagagggattttgtattttatctcttagaccaagttctcttcataaagagaaggaggattgggtaaatctccaagcgccctgcaatcattgcaaaggataggagaatttttgagatgggactaaagattgagaaactagaagtggttcctagaataggcccgatattattgaaacagctaaagacagcgctggtcacgaccagaaaatcattgctatctaggctgacaataaagataagcgctagcaaaatcatagcatagatgacaaagtacttgagaatcttatgctgggtatctttgtcaatcaccgttttattaacatggagggtcaaaacacggtggggcgataggattgacaaaatttggtttttggcaatttttgaaaggatgaggcctcgaataatcttgagtccacctgcagttgatccagcagagccaccgattgccatgaggaaaaggaggataaactgggagaagaggggccagttggtaatatctccatatccaaaaccagttgttgtaatgatgttggaaacctggaagaaggtcatttcaaagctctttgaaaaccctgggtagaggtagagggtgttgaggctaatcaagcctgtagaaaccagtacaatgaccaagtaagccctaagctcttcatctccaaagaaggccttgatgcgacggagcatgaggtagtagtagaggttgaaatttactccaaaaaccagaactccgatactgaccagataggtaatcagtgagctgccatagtgggcaattccgtcgttatagacggtaaagcctccagttcccgctgtccccatagcaataacaaaactatcgtagagaggcataccggctagataatagatgatgacaaagagggagaagagagctagataaaggagatagagaatctgggcagtgttttttagtttggatacaaccttgccaaaaacaggacctggaacctcagccttcatcacctctaggtggctatttttggcattgtccataatagcaagtgcaaaaacaagcactcccatccctccaatcaagtgggtaaaacttcgccagaagaggagggaacggctgagaaccgaaacgtcgttcaaaatacttgctccagtagttgtaaatccagaactaatttcaaaaaaggcatcaataaggctggggatttgcccagaaaagacaaaggggagaccaccaaagaaagaccaaaggatccaacagagggcaacgatcaagactccctccttggcataaatccgttgattttttggcttctgtaaactccctgaaccgcctaacaatacgagaatccctatggtcgaaaagagggctgtaaagacttggctcgattcacggtaatagacagcaatcgcaacaggaaccaaaagaagaacagcttcaatcaaaagtaattttgaaaggaggtaacgaatcatacttttattcatttcttacctcgcgatcaagtcataaatcttggtgatgtttggcaacaaggttgttactaggagcttgtctccaacttccaacatatcctccccagttgggaaaatagtcttgccctttcgaataatggctgcaataagaaccccttttttcaatttcagttgagaaagaggtttggcagtcattttattggcttccttgatatggaattgcagggtttcgatttggccattggctagatggtgcatagcttgaaggtctgaatactgggcattaactcgaccacgaataaagtgcataatcgtatctacagcgatgcttttaggtgtgatgatacttgaaaaatcaggcgcattgataatctcgaggagactggtacgattgaccttagtaatatttttctgtacacctaccctgtcaaggaacatagatgtaatcagattttcctcatcgactcctgttagagtcgcaacggcatcatagtgttgagcactttcttccagcaggatatcttttgcggttccatctccttgaacgatgtagagatttgggaatttctcgctaaagaagctggcgatttcaggattgatttcaatgacttttgtatcgatacgactatctttgagaataccaagtagataataggcaattctacctgccccaacgatgagaaggctcttcacggcgcgtgatttaaaataattatggaagagtatcatatcgacacggttaccagtgacaaagattctatctttatcctgtacagtcatgtcaccgcttggaatgataatttgatgatccctctctatcgcacagacaatgacattaccaaattttttacgaaaatcagaaatgggcatttggcaaagaccgctggtggacttgacgacaaattccatgaggctaacgcgtccaccagcaaagcgttcgacagacagggcgttggggaagtcaatgatattcgcgatagcgcgggcagccaagagctcaggattaacgataagagaaaaaccgagaatattcttttccttgaaataagagttagaatattcagggttccgcacccgaacgatagtttctttagctcccattttcttggctagaactgctgcaatcatgttgacttcatcgtgctcagtcagggcgataaagatatcacaatcttggacgctggcttgctcaagaatggcaaaatcggccccgttaccaaggataccaatgatatcaaagcgactgacaatatgattgagaacagcttcgtcttgctcaatcagcaaaacatcatgcttttctgcaaccaaggagcgacagagggcaaaaccaacttttccccctccgacaaggataattttcataataaaacctactttttcatgatgtaactatcataccctttttcaagaaaaaatgcacctactagctaataacaagagtttttagtgaaaattcgctataaggtaaaactataccctaaccaattgaaatagctattagcgactttctctgaaatatggtatgataaaggatatacaaggagataaaatgaataataatttactggtattacaatcagactttggtctggttgatggtgcggtatcggctatgattggagtggctttagaagagtctccaaccttaaaaatacatcacttgacgcacgatatcacgccttataatatttttgaggggagctatcgtctctttcagacggtggattactggcctgagggaacgacgtttgtatcggttgtcgatccaggtgtcggttcgaaacgtaagagtgtagttgccaagactgcaaaaaatcaatacattgtcacgccagataatgggacgctttcctttatcaagaaacacgttggcattgtagccattcgtgagatttctgaggtggccaataggcgtcaaaacacagagcattcttataccttccacggtcgtgatgtctatgcctatactggtgctaaactggccagtggtcacattacttttgaggaagtagggccagagctcagtgtggaacagattgtagagcttccagtcgtagcgaccatcatagaagatcatctggtgaagggagccattgatattctggatgtgcgtttcggttcgctttggacctctatcacacgggaagaattttacaagctggaaccagaatttggtgatcgttttgaagtgaccatctatcatgctgatatgctggtctatcaaaatcaggttgtctatggcaaatcatttgcagatgtgagaattgggcaaccsatctttacrctcagcatcttcgattagctgggcaattcgttctagttggatttcgtcaatcaaggt

SEQ ID NO: 67 - DNA, 7163 bp; double-stranded, linear
ttatctttaacgatatcaatcaagatctggtcaataaagggattggggcttatcgtgaagttggcatccaagcccatggatatgtctgtgacgtgacagacgaggacggtatccaagccatggtcaagcaaatcgaacaagaggttggtgtcattgacatcctcgttaataacgctggtattatccgccgagttccaatgtgcgaaatgagcgccgctgatttccgtaaggtcatcgatattgacttaaacgcaccatttatcgtttcaaaggcagttattccttctatgataaagaaagggcatggaaagattatcaatatttgttcgatgatgagcgaactgggacgtgaaacagttagcgcttatgctgctgctaaagggggcttgaaaatgttgacccgcaacattgcgtctgaatacggtggagccaatatccaatgtaacggaattggaccgggttatattgccactcctcaaacagcacctcttcgtgaattgcaagaagatggttctcgccacccatttgaccagttcatcattgcaaaaacacctgctgcacgttggggaaatactgaagatttgatgggccctgctgtctttctcgctagtgatgccagcaattttgtcaatggccacatcctatatgtagatggcggtatcttagcctacatcggaaaacaacctgagtaaaaatagaaagaagatcttatgaaaatcgcattaatcaatgaaaatagtcaagctagcaagaatcacattatttacgatagtctaaaagaagcgacagataaaaaaggctaccaattatttaactatggtatgcgtggagaagaaggagaaagtcaattaacttatgtgcagaacggactaatggctgccatccttttaaatacaaaggcagttgactttgttgttaccggctgtggtacgggtgtaggggctatgcttgctttaaacagcttccctggtgttgtctgtggtctagcagtggacccaactgacgcttacctttattctcaaatcaatggtggtaacgccttgtctatcccttatgccaaaggatttggctggggggcagaactgaccctcaaattgatgtttgaacgcttatttgctgaagaaatgggcggtggctacccaagagaacgtgtaatccctgaacaacgcaacgctcgtatcttaaacgaggtgaaacaaatcacccacaatgatttgatgaccatccttaaaataatcgaccaagacttcctcaaagacaccatctctggcaaatacttccaagaatacttctttgaaaactgccaagatgatgaagttgctgcttatttgaaagaagtattagccaagtaaagctattctaaaccagaaaggaactaatggatgacgaaaatattactgtttggcgaaccattaattcgaatttcaccattagatgccaccagtatcggcgatcatgttgccagttcgacttattttggcggatcagaaattaacatcgcttgtaatttgcaagccctgggtatctcaacgaaagtttttaccgcactccctgccaacgagattggagatcgttttctcacattcttgaaacagcaccaaatcgataccagttcaatctgtcggcttggcgatcgaatcggcctctactatttggagaacggctttggttgtcgtcaaagtgaagttttctacgatcgtaagcatacgagtatcagccagattcggccaaacatgctagatatggattctctctttcaggggattagccattttcattttagtggaatcaccgtagctatcggtcaagaggtccgtgcgatccttctcctactcttggaagaagccaagcgccgaggaattgtcgtttcaatggatctcaatctgagaacaaagatgatttcagtcctagaagccaagtatgaattttctaagtttgcacgttttactgactattgcttcggtattgatcctctcatgattgatgaccaaaatctagagatgtttccaagagacagtgctagcctagaagaggtggaaaatcgcatgcgacttttaaaagaagcctatggtttcaaggccattttccataccctccgctctagtgatgagcaagacaaaaatgtctatcaagcctatgctctagaagaactatttgaagagtctgtccaactaaaaactgcagtctatcaacgaattggtagcggggatgcctttatatctggtgccctttaccaactactccatcattcctccctaaaaactaccattgactttgcagttgcgagcgcaactctcaaatgcactcttccaggagaccatctctccacttcctcaactagtattgaaaatttactggcaaatgcacaagatatcattcgttaggagaattacatgaccaaatcagatacgattattgaactaaaaaaacaaaaaattgtcgctgttattcgaggaaatacaaaggaagaaggactacaagcctcgattgcttgtatcaagggcggtatcaaagctattgaaatcgcctataccaatcagtatgcaggacaaatcatcaaggaacttgtagacttgtatcaggacgatcagagtgtttgtatcggtgcaggtactgtgcttgatgccgtaactgctagagatgccattctagctggagcaaattacgttgtttctccatctttccatgctgaaactgcgaaaatgtgcaatctctacagcacaccgtacattccaggctgtattaccctcacagagatcacgactgcacttgaagccggtagtgaaatcatcaaactcttcccaggtagtactctcagtccagcatatatctctgcagtcaaggcaccgatcccacaagtttccgtaatggtaaccggaggagtcggcctaaacaacatccctcaatggttcgctgctggtgcagatgccgttggaattggtggcgaactcaataaactcgcttcccaaggcaactttgaccgcatcagcgagattgcccaacagtatattacactcagataaaatcataactacccgtctaacgggtggtttatctcagagctataagcccaaatcatcagccagcgcctaaagacgctggctttcacgttgttcaagccttattgctcttgactcgtcacttgcctctttaagagactttggtattacttaccactatccctaaagggatcctcatattcttttacactcaatttatctagtgctatagtagattgaaactggaatagtacacctctgcttctaaaacattgttaaaaatcgatttgactgtcctgatcgattttgtcctgttcttatttcattttactatatatcatactttactcgttctcaaattttcatactcatgaagaaatcatccactcgataatttctttaatcttgactatatttcttaattgtggcttcattaagccctactggacttacataataaccttcctcccagaaatgccgattcccaaacttgtacttgagattggcgtgtttgtcaaacatcatgagtgcacttttgccttttaaataccccataaaacttgaaacacttagcctcgacggaatactgactaacatgtgtacatggtctggcattaagtgaccctcgatcatttcaacacctttataactacacaagcgatgaaatatttcgtctaaactacttctatattgattatagatgacttttcgtctatacttaggggtgaacacaatatgatagaacacctccactttgtgtatgataaactatgagtcttttgtgccatattttttctcctttcgctttacaattggattgaacacctttattgtatcgcgtttggagtttttttggtataaccttcgacgcgcacccgtatagcgggtggttgttttgtctcgcacctcacggagcgagacggactaatatagtggagtgaaataggatacgaacaaattgattaggaaaatcaaatgaatttatagaaatcttttagcagttataacgttctattctagtttcaaaacgctatagtcacataataatgaagtaaaaaaggataagtatcaacttatccttttttaaaagaaaaatccgaagatatttggccttcttcggattttttctattttccacagtttcatgtaattcatctagatgatgaacaaattagttgttctttcctctacggaatagataaaatgccccaagtagcaagaaccctagacttgccaagattgactgaccttctcctgtctgagggagattcttttgatccgaatggttcttttcctcttcagatttttccttttcttttgaattctgtacttgtggctgagctgcttgctctagctttttaaagacttcctgatctggagctgattcctgggtttcaggattatagtaggcaatcttatattcatccccttcttttcgaatggtatagactccacgtttcaaaacttggaattggttggaaatagtagagacagaatcatcatatttcacaatgccccaaactccttgtttagcatcataaacagactgaagggtttcgttattttcgatgaggctactttctaactcttttatcatttgattgaaggtggcacgatccacgttaggaatgagcatatagccataagaatctctattttgcttatgagcctgactaatcgtaagaaattcattttcaacttccttgtctgactgtccttcattgatatccttccaggctcccttttgcaaagccttactcatactgattgaactcttcttaaagaaaaagtaaccaatattctttttcgaatcgaacgattctaaaaagacactttgggtttcaggataatccttttcttgttctgtaagggaggcttctttatcattgacatagactttatatggattacctgattccagttttctctggtcaattgtagttgcagcagtatctgttgaagtgttttggatattgcttcctaaaaaggcgatcttatcctttagcataaaccagctcttatgagcagtcaatgtttgattccagttggtgaaatccatggttgctgtcgcattggcatcatctagtttgctcgttccaacgaaagcagacggtaaaactttacctgtatcgctatccgctctcttagcatccgtctctgttgtaccaggcatcttatatggattaactgttggccagtagccatcgctatagtgactcaaatcgccattgtaaagatagaacatcccatcactcgtataccaaccacgtttattttccttgttcatgtgttcgtaattcaaggtacgactggaaaagagtgacaagccaaatccaaaccctttctctgcattgtacatggctgttttatccatcttgttaaaggcagataggtaacttggtcttggaacacttgcgactcctgcatcacttaacaaggattgcatcaaactgatatccttataagtcttcaaattcttaaagacatcataataactatccgattgaacaatggtcttcacaagactctgcaaacattgtttggtttctccttcagacatatccgctattcggtgaatccctcttagtacttctactgcggccacgtgcccctcgctatttgcacgactgatcgagcgtccacgactcatatccatcaactctccattcaccagcaaaggagcaaacgatttatcaatccagtggtacatggtttgcattttatctttatcgattggattcttggtcttttgaatgactggcaacagttgagacaggccatcaatcaaaacattcccataagcacccgtataggcaacattggtgtggtcgatataggatccatcttgataaaaaccttcaccttggtctaccaacttgaacacttgctcaatcgagcgaatggtagaagaaatttcttgatcatccttacgcagtaaaccagctattacttttacccttcccatatcaactaagtttccacctagagccttgaatgggttatcagtcgtctttcggaaatgttcgggatctggtacaaatttttcaatcacatctgtatattttttaatttcctcatcagagaagtattctttcatcagagacaaggtattgttgatggcacgaggtgtaccgatttcataatcccaccagttcccaacaatgctcttttcactattgtagacatgtttatgcatccattccatggaatccctgactgttcgaacgacagtttcatcttgataataacgagaagaaggattggtcacttgcttggccatctcctccaatttccgataagtggcagtcagatttgcagacgttttataatttgaaaatttttcccacaaataggtgcggtccgcctgacttgaaatactggataggctatcagctacctttccttccaattcctggtttaatttggccatctgttcatttttagaatcatagtattgattcccagcgatgatgccattccagtcatccaaacggtctgtgtatgcatccttaacagaggccagaatcttcaaaggaatctttttcacttccttgccatctttactgacaatgacattggttgtcccttccttaagaggttctaaaattccatttttgactgaagcaacgtcaggattttctaccttataagtatagtccgcaagagaaaaaacatgtttttttccaattggtaaatcaatcttttcctcaagctgtttatctgtttgagaatcctcagaaagctggtctgctacctctaccagctcaatatccttaaaggaaacagtcccagttcctgtttcatagaataactccagcttgattttatcaacatctaaagtcgggctatagtctgcttcaatggtctgccagtcctttgttcctgacgtcgttgcagaattccacaatcgcttgtccttaccactttcctcaatgatacgaactttggcaatcccgattttattatctgttttaatcttgaaacgcagtttatactttttcttagcttcaataggaaccatacggtgaagcgctgcccttaatttctcatggcttgagatagtgatagccccatccttagcctcaatgactcgagttgaggcatctgcactattcttctggtctacccaagctgaccaccccctgagctttgcttcctgtccgg

SEQ ID NO: 68 - DNA, 9244 bp; double-stranded, linear
cgttataacatacatgtaagcggtacccaaaatggtgccaagtcaaaatttttaaggaggaaaatacatgtcttcacatccaattcaggtcttctcagaaattgggaaactgaaaaaagttatgttgcaccgtccaggcaaggagttagaaaacttgttgccggactatcttgaaaggcttctttttgatgatattcctttcttggaagatgctcaaaaagaacatgatgcatttgcccaagctcttcgcgatgaaggaattgaggttctctacctagaacaactcgctgctgaatcattgacctctccagaaatccgcgatcaatttatcgaggaatacttagacgaagccaacatccgtgatcgtcaaaccaaggttgctattcgtgaattgcttcacggcatcaaggacaaccaagaattggttgaaaaaacaatggctgggattcaaaaagttgaattgccagaaattcctgacgaagctaaagatctaactgacttagttgaatcagagtatccatttgcaattgacccgatgccaaacctctatttcactcgcgacccatttgcaacaattggaaacgccgtatcgcttaaccacatgtttgcagacactcgtaaccgtgaaacactctacggtaagtatatcttcaaataccacccaatctatggcggaaaagtggatttggtctacaaccgtgaagaagatacgcgtatcgaaggtggagacgagttagttctttctaaagacgtccttgcagtaggtatctctcaacgtacagacgcagcttctatcgaaaaacttttggtcaacatcttcaagaaaaatgttggcttcaagaaagttttggcctttgaatttgctaacaaccgtaaattcatgcacttggatactgtcttcactatggtagactatgacaagttcactattcacccagaaatcgaaggcgaccttcacgtttactcagttacttacgaaaacgaaaaacttaaaatcgttgaagagaaaggtgacttagctgaacttcttgctcaaaaccttggtgtagaaaaagttcatttgattcgttgcggtggtggcaatatcgtagcagctgcgcgtgaacaatggaacgacggttctaacactttgaccatcgcacctggtgtggtagttgtttatgaccgcaataccgtgaccaataagattttggaagaatacgggcttcgcttgattaagattcgcggaagtgaattggttcggggccgtggtggacctcgttgtatgtctatgccatttgaacgtgaagaagtgtaatcgctgttcgatattcgtcaatagaaaatgtaaaaaatagaaagaggaaataataaaatgacaaattcagtattccaaggacgcagcttcttagcagaaaaagactttacccgtgcagagttagaataccttattggtctttcagctcacttgaaagatttgaaaaaacgcaatattcaacaccactaccttgctggcaagaatatcgctctcctatttgaaaaaacatctactcgtactcgtgcagcctttacaactgcggctatcgaccttggtgctcacccagaatacctcggagcaaatgatattcagttgggtaaaaaagaatctactgaagatactgctaaagtattgggacgtatgtttgacgggattgaattccgcggattcagccaacgtatggttgaagaattggcagaattctcaggcgttccagtatggaacggtctaactgacgaatggcacccaactcaaatgctcgctgactacttgactgttcaagaaaacttcggtcgcttggaaggcttgacattggtatactgtggtgatggacgtaacaacgttgccaacagcttgctcgtaacaggtgctatccttggtgtcaatgttcacatcttctcaccaaaagaactcttcccagaaaaagaaatcgttgaattggcagaaggatttgctaaagaaagtggcgcacatgttctcatcactgaagatgctgatgaagcagttaaagatgcagacgttctttacacagacgtttgggtatcaatgggtgaagaagacaaattcgcagaacgtgtagctcttcttaaaccttaccaagtcaatatggacttagttaaaaaagcaggcaatgaaaacttgatcttcctacactgcttgccagcattccacgatactcacactgtttatggtaaagacgttgctgaaaaatttggtgtagaagaaatggaagtaacagacgaagtcttccgcagcaagtacgctcgccacttcgatcaagcagaaaaccgtatgcacactatcaaagctgttatggctgctacacttggtaacctttatattcctaaagtataattttagataataaaccgtctaccaacagctatgagggctgcgactaatagctttagtccggtcctcttttatgtaatggtaatctattatttcttataaaatatgtgaaaaatcattaaattgaaatctaaacgcattctattgagtgtgataaaggagaatttatggcaaatcgtaaaattgtagtagctttgggaggaaatgcgattctttcttctgacccatcagcaaaggctcaacaagaagctttagttgaaacagctaagcatcttgtaaaattgattaaaaatggagatgatctgattatcactcacggtaatggacctcaagttgggaatctcttgctccaacatttggcatcagactctgaaaagaaccctgccttcccactcgactcacttgtcgctatgacagaaggtagcatcggtttctggttgaaaaatgctttgcaaaatgctctcttggatgaaggcatcgaaaaaaatgttgcctctgttgtaacgcaagttgtcgtagataaaaatgatccagcttttgttaacttgagtaaaccaatcggtcctttctattcagaagaagaagcaaaagcagaagccgaaaaaagcggagcgactttcaaggaagatgctggccgtggctggcgtaaggtcgttgcctcaccaaaacctgttgacatcaaagaaattgaaaccatccgtactcttttaaataatggtcaagtcgtcgtagctgcaggtggtggcggtattcccgtcgtcaaagaaaacaatggacatttgactggtgtcgaagcggttattgataaagacttcgcttcccaacgtttggcagaattggttgatgcagacctcttcatcgttttgacaggtgtagattatgtatttgttaactacaacaagccaaaccaggaaaaattggaacatgtgaatgttgcccagctggaagaatatatcaaacaagatcagtttgcaccaggtagcatgcttccaaaagtagaagcagctatcgcttttgtcaatggtcgtccagaaggaaaagcagttattacttcccttgaaaatctaggcgccttgattgaatctgaaagcggaacaattattgaaaaaggataagttgttttactaataagatgtattctatttctagtatctttatatcaaattagaaattattcttgaaaacatgtacaatatttcaaaagatactagttttagactttaatatggtaaaacaaatataaatagaaagcgttttcttgaatgtttatttaagaaagtagttggttttttacactttgttagacatcaggaggaaaaacaaatgagtgaaaaagctaaaaaagggtttaagatgccttcatcttacaccgtattattgataatcattgctattatggcagtgctaacttggtttatccctgcgggggcctttatagaaggtatttacgagactcagcctcaaaatccacaagggatttgggatgtcctcatggcaccgattcgggctatgctaggtactcatccagaggaaggttcgctcattaaagaaacgagcgcagcgattgatgtagccttcttcatccttatggttggtggtttccttggcattgtcaacaaaactggtgctcttgacgtagggattgcctctatcgtgaagaagtataagggccgcgaaaaaatgttaattttggtactgatgcctttgtttgccctcggtggtacaacttatggtatgggtgaagaaacaatggccttctatccactccttgtgccagttatgatggccgttggttttgatagcctgactggtgttgcaattattttgctcggttctcaaatcggctgtttggcatctactctgaatccatttgcgacaggtattgcttcagcgactgcgggagttggtacaggggacggtatcgtacttcgtctgatcttctgggttaccttgactgctcttagtacttggtttgtttaccgttatgcggataagattcaaaaagatccgactaagtcactggtttatagtactcgcaaagaagatttgaaacactttaacgtagaagaatcttcatctgtagaatctacacttagcagcaaacaaaaatcagttctcttcttatttgtgttgacattcatcttgatggtattgagcttcattccatggacagaccttggcgttaccatttttgatgactttaatacttggttgactggtcttccagttattggtaatattgtcggttcatctacttctgcactaggtacttggtacttcccagaaggcgcaatgctctttgcctttatgggtatcctgattggtgttatttatggtcttaaagaagataagattatctcttccttcatgaatggtgctgctgacttgctcagtgttgccttgatcgtagcgattgctcgtggtattcaagttatcatgaacgacggtatgattaccgatacaatcctcaactggggtaaagaaggcttgagcggtctatcttcacaagtctttatcgttgtaacttatatcttctatctacctatgtcattcttgatcccatcttcatctggtcttgccagcgcaactatgggtatcatggctccacttggagaatttgtaaatgtccgtcctagcttgattatcactgcttaccaatctgcttcaggtgtcttgaacttgattgcaccaacatctggtattgtgatgggagctcttgcacttggacgtatcaacattggtacttggtggaaattcatgggcaaactcgtagtcgctattattgtagtgaccatcgcccttcttctccttggaaccttccttccattcctataaaatagtgagtgaggtgattccatgaaaatagatataacaaatcaagttaaagatgaatttcttatatcattaaaaaccttgatttcctatccttcagtactcaatgaaggagaaaatggaacaccttttggacaagcaatccaagatgtcctagaaaaaactttagagatttgtcgagacataggtttcactacctatcttgaccctaaaggttattacggatatgcagaaatcggtcagggagcagagcttctggccattctctgtcatttggatgttgttccatcaggtgatgaagcagattggcagacaccgccatttgaagcaactatcaaagacggctgggtattcggacgtggtgtccaagatgataaaggcccttcgctcgcagctctctatgcagtaaaaagcttgctggaccaaggtattcagttcaaaaagcgcgtacgctttatctttggtaccgatgaggaaaccctctggcgctgcatggcacgctacaataccatcgaagaacaggccagtatgggctttgcacctgactcatcttttcctctgacctatgctgaaaaagggcttctacaggtcaaacttcatggccctggatcggatcaactagagcttgaagtaggaggcgcctttaacgttgtaccagacaaggccaactaccaaggtctcctctatgaacaggtttgtaacggtctcaaagaagctggttatgattaccaaaccactgaacaaaccgtaacggttctcggagtgccaaagcatgctaaggatgctagtcaaggtatcaatgctgtcatccgactagctaccattcttgctcctctccaagaacaccctgctctcagttttcttgcaacacaagcaggtcaagacggcacaggaagacaaatctttggtgatatagcagatgaaccttctggtcacctatcctttaatgtcgcaggtctcatgatcaatcatgaacgttctgaaatccgtattgacattcggactcctgtcttagctgacaaggaagaactagtagagttgcttacaagatgtgcacaaaactaccaactccgctacgaagagtttgactatctagcgcctctatacgtcgcagaagacagtaaactcgttagcacactgatgcaaatctaccaagaaaagactggcgataacagtcctgctatttcatccggtggtgccacttttgctcgcaccatgccaaattgtgtagccttcggcgccttattcccaggagcgaagcagacagaacatcaggcaaatgaatgtgccgttctagaagatttgtaccgtgctatggatatttatgccgaagccgtctatcgacttgcaacttaatcaggcaactgtttctaccaaaaaaaatcgaccgattaatgaactgcaccccaaaagttagacagaataaatctaacttttggggtgttttattatgaaattgagttatgaagataaagttcagatctatgaactaagaaagcaaggacaaagcttcaaacagctttcaaaaagatttggtgtggatgtttctggtctaaagtcatctgaatctttgagatgagctttataaatcgcttttttcagtttttgcactggtgtttcgataaactcaaactttttagccgtggtattgcctgattttatagtatattgaaactagaatagtacacctctccttctaaaacatttttagaaatcgatttgactgtcctgatcgatttgtcctgttcttatttcattttactatatttgagccacttcgtctttaacggctttattcataagctcttgtaatttttctttactatcaattacttctgattttccgttgtaatttattgtaataggttttaacttacctaatttctcgacacgctcattaatttgatcttttttgaaggctgcttatgtttttcctaagattttttcaaaaatatatttatcagatagcggtttgtcttcttcttcagcttggtttttgtattaatttgaaacataaggaacaaatccttcatagtaacctaatgctcccataagttcaaaagcttgttttctaattcaaaccattgcaactcagatttcagcttttcagataaatcctgctcatccaaataatgacttgaaattagtgctgaactcgtttctgtatcctgtacaggctgagcacccataccagcaaaaaataaactcgttcctagcaagaccgaacaagctcctattgcatatggcctcaaagaaaaacgctgctttctctcaaattgaaattctttcatcccatctcccatcattcattattactgtatattttgtatatcagaaatagtttgtattcacaaatctttctagttattcccttatcattcctaattaagggagataacatacaataatttttagttaaatgtatatcgatgttttttgtttttcttaataaacgcaatacaaaaagagcctgttaccaagctctttgtactcaatgaaaatcaaagagcaaattaggaaactagccacaggttgctcaaaacaccgttttgaggttgcagatagaactgacgaagtcagctcaaaacactgttttgaggttgcagatagaactgacgaagtcagtaacatctatacggcaaggcgacgctgacgtggtttgaagagattttcgaagagtattagtctattatttcttctcagcgcgaagggctgacaagatttgtgttcggatatcatccacaccatttggagtatttggtaaaaagatagtttgatttcctttagaggcaaaggtattcaaggtatccaaatactggttggtcaagaggatagacatgatttgttcttctgtcatgccaacattggcttccttgagttcggtgatagactctgccaatccatccacaatcgccttacgttgttgggcaatccccacaccatgaaggcggtctttttctgcttctgcttcagctgcagtgacaattttaatcttgtcagcttccgccaattcttgtgctgcgacccgcttacgttgcgccgcattgatttcattcatggattgcttaacttctgcatctggttcgaccttggtaatcaaggttttcacgataatgtagccgtaagtggtcatttcttctgctacttggtgttgaacttcaagggcaatctcatcttttttctcaaacaattcatccaaggttaattttggaacagaagagcgaagagcatcttcgatataagatttaatctgagattctggacgtatgagtttatagtaagcatctgtcacgctctgctcgttgacacggtactgagtcgctacattcatcataacgaacacattgtccttggtcttagtctcaaccacaatatcactttgcaacaagcgcaactgaatccgtgctgcaatcgagtcaatcccaaaaggcaagcgaatatgaataccgctattagcaaccttttggtatttcccaaagcgttcaataatcgccaccgactgctgacgaaccacataaactgtactcagtgtgactatcaccaataggagcacacaaacaatcagaaaaatcatgaaaaatattgccataatggaacctccacaagtatttttctagtattatagcacatttaaagaaggctgtgccgtttttactgcgatttttcctgaaatgtcaataattagaggtgaattgtcctattgtcgtccaatctcttgctaaaataactctttataaaaggcaatcgtttcttctaaggttggcataaatggatttcctggtgcgcaggcatcaatcaaggcattcttagaaaggtattcaaagtcgaaatctttttcttcaataccaagttcagtcagtttcttaggaatacctactgtctcagaaagcttctcaatctcagcaatcgcataatcggcacattcttgatctgatttaccttctacatgaagtcccaaggctttggcaacattgcggaaagcttctggtacacgtttagcattttcacgttctataactggtagcaacatggcacagcacacgg

SEQ ID NO: 69 - DNA, 8898 bp; double-stranded, linear
gatctgaactttatcatcataacttaatttcataataaaaacaccccaaaagttagattttttctgtctaacttttggggtgtagttcagtcattggactgacgtttttttgtatgcttattttgatttgatgtagttgataccatctgcttttggtgcgactgcttttccaaagaaggctgctaagacaagaattgtcaaaacataaggtgcaatttgaagataaaccgctggcactccttgtaggaacggcaattgagaaccgataacagccaaactttgtgaaagtccaaagaagagactagaaagcatagcaccgattggattccatttcccaaagatcatcgcagcaagggcgataaatccaggtccaacaatagttgtcactgagaagttaactgagattgattgcgcataaatcgctccgccaattccacctagaaaacctgaaataataacccctaaatatctcatcttgtagacgttgattcccaaggtatccgctgcttgaggatgttcaccgacagagcggagacgaagaccaaattgagtcttaaagagaataaaccaagcaaggaatgagaaggcaatcgccagataaccaagtagactagttgacttgaagaagatatcaccaatcactgggatatttgccaagactgggaaatcaaagcgtccaaaagtttgacttaggttgtcggtttgtcctttgttataaagaactttaactaagaaaacagccaaggcaggcgccatcaagttcaataccgtaccgctgacaacatggtctgcacggaaatgaaccgtcgctgctgcgtggatgatagagaaaacactaccaaccaatcctgctacaagcaaggatagccatggagttgctgctccaaattgttctgcaaattcaaggttaaagacaactccagaaaaggcacccataaccataattccttcaaggccaacgtttaccacaccaccacgttcagagaaaacaccaccgatacttgtaaagatgagaggtgctgagtaaatcagcatagaagacaccaagagggggagcaaggttataatagacatctttacttacctcctttaacttgttttttcggtttgacaaagcgttcgataaggtaatgaacactgacaaagaagataatagacgctgttacaatgctgacaagctcagatggtacctgcgccgcattcataccaggagccccaacttggagaacgccaaataggaaggctgcaaagagtataccaattggtgagttggccgcaagcaaactaaccgccattccgttaaatccgatagctaatgacgaaccttgaacatagacgttctggaaggttcccaaaccttcaacagctccaccaagacctgccaaggcacctgaaataatcatagataggataatagtccgcttggcagaaataccagcatattctgaagcatgtggattaagaccaactgcacggatttcaaaaccaagagttgttttcttgagcatgaaccaaataactgcaacggcaatgatggcaaagaaaataccaatattcatccgtgagttaccagtcaactcagccaaccaaggtgtctgataggttgcattagccccaacacgaatggtcgaatctgtactttgcatgaagtctttagggaaagcatggataaaggcattccctacatacaagacaatgtagttcatcatgatggttacaataacctctgacgtccctagataggccctaagaatacctggaatcgctccgacaatcccaccagcaatcaaggcaatcacgatggttgctagaatcatcaagggacggggcatatctggatgcgacagggcaaaccaaccactgagaatccaacctgccaaagcctgaccaggaagtccgacgttaaagaaaccagctcgactggcaacggcaaaaccaagaccaatcaagaccagaggacccatagcacggaagatttctccaatcccacgcagactgccaaaggctgtatagaacaattcttcgtagccccaaatagcatcataaccgaagatccacatgacaatggctccgagtaaaattcctaggaatacagaaatcaagggaaccgaaatttgttgtaattttttagacatcactcttctcctttcccaagtttccaccagccatcaagacaccaagttcttgtttattggttgtttctggtgatacaataccttgaatcttaccatcgtggataacggcaatacggtctgagacgtttaaaatctcatccaattcaaagctgacaacaaggacagccttgccattatcacgctcttcaatcaagcgtttgtggatatactcaatggcaccgacatccaacccacgagttggctggctaacgataaggagatcaggatctcgatcaatttcacgagcaataattgctttttgttgatttcctcctgagagtgcagctgcaggaactaattcactggcagcgcgaacatcaaactcttccatcagctttttagcataagaagtaatatttgaataattcaaaattccatttttactatgtggttctttatagtaggtttgaagggcaatattttcagatatcatcatttccaaaatcaagccatcacggtgacggtcttctggaacgtgcccaacacttagttctgtaatctgacgtgggtgcaagcctacaattgaatctccttttagctcaatgctaccagattcaaccttacgaagacctgtaatggcttgaatcagttcagactgaccatttccatcaatccccgcaataccaacaatctctccagcacgaacatccaaggacagatttttaacagctggaacaccacggttttcattgaccaccaaatctttgatagacaaaaccacttcttttggtttagaggcttgcttctctgttttaaaggaaacagaacgtcctaccatcatttccgccaaatcagcattggtagcccctgcaatttcaacggtttcaattgatttcccacgacggataactgtaacacggtcagaaactgctcgaatttcatccaatttgtgggtaatcaagataattgattttccttctttgacaagatttttcataatagccatcaactcatcaatttctgatggagtcaaaacagccgttggttcgtcaaagataaggatatcagccccccgataaagtgtttttaaaatttctacacgttgttgggctccaactgagatatctgctaccttggcagaagggtcaacagctaagccataacgttcagaaagagccttgatttctttgctagctccagcgatatctagcacaccatttttagtcaattcactacctaaaatgatgttttcagccactgtgaaggcttcaaccaacataaagtgctggtgaaccatcccgattcccaagctagctgctttagatggggagtcgagattgacaacttgaccgttgaccgcgatttcaccactagttggttcaagaaggcctgctaacatgttcattagcgtggacttaccagccccattttctcctaaaagtgcatgaatttcaccttttcgtaggtgcaagttgattttgtcgttggcaacaaatccaccaaacaccttggtaatatcacgcatctcaatgacattttcgtgtgccatgtgctcttcctttcagagtcttattttatttcaataaaacttgctagtttgtctagtagcaagctttacttagacaaaatgactttgtctcaactcttaaaaaagcggcccttggccgcttcctaagaaatgacttccatccattatttttcaggaacttttacgcttccatcaaggattttagcttttgcatcttcgacagcttttttaccttcttctgaaaggtttgttactgccaagtcaacccctttatccttcaatgagtaaacgatcacttgaccgccagggaattctcctctttctgccttgttagaaatatcttttacagttgtaccaacttgtttcaaagtagatacaagaacaaagtttgattctttgccatctttagaagtgtatttaccttctgcttcttggtcacgatcaacaccgataacccaaactttttcattttcaggacggctttcgttgagagattttgcctctgcaaagacacctgcacctgtaccaccagctacttggtaaacaatatctgcaccggctgcgtattgtgcggctgcaattgttttacctttagccgcatcaccaaatgaaccagcgtagtcaacttggactttgatagatgggtctactgacgcaacaccagccttgaatcctgcttcaaaacgagagataacttcagattcgataccacctacaaaaccaacttgttttgtcttagttgtttttgctgcagccacacctgcaaggtaacctgactcattatcagcgaaagttacgctcgcaacattcttttggtctttaatcacatcatcaatcaagacatagttcaagtcagtgtgttcttttgctgcatctttaactgcattattaagggcaaaaccaacaccgaagattaggttgtaacttccagccgcttgttgcaagttgttagcgtagtcagcttcacttgttgattggaagtaagtgaaaccgttatcttttgaaagattgtgttctttaccccaagcctgcaaaccttcccaagctgattggttgaatgatttgtcatcaacaccaccagtatcagtgacgattgctgcttttgtcttcacatcagaagatgaagctgcgttacgagaagagcggttaccacatgcagcaagtccaactgctgccactgcaactaggccaagacctagccattgtttcttgttcattactgaacctcctaaataagatgtgcaacgatgttgcaagtatggattggttggccacaaggaccgtgccactcagagagcgactcagactagtttaagtctgtaaaagagtatggaagtaattccccgaccgtcatctcgaccgtcgatttatcttttgcgactaaggtcacttttagatcttgttcaaaaaattcagccatcacttggcgacaagcaccacatggcgagatcggtttttcagtttgaccatagacaatcaattctgaaaattctctttggccttcagatatagccttaaaaatagctgttctctcaccgcaattggtcaaaggatagctagcattttcaatattcactcccgtgtaaacacttccgtctttagctactaaaactgctccgataggaaagtgagaataggggacataggcatgtttgctggtttcaattgccagttcaatcaactcagtagtcgccatctgccaattctccttttaaaatagctaccccagctgacgttccgatacgggtcgcacctgcttcgacaaaggcaagagcatctgcataagaacgagctccaccggcggccttgacacccatatcagatccaactgtttcacgcattaatgtaacatctgctatcgtagcaccaccagttgaaaagccagtagatgttttgacaaagtcagccccagctttttgggccaattggcaaacaacaactttttcttggtctgtcagaaggcaagcttcaataatgactttcactaacttatcaccacttgcttccactactgcgcgaatatctgactcaaccaaggctaaattacctgatttgagagctccaacattgatcaccatatcaatctcatctgcaccattttggatagcttcttttgtctcaaatgctttcacggctgaagttgttgctcccaaagggaaacctactactgtgcaaaccttaacatctgtgccttcaagtccttttttagcatgttcaacccaggtcggattaacgcaaacactggcaaagtcatactctctagcctcagacaacaaactatcaatttgttttttctttgcatcttgttttaaaagcgtatgatctatatatttatttaatttcatttcggttttccctccatttaggagatgatttctacaatttcacggatttttttcacttcatcacttattttaacacatttttggaaatctgtaactagttgaggtggaattttttcatttgtgtatacttttgcaacaatttcacccttttgaacggagtctccaatcttcttttcaaaaacaattcctgtttcatagtccaaggcatcagacttaactgcacgaccagcacccagcctcatggcataaagaccaaagtccatagctggaagagctgaaatgacacccgtttcctgagcagggatttccaccacatgagctacatttacaggacgatagaggtcttccaagtctccaccttgggcttgcaccatttcctcaaacttagccagtgcttgaccattctcaagatgttggtgaacttcttcaacagttttgttaacatttgccaaaccaagcataatttgagccaattcacaaataaagtgggtaatatcctgacgtccttgaccttgcaaaatctccaatgcttcaaggatttccagacgatttccaatcgctcgtcccaaaggctggctcatatccgtaatcactgctactgtcttccgtccaacaaccttaccaagatctaccatagtttgagccaactcacgcgcctcatcaaccgtcttcatgaaggcaccctcaccgacagtcacgtctagcaaaatagcatccgcccctgccgcaattttcttgctcatcaccgaactcgcaatcaaaggaatcgtgtcgacagttgcggtcacatcacgaagggcatagagaagcttatctgctttgaccagctggtctgattgcccaatgacagatactccaatatcctgaacctgacgaataaaatcctcttgactacgttctacttgatagcccttaatggactccaatttatcaattgttccgcctgtatggccaagaccacgaccactcatttttgctacaggcacaccgaagctagcaacaagaggagctaaaatcaaggttaccttatcgccgacaccaccagtagaatgcttgtcaactttcacaccatcaatggctgacaggtcaaactcttgcccagtcttaaccatattcatcgttaaatcagagatttctcgagtcgtcattcctttaaaataaacagccatagcaaaggcagacatctgataatcaggaacagttcctgatacatagccttctatcagccattcaatttcacttgaagtcagttcttgaccgtctcgttttttttggattaaatcaactgctctcattctttcacacttctaaggatatagtatcccttgtcttttttaaggatttcacaattgccaaacacatcttccatcttagacttggcacttggagctccttgttttttctggatgacgatggtcaaatctccaccaatttccaagaaatctttacttttctcgatgatttcatgaacgacttgcttgcccgcacggataggaggattggaaatgacatggtcaaatcgcccttgaactcttgcataaatattagattgaaatatcgtcgcttttgcattatttttttcagcatttctctgagctaaatccagggcacgagtgttaatatcaaccatggtcgcctgaactccgtaaaccttgaccaaggacaaacctaatggaccataaccacagcctacatctaggactgtctctccttggttgacatccagacacttgagcaagagttgacttccaaagtcaaccattttcttgctaaaaacacccgcatctgtcaaaaaagtcattttttctcccaacaagtccactctcaactcatgaatgtcgtgagcagcgtcaggattttctgcatagtacattttactcatgacactattttaccataatttgactcaaattgtaaatcgtttacaaattgataataaaacgaaaaagaccgaagaaagcaagtcacgaagccattttcttcaatctctttcaacacttataaataataaaccatttagaactataaatatcacagtccagataaaaacaaaaagtttatcatctataatcaggcagattattatttctattgcttaaccttaaaatactttattatcaacaaaattcctaacaaaatgtttagataaaagcccaactgatacgtttatgtcaggatttccaaacttgtccaaagtcgtatcaaatcttctagtgacatgtggaagaaataaccctctgtcgcaatccgtaggactaaaaagcaataactacccgcagcaatccatttcgtccatcgttttttagtaagaaagcaattaagaacgaacaaataaagacagctgttacaatagcatgttccatcaaaaaagtaaaaccgtaataggtttccacaaagcatctaccattatctgcattggttccttttataaaaggtaaagcaaaacttaaaataaaacagagttccaatatgtaacgttttaagattttcatagtacacctcctataagttgtgaactaaaaagccccctttataagcttataaatcagtagaatctatctcctatttcatcaataaattgatcacttatactatataccattgacttaccacattcaagaaaccgctttatttttttagctttttatggtatgatagacaaaatatctaggggaaaacaaatgaccaacgaatttttacattttgaaaaaatcagccgccagacttggcaatctttacatcgaaagacaacacctcctttgacagaagaagaattggaatctatcaagagttttaatgaccaaatcagtctccaagacgttacagatatctatctccccttggctcatttgattcagatttacaagcgaactaaggaagatttagccttttcaaaaggaattttcctcca

SEQ ID NO: 70 - DNA, 13188 bp; double-stranded, linear
tatcttaacgaggattgggtttatcgtcagtcttattgccctaattgtgggaacaatcccttaaatcattttgaaaataatcggcctgtagcagatttttactgtaatcattgtagtgaggagtttgaactaaagagcaaaaaaggaaatttttcatcaacaatcaatgatggtgcttatgcaacgatgatgaagcgtgtgcaggcagataataatcctaatttcttttttttaacttacacaaaaaattttgaggtaaataactttcttgtccttccgaagcaatttgttacaccgaaatcgattattcaaagaaaaccacttgcaccaactgctagacgagcaggttggattggttgtaacattgatttatcacaagtaccttctaaaggaaggatatttcttgtgcaagatggacaagttagagatccagaaaaagttacaaaagaatttaagcaaggtttatttttaaggaagagctctctgtcatcaagaggttggacaatagaaattctaaattgtatagataagatagagggttcagaatttacccttgaagatatgtatcgttttgaaagtgacctaaaaaatatctttgttaagaacaatcatatcaaagaaaagattaggcaacagcttcaaatattaagagacaaagaaataatagaatttaaaggtagaggaaagtatcggaaattatgaaaacgaaacaacttgttgcatcagaagaggtgtatgatttcttaaaagtcatctggcctgattatgaaactgaaagccgttacgataacctaagtttaatcgtctgtaccttatcagatcccgattgtgtgagatggttatctgaaaatatgaaatttggtgacgaaaaacaactagctttgatgaaggaaaaatatgggtgggaagtaggagataaattgccagagtggctacatagctcctatcatagattattgttaataggtgaattattggaaagcaatctaaaactgaaaaagtatacagtagaaattacagaaactttatcacgtttagtaagtatagaggctgaaaatccagatgaagccgaacgacttgtaagagaaaagtataagagttgtgaaattgttcttgatgcagatgattttcaggactatgacactagcatatatgaataggtagatgtttttattttgtcaacaaaaaagaggctcgcacctctttttcttatttctttttatgatttaatacggcattgaggacaatagcgagtaggctggctacgacgattccgtttgagaagaacatttggaaggctgtcggcatgctgacaaagagattactgttgttgagaccgacacctgcagcgattgaaacagctgcgataaggaagttgtgttcattgttagcaaagtcaacacgggcgaggatttgcatcccttgaattgatacaaaaccaaacattaccagcatggcaccaccgaggacggagcttggaatgatttgggcaagggcgccaaacttaggaagcagtccaaggagaaccaggaaaccagctgcgtagtagattggcaggcgttttttgatgcctgacaatttaaccaaaccaacgttttgtgaaaatccggtgtaagggaaggtgttaaagattcctccgagaagtacggccaaaccttctgcgcggtatccgttgcgaaggcgcgtgctgtcgattggatcctttgtgatatcagacaaggccagataaacaccagttgactcaaccatagacaccgttgcgatgatacacatcatgacaatagatgagatttcaaaggttggcatcccaaagtagagtggagttgggacatggacaagtggagctaccgcaacaggagagaagtccaccaagcccatagtagcagcaatggcagttccaacaaccagaccaatcaaaatagagatagacttgataaatcctttggtaaagatgttgatcaagaggataatcagaacagtaatagctgcaagcaagagactttgaccagttggctctggaacgttatttcccatatttccaatagcgacagggatcaaggttaaaccaatcgtggtaataacagatcctgttacgatagatgggaagagattggctacttttgagaagatgcctgaaacaagaaccacgtaaatcccagatgcgataagggcaccaaacatagcgccactaccatggctttgcccaatcataatcaagggagcgaccgactggaatgcaactccaagaacgactgggagtccaatcccaaagtatttgttgagttggagttggaggaaggttgccaccccacacatgaagatatctgtagaaatcaggtaggtcaactgctcagctgaatagccaagggctgtcgcaatcatgatgggaaccaggatagatcctgagtacatggctagtaagtgctgcaagccaagaacggctgcttgcgagtgtttttcttgagtttgcattagagatctgcctccttaaatacgacttgaccattttcaaaacaatccaaacgagcaagtgataggacagggtagcctgctttttcaagcaaatcacgaccatcttggaaggatttctcaatcacgataccgatagcttggactgtggcaccggcctgttcgatgatttgaatcaagcctttagcagcttggccattagcaaggaaatcgtcgataatcaaaaccttgtcctctggtgagaggaatttttcagcgatagaaacggtgctggtcacctgcttggtaaaggagtagacttgagcagttaagatgccttcgttcatggtgatgttcttagcttttttggcgaaaatcatgggaacgtttaaggcttcagctgtaaaaacggctggggcaatacccgacgcttcaatggttacgaccttggtaatgccagtagtagcaaatttttccgcaaaaaccttaccaatctctcgcatcaagctaaagtcaacttggtgggttaaaaaggaatctaccttgaggatgttatcacccaagatatgcccatccttgaggatgcgctcttctaataatttcataagacctcctaaagtctaaaagttaatttacttgttgtttaaatatttctatagtgatcccttttgctaatactatatatttgataaaactattacgagcgaagcgagtcttatcaaatatttcccgttgtagtggtatcatagacaataatcttgttattgtctatgacgggatttttgagagtaaaatagttcggggaactattttagcctaagcctagaaatgaaagagctaggggctcaaaaattagggatgaaattccctggattcctgaaattattcacaggataatttcacctcccgtccgcactaattaagggaaatattaaaaaaagacctacttaatctctaagtaagtcccctaaatagacatggcaaaaacggccatatctcactgctgacttacttattgttaggtgttccggcaccttgtagaaacgtcgtgccaattcacgacataaacaagtaaaacgatattcaattttaaataggcttgagccaatgtttttattttacactaaataactttagaaatcaactattttgttagtgttttggtttaaaaaacgaacaaaaagaagagagggtgaacaaaaactccattgtaagctaacagttatactaaatgaaaatcaaagagcaaactaggaagctatccacaacctcaaaacactgttttgaggttgtggatagaattgacagagccagtatcatatacctacggtaaggcgacgttgacgtggcttgaagagattttcgaagagtattagaagatttttccatcataaaaggcatactatcaagcttttagacacctgacaatatgcctttttctaactttaaagacttttcccaatttttattattctactcgctaaatcttaaaaaatagccatctggatccaaaactgcaaatttatgaggatagatatagggatcactgacacgaaactttcttttggtcaagggacgataaataggatagtttgccttcatcactctttaatagagttttgaaacatcctttatgccaaaggagagattgactccacgaccaaagggataggtcagttcagctagttgatcctttgttccctcctctaacattagttgacactcttcaagagaaagagaaagttttcttctggacgttggtattcaatcctaaaacccagtaaaccacagtagaaggaccgggactgttcgatattcgatacaagcaactcgggaatgaccgcattgtagtccatatagaaaatccttacaagtcaatttccaagacaatcggtgtatggtcttggcgagcacctgagtcaatcatatcagatttagtgaccttgtcagcgatacggttacttgtgagccagtagtcgattctccagcctgtattgttgattttagaagttttgctgcgttgtgcccaccaagtgtagcgttcaggaacatcgccatgaacatggcggaaggtgtctgtaaatccagttgccaaaaggttggtaaatccagcacgttcctcgtcagtaaatccaggtgaacggcggttgctagcaggatttgcaaggtcgatttcattgtgggctacgttgtagtcaccggtcgcaaggactggtttttctttgtctagttcagccaaatactcagcatatttggcatcccagacttggcgttcttccaagcgtttgagaccgtcaccagcgtttggagtgtaaacttgggttacgaaaaatgcatcaaattctagagtgatgatacgaccttccaagtccatggtagaaggggcaccgatttctgggaagctgatagtaggtgtaagttctttcttataaaggaacatggttccagcatagcctttacgggcaggctcttgggaagagcgccacgtgttttcgtagcctgggaagagttcttctaaaatttccacgtgtttctttgtaggtcctttggcagaaagcttggtttcttggatagcaatgatatcagcattttcagcgaccaaggtttgtaggacttcttgggacaatttggcacgagctgagtcactagttagggcagcgtttagggaatcaatattccatgagataagtttcataaagttacctttttcattcagattatagattttattataccaaaaaaagatctatttccccaacgtatggtttgaaaaattactctctttcgtttataattaagaatgattttatgaaagggagtgaaaatacatgaaattctactcttatgactatgtactcagccaaatcggtcagcaaaatggtatcatggttggctttgggattgttctattagctgtgacagttttttttgctttcaaggcataccataataaaaagggaagcgaatttcgtgagttggtcatgatttcagatctggccttatttagctctgcttttggtcagcatcacgacttatcaaaacaatcaagtttctaacaataaatttcaaacttcacttcatttcatcgaggttgtttccaaagatttgtgagtagacaagtcagaagtctatgttaatacttccacaaacacagatggcgcacttatcaaggtgggagatcgctattatcgtgccctaaatggaagtgagccagacaagtacctgttagagaaagtcgaattgtataagacagacgcaattgaactggtggatgtgaacaaatgacacttaattatatcgaaattttaatcaaactggtcttgactctcaaatagctcaacaacaatgttcactttgtgaaacgtttgattgatggtaagccaactctccttatcaaaaatgggaatattgacccagaagcctgtcgttcagttggtttgtctgcatcggatgtatccctcaaacttcgtagccaagggattttccagatgaagcaagtcaaacgagctgtgcaagagcaaaatgggcaactcatcgttgtgcaaatgggagatgaaaatcctaagtatccagttgtgactgacggtgtgattcaagtagatgtcttggaatcgattggtcgtagcgaagagtggttgcttgataacctcagtaaacaagggcatgacaatgtagccaatatctttattgctgaatatgacaagggtgctgttacagtcgtaacttatgaataagaaaaacctggggtcttgtactcttcgaaaatctcttcaaaccgcgtcaacgtcgccttgccgtatgtaggttactgacttcgtcagttctatctacaacctcaaagcagtgctttgagcagcctgcggctagtttcctagtttgctctttgattttcattgagtattggcctcaggtttccatttgcaatcagaaagggattttatgtccattattcaaaaactttggtggtttttcaagttagaaaaacgccgttatctagtcggaattgtggccctgatcttggtttccgtcctcaatctcattcctcctatggttatggggcgggtcattgatgccatcacatcggggcaattaacccagcaggacctccttcttagcctattttacttgctacttgcagcctttggtatgtactatttgcgctatgtgtggcgtatgtatatccttgggacctcttattgcttgggacagatcatgcggtctcgcttgtttaagcatttcacaaaaatgtcgtcagccttttatcaaacctatcggacgggtgatctgatggcacacgcaaccaatgatatcaatgccttgactcgtttagcaggtggcggtgtcatgtctgcggtggatgcctctatcacggctctggtgactttgttgaccatgctctttagcatctcatggcagatgactcttgttgccattctccccctacctttcatggcctatacgactagtcgcctagggagaaagactcataaggcctttggcgaatcccaagctgctttttctgaactcaataacaaggtacaggagtccgtatcaggtatcaaagtgaccaagtctttcggttatcaggcagacgagttgaagtcttttcaggcagtcaatgaattaaccttccaaaagaacctgcaaaccatgaaatatgatagtctctttgaccctatggttctcttgtttgttggttcgtcctatgttttaacgcttttggttggctccttgatggttcaggaagggcagattacagttgggaatctagtcacctttatcagctatttggatatgctggtctggcctcttctggccatcggtttcctctttaatactactcagcgagggaaggtttcttaccagcggattgaaaatcttttgtctcaggaatctcctgtacaagaccctgagtttcctctggatggtattgaaaatgggcgtttggagtatgccattgacagctttgcttttgaaaatgaggaaacactgacggatattcactttagtttggcaaaagggcaaacactgggcttggttgggcagacaggctctgggaaaacgtccttaatcaagctcctcttgcgtgaatacgatgtggataagggtgccatttatctaaacggtcacgatattcgggactatcgtctgacagaccttcgcagtctcatgggctatgttcctcaggaccagtttctttttgcgacttcaatcctagacaatatccgctttggcaatcctaacttgcccctttcagcggtcgaggaagctactaagctagcccgggtttaccaagatattgtagacatgcctcaaggatttgatacgctgattggtgaaaaaggagtcagtctttctggtggtcaaaagcaacggttggctatgagtcgggctatgattttagaccctgatatcttgattttggatgattccttatccgccgtagatgccaagacagagtatgcgattatcgacaacctcaaggagatgcgaaaggacaagacaaccattatcactgcccatcgcctcagtgctgttgtccatgcagattttattttagttctacaaaatggtcaaattatcgaacgaggcacgcacgaagacttgctagctttggatggctggtatgcccaaacctaccagtctcagcagttggaaatgaaaggagaagaagatgcagaataaacaagaacaatggactgtattgaagcgcttgatgtcttatctcaagccttatggactcctgacctttttggcactcagttttctcctagcgacgacggtcattaaaagtgtcatacccctcgtggcttcccactttatcgaccagtatctcagcaatcttaaccaactagccgttaccgttttgctggtctactatggtctctacatcctacaaactgtagttcagtatgtcggcaatcttctctttgcgcgcgtgtcttacagtattgttagggatattcgtcgggatgcctttgccaatatggagaaactgggcatgtcttactttgacaagacgccagcaggttctatcgtttctcgtttgaccaacgataccgagacgattagtgatatgttttctgggattttatccagctttatctcagcagtttttatctttctgacaaccctttataccatgttggtgctggattttcgtttgacggctttagtcttgctctttcttcctttgattttccttttggtcaatctctatcgaaaaaagtcagtgaaaatcatcgagaaaaccagaagtctcttgtcagatatcaatagtaagctggcagagaatatcgagggaatcaggattattcaggcctttaatcaagagaagcgcctgcaggcagaatttgatgaaatcaaccaagaacacttggtctacgccaaccgttctgtagccttggatgccctctttttgagacctgccatgagtttgctgaaacttctaggctatgcagtcttgatggcctactttggctaccgtggtttttctatcgggataacggtcgggaccatgtatgcctttatccagtacatcaaccgcctttttgaccccttgattgaggtgacgcaaaacttttcaactctgcaaacggctatggtttctgcaggtcgtgtctttgccctgatagacgagaggacctatgaacctcttcaagaaaatgggcaagccaaagtccaagaaggcaatatccgttttgaacatgtgtgtttctcatatgacggtaaacatccgattctggatgacatttctttctctgttaataagggtgaaaccattgcctttgtaggtcatacaggttcagggaaatcgtctattatcaatgtcctcatgcgcttttatgaattccagtcagggagagttctcttggatgatgtggatatcagggatttcagtcaagaagagctgagaaaaaacatcggtttggtcttgcaggaacccttcctctatcatggaactattaagtccaatatcgccatgtaccaagaaaccagtgatgagcaggttcaggctgcggcagcctttgtggatgcagattcctttattcaagaacttcctcaggggtacgactcccctgtttccgagcgtggttcgagcttctctactgggcaacgccagcttcttgcctttgctagaacagtcgccagccagcctaaaatcctgattttggatgaagcgacagccaatattgactctgaaacagaaagcttggttcaagcttctctggcgaagatgagacagggccgaacaactattgctatcgctcaccgcctttctactattcaagatgccaactgcatctatgtcttggataagggacgcattatcgagagtggaacccatgaggaactcttggctctgggaggaacctatcacaagatgtatagtttgcaggcaggggccatggccgatactctttgaaaatctctttaaaccatgtcagctttatctgcaatctcaaagctgtactttgattttcattgagtactagaaggaaatccttcaaattacagatttctttcaccgccttttccattttgtggtataatgaaaaatgttgacaaatagtataataaaaacaaaggagaacagcatgctgaaatgggaagacttgcctgtggaaatgaaatcaagcgaggttgagtcttactaccagcttgtctctaaaaggaagggttcgctgattttcaagcgttgcttggactgggttttggccttggtcttactggttctgacctctcccatctttctcatcttgagcatttggatcaagttggatagcaaagggccagtgatttacaagcaagagcgtgtgacccagtacaaccgtcggttcaagatttggaagtttcgtaccatggtgacggatgcggataaaaaaggaagtctggtgacttctgctaacgatagccgcattaccaaggttggaaatttcatccgacgtgtccgtttggacgaactgcctcagttggtcaatgtccttaaaggtgagatgtcctttgtcggtacacgacctgaagtgccacgttatacagagcagtatagccctgaaatgatggcaaccttgctcttgcaagcagggattacctctccagccagcatcaactacaaggatgaggacacaattatcagtcaaatgacggagaaaggtctgtcagttgatcaggcctatgtggagcatgttcttcctgaaaagatgcgctataacctcgcctatctccgagagtttagtttctttggggacatcaaaatcatgtttcaaaccgtgtttgaggtactaaaataaagtagtcataagaaaatgagtacagataaaaggagcaaatcaatgccaaattacaatattccattttcaccgcctgatatcacagaagcagaaattactgaagtagtggataccctgcgttctggttggatcacaacaggtcctaaaacaaaagaactggagcgccgcttgtctctttacacacagacacctaagactgtttgtctcaactctgcgacagccgctctggagttgattttacgcgttttggaagtgggacctggtgatgaagtcatcgttccagccatgacctatacggcttcatgtagtgtcattacgcacgtgggagcaacccctgtcatggtggatatccaagcagatacgtttgagatggactatgacctgcttgagcaagctatcactgagaaaactaaggtgattattccagtagagctcgcagggattgtttgcgattatgaccgtttgttccaagtcgtggagaaaaaacgtgacttctttaccgcttcaagcaagtggcaaaaggcctttaaccgtattgtcattgtctctgatagtgcccacgctttgggatctatttataaaggacaaccttctggttctatcgctgactttacttccttctcattccatgcagttaagaactttacaacggcagaaggtggaagtgcgacttggaaagccaatccagtgattgatgacgaagagatgtacaaggaattccaaatcctttcccttcacgggcaaactaaggatgctcttgccaagatgcaactggggtcatgggaatacgatatcgttacaccagcctataagtgcaacatgaccgatatcatggcttcacttggtttggtacaattggaccgctatccaagtttgttgcaacgccgtaaggacattgtggaccgctatgatagtggttttgcaggttctcgcatccatcctttggcacacaagactgaaactgtcgaatcttcacgccacctctacatcacccgtgtagaaggagcaagcctagaagaacgcaacctcatcatccaagaattggctaaagcaggaattgcaagtaatgttcactacaaaccgcttcctctcttgacagcctataagaatcttggatttgatatgacgaactatcctaaggcctatgccttctttgagaatgaaattaccctccctcttcatactaaattaagcgatgaagaagtagactatatcattgagactttcaaaacagtttctgaaaaagtgctaactttatcaaaaaaatgacaaactacagtcaagcgaaagtgatcctgcccctaaaaagtctaattgagtgtaaaaactgttgttttcaattgataatagtttacacctgtagttgaggcccctttctcctcagagagagaatttttataggattttcctttcttgtgggagtcccgtggtttgaaataagatgtgagcaatttagtgtagcatttagaatccttactagacatcatttagaaaatctagtgtcttgttctagttttcaattcaccctattttttgaaagacgtgagtttccatgagtgagattgtggaaactcgcgtctttttttgttttcagaatattgttcaaaattttgtgcctgtctttcatgttctagtcattcttttgcatgatagaatttatagcatgttgatattataataatacaaatattctatatgtttagtgatgcttgctatacattattagatctcctgcgagacaatctataaaacacttgtctacgattacctatatgccctattccagtattttagaagcactgcatctatttttatcgaggttaaatctagcttttatagaaggtctatttaagaaatatattgtagtgttttagtttcaatccgccatatgagcgatattcaggtaaatatccctggcgaatgcttgtatgacaaggtatttgttctttcatttataatttacaacatatcaacaaatttaaatatagtaaatgggatattttatattcaagctaagaaagatagcatcacttttgaatggaaggctaaagagcaaactaggaagttggccatagatagctcaaaaccctgctttgaggttgtagatatagtaaaatgaaatgagaataggacaaattgatcgggacagtcaaatcgatttctaacaatgttttagaagtagaggtgtactattttagtttcagtctactatagaactgaccaagtcagtaacctagacttagggcaaggcggcactgacctagtttgaagagatttccgaagagtataaattttaatattttcttgtgttattccttgacaattcaatttggaaaatatatgataaagataatgacagcggtgtcattctatctattttaagaaaagtaataatcaattgttaaaaatagtaaaaaaattggaggttctgatgaaatattttgttccg

SEQ ID NO: 71 - DNA, 32768 bp; double-stranded, linear
aacgagtgcatcagtctcagcaagcaccagtgcgtcggcctcagcaagcaccagcgcgtctgaatccgcatcaaccagtgcctcagcttcagcaagtacctcagcatctgaatcagcatcaacaagtgcatcggcttcagcaagcacaagtgcttcagcctcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcggcctcaaccagtgcatctgaatcggcatcaaccagtgcgtcagcctcagcaagtactagcgcctcagcctcagcatcaacgagtgcgtccgcttcagcaagtactagtgcatcagcatcagcatcaacgagtgcatcggcttcagcaagtaccagcgcctcagcttcagcaagcaccagtgcgtcagcctcagcaagtaccagcgcctcagcctcagcaagcaccagtgcctcagcttcagcaagtaccagtgcgtcagcctcagcgtcgacaagtgcgtcggcttcagcaagtacctcagcgtctgaatcagcatcaacgagtgcatcagcttcagcatcaacaagtgcttcagcttcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcggcctcaaccagtgcatctgaatcggcatcaaccagtgcgtcagcctcagcaagtactagcgcctcagcctcagcatcaacgagtgcgtccgcttcagcaagtactagtgcatcagcatcagcatcaacgagtgcatcggcttcagcaagtaccagcgcctcagcttcagcaagcaccagtgcgtcagnctcagcaagtaccagcgcctcagcctcagcaagcaccagtgcctcagcttcagcaagtaccagtgcgtcagcctcagcgtcgacaagtgcgtcggcttcagcaagtacctcagcgtctgaatcagcatcaacgagtgcatcagcttcagcatcaacaagtgcttcagcttcagcaagtaccagtgcgtcggcttcagcatcaacgagtgcttcagtctcagcgtcaaccagtgcctctgaatcagcatcaacaagtgcctcggcttcagcaagcaccagtgcgtcggcttcagcaagtactagtgcatcggcttcagcatcgacaagtgcgtctgaatcggcatcaacgagtgcttcggcttcagcatcaacgagtgcgtcagcctcagcaagcacatcagcttctgaatctgcatcaaccagtgcgtccgcttcagcgtcaaccagtgcgtcggcttcagcgtcgacaagtgcttcggcttcagcatcaacgagtgcgtcggcctcagcaagcgcaagtacctcagcgtcagcttccgcctcaaccagtgcgtcggcttcagcaagcacaagtgcgtcagcctcagcaagtatctcagcgtctgaatcggcatcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcaaccagtgcttcggcttcagcaagtaccagtgcttcagcttcagcatcaaccagcgcctcggcctcagcaagcacctcagcttctgaatcggcctcaaccagcgcctcggcctcagcaagcacctcagcttctgaatcggcctcaaccagcgcctcagcctcagcatcaacgagtgcttcggcttcagcaagcacaagcgcctcgggttcagcatcaacgagtacgtcagcttcagcgtcaaccagtgcttcagcctcagcatcaacaagtgcgtcagcctcagcaagtatctcagcgtctgaatcggcatcaacgagtgcgtctgagtcagcatcaacgagtacgtcagcctcagcaagcacctcagcttctgaatcggcctcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcgacaagcgcctcagcttcagcaagtaccagtgcgtcagcctcagcgtcgacaagtgcgtcagcctcagcaagtactagtgcatcagcttcagcatcaacgagtgcatcggcttcggcgtcaaccagtgcatcagagtcagcaagtaccagtgcgtcagcttccgcatcaacaagtgcctcggcttcagcaagcaccagtgcgtcggcttcagcaagtactagcgcctcagcctcagcctcaaccagtgcgtcagcctcagcaagtatctcagcgtctgaatcggcatcaacgagtgcgtccgcttcagcaagtactagcgcctcagcctcagcgtcaacaagtgcatcggcttcagcgtcaacgagtgcgtctgaatcggcatcaacgagtgcgtccgcttcagcaagtactagcgcctcagcctcagcgtcaacaagtgcatcggcttcagcatcaacgagtgcgtccgcttcagcaagtactagcgcctcagcctcagcgtcaacaagtgcatcggcttcagcgtcaacgagtgcgtctgagtcagcatcaacgagtgcgtcagcctcagcaagcacatcagcttctgaatctgcatcaaccagtgcgtcagcctcagcatcgacaagcgcctcagcttcagcaagtaccagtgcgtcagcctcagcgtcgacaagtgcgtcggcttcagcaagtaccagtgcgtcagcctcagcaagtaccagtgcgtcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcatcagagtcagcaagtaccagtgcgtcagcttccgcatcaacaagtgcctcggcttcagcaagtactagcgcctcagcctcagcgtcaacaagtgcttcagcttccgcgtcaaccagcgcctcggcctcagcaagtatctcagcgtctgaatcggcatcaacaagtgcctcggcttcagcatcaacgagtgcatcagtctcagcaagcaccagtgcgtcggcctcagcaagcaccagcgcgtctgaatccgcatcaaccagtgcctcagcttcagcaagtacctcagcatctgaatcagcatcaacaagtgcctcggcttcagcaagcacaagtgcttcagcctcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcggcctcaaccagtgcatctgaatcggcatcaaccagtgcgtcagcctcagcaagtactagcgcctcagcctcagcatcaacgagtgcgtccgcttcagcaagtactagtgcatcagcttcagcaagtactagcgcctcagcctcagcgtcgacaagcgcctcagcttcagcaagtaccagtgcgtcagcctcagcgtcgacaagtgcgtcggcttcagcaagtacctcagcgtctgaatcagcatcaacaagtgcgtcggcttcagcatcaacgagtgcatcagcttcagcatcaacaagtgcttcagcttcagcaagtaccagtgcgtcggcttcagcatcaacgagtgcttcagtctcagcgtcaaccagtgcctctgaatccgcatcaacaagtgcctcggcttcagcaagcaccagtgcttcggcttcagcgtcaacgagtgcgtctgagtcagcatcaacgagtgcgtcagcctcagcaagcacatcagcttctgaatctgcatcaaccagtgcgtcagcttccgcatcaacaagcgcctcggcctcagcaagtacaagtgcttcagcctcagcatcaaccagtgcatcagcttcagcctcaacaagtgcttcagcctcagcgtcaaccagtgcctcggcttcagcaagtaccagtgcgtcagcttcagcaagcacaagtgcgtcagcttcagcatcaaccagtgcttcggcttcggcatcaacaagtgcctcagcatcagcatcaacgagtgcgtcagcctcagcaagtactagtgcatcagcatcagcatcaaccagtgcatcagcctcagcaagtatctcagcgtctgaatcggcatcaacgagtgcatcagcatcagcatcaacgagtgcatcggcttcagcgtcaaccagtgcatcagtctcagcaagcaccagtgcgtcggcttcagcatcaacgagtgcctcagcctcagcaagtatctcagcgtctgaatcggcatcaacgagtgcgtcagcctcagcaagtactagtgcatcggcttcagcaagcaccagtgcgtcggcttcagcatcaaccagtgcctcagcctcagcaagtatctcagcgtctgaatcggcatcaacgagtgcgtcagcctcagcaagtactagtgcatcagcmtcagcatcaacgagtgcatcggcttcagcaagtaccagcgcctcagcttcagcaagcaccagtgcgtcagcctcagcaagtaccagcgcctcagcctcagcaagcaccagtgcctcagcttcagcaagtaccagtgcgtcagctcagcatcaacaagtgcttcagcttcggcctcaacaagtgcgtcagcttcagcatcaacgagtgcgtcggcttcagcaagcaccagtgcctcggcctcagcaagcaccagtgcttcagcttcagcatcaacaagtgcgtcagcttcagcaagtacatcagtttcaaattcagcaaaccattcgaactcacaagttggaaatacttctggatcgacaggtaaatcccaaaaagaattgcctaatacaggtactgagtcgtcaattggatctgtgttacttggagttctagcagctgttacaggtattggattggttgcgaaacgccgtaaacgtgatgaagaagagtaagacaacctgtaaagttaggctaaactaactcgcgcacataaatcaaggagaaaattgctagtggatgataaaataacagtcattgtaccagtatacaatgtggaaaactatctgaggaagtgcctagatagtattattactcaaacatataaaaatattgagattgttgtcgttaatgatggttctacggatgcttcaggtgaaatttgtaaagaattttcagaaatggatcaccgaattctctatatagaacaagaaaatgctggtctttctgccgcacgaaacaccggtctgaataatatgtccggaaattatgtgacctttgtggactcggatgattggattgagcaagattatgtagaaactctatataaaaaaatagtagagtatcaggctgatattgcagttggtaattattattctttcaacgaaagtgaaggaatgttctactttcatatattgggagactcctattatgagaaagtatatgataatgtttctatctttgagaacttgtatgaaactcaagaaatgaagagttttgctttgatatctgcttggggtaaactctataaggcaagattgtttgagcagttgcgctttgacataggtaaattaggagaagatggttacctcaatcaaaaggtatatttattatcagaaaaggtaatttatttaaataaaagtctttatgcttatcggattagaaaaggtagtttatcaagagtttggacagaaaagtggatgcacgctttagttgatgctatgtctgaacgtattacgctactagctaatatgggttatcctctagagaaacacttggcagtttatcgtcagatgttggaagtcagtctcgccaacggtcaagctagtggtttatctgacacagcaacgtataaagagtttgaaatgaaacaaaggcttttaaatcagctatcgagacaagaggaaagtgaaaagaaagccattgtcctcgcagcaaactatggctatgtagaccaagttttaacgacaatcaagtctatttgttatcataatcgttcgattcgtttttatctgattcatagcgattttccaaatgaatggattaagcaattaaataagcgcttagagaagtttgactcagaaattattaattgtcgggtaacttctgagcaaatttcatgttataaatcggatattagttacacagtctttttacgctatttcatagctgatttcgtgcaagaagacaaggccctctacttggactgtgatctagttgtaacgaaaaatctggatgacttgtttgctacagacttacaagattatcctttggctgctgttagagattttgggggcagagcttattttggtcaagaaatctttaatgccggtgttctcttggtaaacaatgctttttggaaaaaagagaatatgacccaaaaattaattgatgtaaccaatgaatggcatgataaggtggatcaggcagatcagagcatcttgaatatgctttttgaacataaatggttggaattggactttgattataatcatattgtcattcataaacagtttgctgattatcaattgcctgagggtcaggattatcctgctattattcactatctttctcatcggaaaccgtggaaagatttggcggcccaaacctatcgtgaagtttggtggtactatcatgggcttgaatggacagaattgggacaaaaccatcatttacatccattacaaagatctcacatctatccaataaaggaacctttcacttgtctaatctatactgcctcagaccatattgaacaaattgagacattggttcaatccttgcctgatattcagtttaagatagcagctagagtaatagttagtgatcgattggctcagatgacaatttatccaaacgtgactatatttaacggaattcactatttggtagatgtcgataatgaattggtagaaaccagtcaagtacttttagatattaatcatggcgaaaagacagaagaaattctcgatcaatttgctaatcttggcaagcctatcttatcctttgaaaatactaaaacctatgaagtaggtcaggaggcatatgctgttgaccaagttcaagcaatgattgaaaaattgagagaaataagcaaatgaagaaaaatcatttagtaggagatgctctgattttgacggttagtgatcagattgaagagttggattattttttataaaatttctccgttcatcatatatgaaagttgttcaaacatcagagtgctttataaaatataaatagacctaaagatatttaatatgaactgcaccccaaaagttagacagaaaaaatctaactttttggsgtcagtacaatattagggtgtgattaattatctttttaggtgaaaatgattctatattatagctgtttgatacgaaatttattataaggaaattatgttaatgaatacaaaatctatagtttttaatgcagataatgattatgtagataaattagaaactgcaattaaatctatttgttgttataataattgtttaaaattttatgtatttaatgatgatattgcgtcagagtggtttttgatgatgaataagcgattgaagactatacaatctgaaatcgttaatgtaaagattgtagatcatgttcttaaaaagtttcatttaccgttaaagaatttaagttatgccactttctttcgttattttatacctaattttgtcaaagaaagtcgtgctttatacctagattctgacatcattgttacaggaagtttagactatttatttgatatagaactagatggttatgccttggcagcagtagaagattcttttggtgatgttccttctaccaattttaactccggaatgttattagttaatgtagatacttggagagatgaagatgcttgttcgaaactgttagaactgaccaatcaatatcatgaaacagcatatggagatcaaggaattttaaatatgttattccatgatagatggaaaagattagaccgaaattttaattttatggtggggatggatagcgtcgcacacatagaaggaaatcataaatggtatgagatttctgagttgaaaaatggagatttacctagtgttatacattatactggggtaaaaccttgggaaataatttccaataatcgctttagagaagtttggtggttttataatctgttagaatggtctgatattttattgagaaaagacattattagtcgtagtttcgaagaacttgtatacagtcctaaagctcatacagcaatttttacagctagttgtgagatggagcatgtagaatatttgatagaaaatttaccagaggtacatttttctatactagcacatacatattttgcgtctagtgtcgttgctttattaagatatagcaatgttacgatttatccttgtttttctccatttgattatcgaaaaattttggataatttagatttttatttagatattaatcattataaagaagtggataatattgtatccgttgttcaacaactatctaaaccaatttttacctttgaaaatactagtcatgatataggcaatcaaactaatatattttcttcaaccgaaccaaacaaaatggtagaggctattagacaatttataggagaataagtttatggcagacgaactaattagtattgtagttccaatctacaacgttgagaattatttgcgaatgtgtttggatagcattcagaatcagacgtatcaaaattttgagtgtttattaatcaatgatggctctccagatcattcatccaaaatatgtgaagaatttgtagagaaagattctcgtttcaaatattttgagaaagcaaacggcggtctttcatcagctcgtaacctaggtattgaatgttcgggggggggcgtacattacttttgtagactctgatgattggttggaacatgatgctttagaccgattatatggtgctttgaaaaaggaaaacgcagatattagtatcgggcgttataattcttatgatgaaacacgctatgtgtatatgacttatgttacggatccagatgattctctagaagtgatagaaggtaaagcaattatggatagggaaggtgtcgaagaagtcagaaatgggaactggactgtagctgtcttgaagttattcaagagagagttactacaagatttaccatttcctataggaaaaattgcagaggatacttactggacatggaaggtacttctaagagcttcgaggatagtctatttgaatcgttgtgtttactggtaccgtgttggtttatctgatactttatcgaatacatggagtgaaaagcgtatgtatgatgaaattggggctagggaagaaaagatagctattttagcaagttcagactatgacttgaccaatcatattttgatttataaaaatagattacaaagagtgatagcaaaattagaagaacaaaatatgcagttcacagagatttacagaagaatgatggaaaaattgtctttacttccgtagatagtaataaaaaatgagatagcgtaatatgaaactacatttaacaaatttatacggcatggctggtgatagtacggttatcttagctcaaaatgctgttcaaaagatagctagtcaactgggatttagagaggttggtatttatttttacaacattgcttcagatagtccttctgaaatgaataagcgtctggatggtattatggccagtatctctattggggatattttagtctttcagtctccaacctggaatggttttgaatttgatcgtctcttgtttgataagctaaaggatatgcaggtgaaaattatttgctttatccatgatgttgttcccctcatgtttgatagtaactattatctcatgaaagattatctgtatatgtataatctatcagatgttttgatagtgccgtcagagagaatgaaaacacgcctgatggaagaaggattgacgactaagaagattcttgttcaagggatgtgggatcatcctcatgatttatccttatacacccctgcttttaaaaaagaacttttttttgctggaagtttagagcgttttccagacttacaaaattggtctcaagatacgcctttgagagtattttcaaataaaggggaagctagttctagtgctagaagtctcagcatcgaaggatggaaaaaagatgaggaattgttgctagaattatcaaagggtggatttggccttgtctggggaacccatcaaaatgagggagaaagtaaccaatactataccttgaatatatctcataaggtgagtacctatctaacagcgggcattccagtcattgtaccaagtagcttgtcaactgctaaatttatagtagatcaaggcttgggctttatggcggatagtctggaagaggttcatgagatagttgataaaatgaatctacaagaatatcaagaaatgacgaatcgtatcaagacctttagctatttgttaaaagagggctatttcactaaaaagttattggtagatgcaatctatcacttgggaattgattaagggaatgaaatgaacaaaacaattgtactagcaggggatcgcaattacaccaggcagttagaaacaacgataaaatctattttataccacaatcgagatgttaagatttatattttgaatcaagatatcatgccagattggtttcgcaaaccacgaaaaatagctcgcatgttaggtagtgagattatcgatgttaaactacctgaacaaactgtgtttcaagattgggaaaagcaagatcacattagtagcattacttatgctagatattttattgcagattatatccaagaagataaggttttatatttagacagtgatttgattgtaaatacttctttagagaaattatttagtatttgtttagaagaaaaatcactcgcagcagttaaagatacagatggaattacatttaatgcaggtgttttattaatcaacaataaaaaatggcgtcaagagaaattaaaagaacgactaattgaacagagcattgttacaatgaaggaagttgaagaaggccgtttcgagcattttaatggtgatcaaacgatttttaatcaggtcttgcaagatgattggttagaactaggtcgagcttataatttacaagtagggcatgatattgtggctttgtataacaattggcaggaacatctggcttttaatgataaaccagtggtgattcattttacgacctacagaaaaccctggactaccttgacagccaatcgttatcgtgatttatggtgggaattccatgatttggagtggagtcagattttacaacaccatatgggagaatttgaactaatatcgcctctagataaggaattttcttgcttaaccttaacgaattcccaagatttagaaggaatagaagagctagttacagctctacctgaggtggtatttcatatcgcagcttggacggatatgggagataaattaaaaaaattagctgtatataataatgtgagattgcatccacaaattgttccaccggtcttagataagctgaaaaagtcaacaaatctatatttggatatcaatcatggtagtgcagatgagaactttttaaaatctttgcaagaacaagaaaaaacgctactagcttttcaatcgactcagcacggagagttaggacaaatcgttttcgaaaatgggaaagtttcctttatgattgatacgattaaagattttaagaaaaacggacatcttacctgttttcgacaacttccaagtttaacttgtttaacgtttacggcttctcagtatatcgaacaattggattacttggctggacagttgccaaatgttgtttttcaaattgctgcttggacagctatggggccaaaattatatgatttgtctaatcgttatcctaatattcagctctatccggcaatttctagagataagctagacgagttgaaggagaagatggatgcttatttagatatcaacctactgacttcaacatccgatatcgttgcagaaatggctcatctatctaaacctatactagccttttataaatctcaaaatgggaataatggccaaaggttgtattcaagtgaacatcctgaacgaatgttggctgatttgcaaaaattgataactaaggatatgctagaaaaaccgcttgatataatccaggtgaaagggatagatgaaaccttggattatattattgaacacaactcttctttagttcgttttggagatggggaaatcaatatgcttgcagggcattcaattccctaccaggattatgatgaagagttggtttcaatcatgagggacattatcggccaagaaagtcgagaagatttagtagtgtgccttcctgatgcttttacagatcgttttaggtttacatcgtgggcgattccattttggaaagatcacatggatcattatatggatttttacagagagttatgcagtgattcatggtatggctcaacctttgtatctcgcccttatatcgattttgaagacaagagtcaagctaaagctcaatttgaaaaattgaaaagcatttgggaaaaccgtgacttactgatagtcgaaggtgcgacttctcgttcaggtgtcggaaatgatttattcgatgaggcaaattctattaagcgaattatctgtccttctcatagtgccttttctagagttcatgaacttgaacaagaaattgaaaagtatgctggtggtcgcttgattttatgtatgcttggacctacagcaaaagttctgagttataatctatgccagatgggctatcaagttttggatgtaggccatattgactcagagtatgaatggatgaaaatgggagctaaaactaaggttaaattttctcataaacatactgcagaacataatttcgaccaagatattgaatttattgatgatgaaacctataacagtcagattgttgcacgaatattaaactagactatttaaaataaatgataaggatttaaaatgagaaataccaaacgcgctgtagtatttgcaggtgattacgcttatattcgacaaatcgaaacggcgatgaagtcactctgtagacacaatagtcatttgaaaatttatctgctaaatcaggacattcctcaggaatggtttagtcaaataagaatatatttacaagagatggggggcgacttgattgactgcaagttaattggctcacagtttcaaatgaattggtctaataaattacctcatatcaatcatatgacatttgcacgctattttattccagattttgtaacagaagataaagttctctatctagatagtgatttgattgtgactggtgatttgaccgatttgtttgaattagacttaggtgaaaattatttggcagcagctcgttcttgctttggagcaggagtcggcttcaatgctggtgttctcttgattaacaacaaaaaatggggatctgaaactattcgacaaaaattgattgacttaacagaaaaagaacatgagaatgtggaagaaggagaccagtcaattttgaatatgttgtttaaagatcaatatagttcccttgaagatcaatataattttcaaataggatatgattatggggcggcaacctttaaacatcaattcatttttgatattccgctcgaaccactgccactaattttacactatatttctcaggataagccttggaatcaattttctgttggacgtctaagagaagtttggtgggaatactctttgatggattggtctgttattttaaatgaatggttttcaaagagtgtgaagtaccctagtaaatcacaaatatttaagttgcaatgtgttaatttaacgaattcttggtgtgtcgagaaaatcgattatttggcggagcaattgccagaagttcattttcatattgttgcttatacaaatatggcaaatgaactactagctttaacgcgttttcctaatgttaccgtatatccaaattccttaccaatgttattggaacaaatagtaatagcttcagatttgtatttggatttgaatcatgatcgaaaattagaagatgcatatgagtttgtgcttaagtacaaaaaaccaatgatagctttcgacaatacttgctctgaaaatctttctgagatttcatatgaaggtatctatccaagctccattccgaaaaaaatggttgcagcaatcagatcttacatgaggtagagaacagtatgagaaaatcaatagtattagcggcagataatgcctatcttattcctttagagacgactataaagtctgtattgtatcacaatagagatgttgatttttatattctcaacagtgatatagctcctgaatggtttaaattattggggagaaaaatggaagttgtgaattctacaattcgcagtgtacacattgataaagaactttttgaaagctataaaacaggacctcatataaattatgcttcttactttagattttttgcgacagaagtggttgaatctgatagggtattgtatctggattccgatatcattgtaactggggaactagctactttgtttgagatagatctcaaaggatattcaattggtgctgttgatgatgtctatgcctatgaaggacgaaaatctggatttaatactggtatgttactaatggatgttgcaaagtggaaagaacattctattgtcaatagtttattggaattagcggccgagcagaatcaagttgttcatcttggggatcagagtattttaaatatttattttgaggataattggctagccttagataaaacatataattatatggtgggtattgatatttatcaccttgctcaagaatgtgaacgtctagatgacaatccacctacaattgttcactatgctagtcatgataaaccttggaatacatatagtatatctagactacgtgaattatggtgggtttatagagatttggattggtcagagattgcttttcaacgttccgatttaaattattttgaaagaagcaatcagtctaaaaaacaagtgatgcttgtgacatggagtgcagatataaaacatttagagtatttagtacaacggttacctgattggcattttcatttggctgcaccgtgtgattgttctgaggagctgacctctctatcacagtatacgaatgtaacagtatatcaaaatgtattacatagtagaattgattggctattggacgattctatagtttatttagatattaatacaggtggagaggtttttaatgtagttacaagggcacaagaaagtggcaagaaaatcttcgcttttgatatcacacgtaaaagtatggatgatggactctatgacggtattttttctgtggagagaccagatgatttagtggatagaatgaagaatatagagatagagtaatgagtgaattaattagtgttgtggtaccgatatacaatacgggaaaatatttagtggagtgtgtcgagcatattctgaagcaaacctatcaaaatatagaaattattttagttgatgacggttctacggataattctggggaaatttgtgatgcttttatgatgcaagataatcgtgtgcgagtattgcatcaagaaaataaggggggggcagcacaagctaaaaatatggggattagtgtagctaagggagagtacatcacgattgttgattcagatgatatcgtaaaagaaaatatgattgaaactctttatcagcaagtccaagaaaaggatgcagatgttgttatagggaattactataattatgacgaaagtgacgggaatttttatttttatgtaacagggcaagatttttgcgtcgaagaattagctatacaagaaattatgaaccgtcaagcaggagattggaaattcaatagctcggcctttatattgccgacatttaagttgattaaaaaagaattattcaatgaagttcacttttcaaatggtcgccgctttgatgatgaagcaactatgcatcgcttttatcttttagcctctaaaatcgtctttataaacgataatctctatctgtatagaagacgttcaggaagcatcatgagaacggaatttgatctttcctgggcaagagatattgttgaagtgttttctaagaaaatatcggattgtgtcttggctggtttggatgtctccgttctgcgtattcgatttgtcaatcttttaaaagattataagcaaactttagaataccatcaattaacagatactgaggaatataaagatatttgtttcagattaaagttgttttttgatgcagaacaaagaaatggtaaaagttgaaataaaagaattgttatttaccatatcacaaacaatgaaggtgaggggagtgttttatgactaagatttattcgtcaatagcagtaaaaaaaggactatttacctcatttctactgtttatctatgtattgggaagtcgtattattctcccttttgttgacctaaatactaaagattttttaggaggttcaacagcctatctagccttctcagccgccctaacaggtgggaatctaagaagtttatcaattttttctgttggattatccccttggatgtccgccatgattttatggcagatgttttctttttctaaacggttgggtttaacatctacgtctatagaaatacaagatcgccgtaaaatgtacctgaccttgctaattgctgtgattcaatccttggcagttagcttgagactgccagtacaatcctcctattctgcaatattggttgttctaatgaatacaatattgctgatagcaggaacattttttcttgtttggttgtcagatttaaatgcgagtatggggattggaggttctattgtaatcctcctatccagtatggttttaaatattcctcaggatgttttggaaacatttcagacagtacacattccaacagggattattgtgttacttgctttattaacccttgtcttttcttatttacttgcccttatgtatcgagctcgctatttggttcctgttaataaaattggcttacacaatcgatttaaacgctattcttatctcgaaatcatgttgaatcctgcaggtgggatgccttatatgtatgtgatgagttttcttagtgtaccagcttatttgttcatcttgttgggatttattttccctaatcattcagggttagcggctttatcaaaggaatttatggttggaaagcctttgtgggtctatgtttatatttcggtcttatttttatttagtatcatttttgcttttgttacgatgaatggagaagagattgcagaccgtatgaaaaaatctggagaatacatttatggtatttatccaggtgcggatactagtcgatttattaatcgattggtccttcgtttctcagtcataggtggtctctttaatgtgattatggcaggtggtcccatgctttttgttttgtttgatgaaaagttattacgattggcaatgattccaggcttatttatgatgttcgggggcatgatttttacgattagagacgaggtcaaggctttaaggctaaatgagacctatagacctttgatttaggagacttttatgtattattttattccagcttggtatgggtcagaaagaacatggcatgcagatatcactccatggtatttttctcattttcgtctagagtttgatgatacctttcaccagattcggctctttcaagagcaagatatagattctcgtctattagtattagcttaccagcctcatctacgttattttttatatagacatggtgtgttagaaatggatacttattccgtttttgatgttatgcaagattttcataatctccatacccaagttttaagcattagagatattgagtgggatgatgactgtgaatttatttatagtccctttacgattatcgttcaaaaaaatgggaagaaatttgctaaggttgaacatggagttgaaggcttcatcagtgatatacagtattttgaaccaaatggtcaaatacatatgcaccatatcgtggatgatcgtgggtttgtatcgagcattatcttttttgaagatgggcaagcagcctatcaagaatatctgaacctcaagggagagtggcaattcagagagcgtttaaaagaaggaggacaggtagaagtcaatccaattttgggttatcgctttaaaatgcttacctatcaaaatatgggagatctggtggcagaattttttgagaattatctgcaaacgtatgtgaaggatcaggatatttttatgcttccttctcattctcatcatgaccagttggtactagatcgtttacctagtactaatcctaaactgttgagtctgttcattggacgtaatcctcaagatacctttagggatttagatgtaacttttgaaaaatcggatttgattttggtggatagagaggatagtttacgattgttgcaggagttgtatcctgaacgaatgcatcaatgttatcatttatcatcttttgacacccgattacgattgggacgaagccaaactaagaaagaatccatcatttattttcaactggattttgagcaggggattgataatcaagctctgcttcaagtcttgtcctttgtcgctgaaaataaggatactgaggtgatttttggagcctttgctgctagtcaggagcaaatgaatgaggttgaagggattgttgagtctttcatccaagaaaacattcaatccgaaaatctgggaaaggcgattgattatggtgatgcagaaaatcctctggaagaaaatcaacaccaggacttacgcttacagtttgttaacttgaatgatgagttagatttgataaaaacactagaatttgtccgtttgattgtggatttaaatagacatcctcatctctacacacagattgctgggattagtgcaggaattcctcaaatcaacctagttgaaaccgtctatgttgaacatttaaaaaatggttatttgttagcagatgttacagaattttctaaggctgcacattattacacagataggttgaaggagtggaatgagtccttgatatattcaattgataagattaaggagcacacaggacaacaatttcttggaaaattagagaaatggatagaggaggttaaaaatgtcaaaggaacttaatattttacagataggacttgccaattgggaaaatcactatgacatacctgaaaatatgagttggtattatttttacccaaactcatcaaaagcccttcgtgaaataattgaaaaagaggatattaaccgttttcatgcagttttaatagaagatggtcagtattccagagacttattttcctatgtaaaatattttgaaccttatactttattttataaccagaatctacaaataaatgatagagaggttgtggattttctaaaaaaacgatgtgcacaagcaattgattttttaagtccccaacaactaatcaatgatttaagtaaatctctttttggcggtgggtatggtgataaactctttcctccgacgatacaagtcaatccaaattttacaggagctatttcttatcaaggattggattatgtcagtttggaaggtgagtttgggcaagattttgcccagcttgcctattgggcttataatattatggtgcaaaaaacactccctattgagttgtggcttgaatatgagaaggaaggcaattgtgactttcgtttagtaatccgtaaaatgtggagtgggtctgttgatgatttctttgaagaagtaatagtatctgaaaaagacttggagcaagcactttttatggatagtcgagacggagactactttctctcgatatctgttgaagcaagaggtcgtggaactatcaaactaggtaatcttcaccaacgatggagtcgaaaacaatttggtaagtttgtacttggtggaaatatcctacatgattccaagcgtgatgaaataaactatttcttccatccaggtgattttaaaccgcctttgactgtctattttgcaggttatcgacctgcagaaggattcgagggttactttatgatgaaaactcttggatgtcccttcattttattttctgatccacgtttagaggggggagctttttatctcggaacggatgagctagagggaaaagtaaaggatacgatcactcactatcttgattatttaggctttgatcataaggatttgattttatcaggtctttctatgggaacgtttccggctctctattatggtgcttcttttgaaccccatgccatcatagttggtaagcccttggctaatttaggaactatagctagtcgtggacgtttggacgcaccgggtgtctctaacttagcttttgattgtttaattcatcatacaggtgggacaagttctcaagatatgacggagttggatcagcgtttttggaaaatttttaaacaagcaaatttttcaaagacaacctttggtttatcctatatgaaagatgaagaaatggatccacaagcctatgaacaattagtgtcttatctgtgtaatacaggtgcgaagattttatctaaaggaactgctggacgacacaatgatgatacagataccaatatttcttggtttttgcacttttatagaatggtcttagagactggttttggaagggagaaaagatgattattacacagagacagtctattcattggggagaagttggtgggacttatatgtatggaacaactgtatcttattaccctgacaaaagtgttcgtctgtataatcctctattgccatctggtgagattctaaagacttggttttctagtgtcaattaccaggctgcacgaacccaacctcagcttcccttattaaaaagaaagcaggagtatcaactatcactggtttttgactgtcagcctgaaaatggagtttataccaagataactttttttgaccgctatggtgatattttagaaaaaaaggtagaaaaagtgaaagatttcatatttacttatccagaagatagttatacttatcgagtttctcttttaagtgctggatttgagtccttaactttttatcatttttctatcaaggagatcagaagtgtttagacgtttaggtcaagatttccagcttaggaaagtgaaaaagattttaaagcagattaatgccctgaaaggcaagatgtcctctctttcggatcaagaattagtagctaaaacagtagagtttcgtcagcgtctttccgagggagaaagtctagacgatattttggttgaagcttttgctgtggtgcgtgaagcagataagcggattttagggatgtttccttatgatgttcaagtcatgggagctattgtcatgcactatggaaatgttgctgagatgaatacgggggaaggtaagaccttgacagctaccatgcctgtctatttgaacgctttttcaggagaaggagtgatggttgtgactcctaatgagtatttatcaaagcgtgatgccgaggaaatgggtcaagtttatcgttttctaggattgaccattggtgtaccatttacggaagatccaaagaaggagatgaaagctgaagaaaagaagcttatctatgcttcggatatcatctacacaaccaatagtaatttaggttttgattatctaaatgataacctagcctcgaatgaagaaggtaagtttttacgaccgtttaactatgtgattattgatgaaattgatgatatcttgcttgatagtgcacaaactcctctgattattgcgggttctcctcgtgttcagtctaattactatgcgatcattgatacacttgtaacaaccttggtcgaaggagaggattatatctttaaagaggagaaagaggaggtttggctcactactaagggggccaagtctgctgagaatttcctagggattgataatttatacaaggaagagcatgcgtcttttgctcgtcatttggtttatgcgattcgagctcataagctctttactaaagataaggactatatcattcgtggaaatgagatggtactggttgataagggaacagggcgtctaatggaaatgactaaacttcaaggaggtctccatcaggctattgaagccaaggaacatgtcaaattatctcctgagacgcgggctatggcctcgatcacctatcagagtctttttaagatgtttaataagatatctggtatgacagggacaggtaaggtcgcggaaaaagagtttattgaaacttacaatatgtctgtagtacgcattccaaccaatcgtccgagacaacggattgactatccagataatctatatatcactttacctgaaaaagtgtatgcatccttggagtacatcaagcaataccatgctaagggaaatcctttactcgtttttgtaggctcagttgaaatgtctcaactctattcgtctctcttgtttcgtgaagggattgcccataatgtcctaaatgctaataatgcggcgcgtgaggctcagattatctccgagtcaggtcagatgggggctgtgacagtggctacctctatggcaggacgtggtacggatatcaagcttggtaaaggagtcgcagagcttgggggcttgattgttattgggactgagcggatggaaagtcagcggatcgacctacaaattcgtggccgttctggtcgtcagggagatcctggtatgagtaaattttttgtatccttagaggatgatgttatcaagaaatttggtccatcttgggtgcataaaaagtacaaagactatcaggttcaagatatgactcaaccggaagtattgaaaggtcgtaaataccggaaactagtcgaaaaggctcagcatgccagtgatagtgctggacgttcagcacgtcgtcagactctggagtatgctgaaagtatgaatatacaacgggatatagtctataaagagagaaatcgtctaatagatggttctcgtgacttagaggatgttgttgtggatatcattgagagatatacagaagaggtagcggctgatcactatgctagtcgtgaattattgtttcactttattgtgaccaatattagttttcatgttaaagaggttccagattatatagatgtaactgacaaaactgcagttcgtagctttatgaagcaggtgattgataaagaactttctgaaaagaaagaattacttaatcaacatgacttatatgaacagtttttacgactttcactgcttaaagccattgatgacaactgggtagagcaggtagactatctacaacagctatccatggctatcggtggtcaatctgctagtcagaaaaatccaatcgtagagtactatcaagaagcctacgcgggctttgaagctatgaaagaacagattcatgcggatatggtgcgtaatctcctgatggggctggttgaggtcactccaaaaggtgaaatcgtgactcattttccataaaaggagaaaatatgacaatttacaatataaatttaggaattggttgggctagtagcggtgttgaatacgctcaagcctatcgtgctggtgtttttcggaaattaaatctgtcctctaagtttatctttacagatatgattttagccgataatattcagcacttaacagccaatattggttttgatgataatcaggttatctggctttataatcatttcacagatatcaaaattgcacctactagcgtgacagtggatgatgtcttggcttactttggtggtgaagaaagtcacagagaaaaaaatggcaaggttttacgtgtattcttttttgaccaagataagtttgtaacctgttatttggttgatgagaacaaggacttggttcaacatgccgagtatgtttttaagggaaacctgattcggaaggattacttttcttatacgcgttattgtagcgagtattttgctcccaaggacaatgttgcagtcttataccaacgaactttttataatgaagacgggactccagtctatgatatcttgatgaatcaagggaaggaagaagtttatcatttcaaggataagattttctatggaaagcaagcttttgtgcgtgcctttatgaaatctttgaatttgaataagtctgatttggtcattctcgatagggagacaggtattggacaggttgtgtttgaggaagcacagacagcacatctagcggtagttgttcatgcggagcattatagtgaaaatgctacaaatgaggactatatcctttggaataactattatgactatcagtttaccaatgcagataaggttgacttctttatcgtgtctactgatagacaaaatgaagttctacaagagcaatttgccaaatatactcagcatcagccaaagattgttaccattcctgtaggcagtattgattccttgacagattcaagtcaagggcgcaaaccattttcattgattacggcttcacgtcttgccaaagaaaagcacattgattggcttgtgaaagctgtgattgaagctcataaggagttaccggaactaacctttgatatctatggtagtggtggagaagattctctgcttagagaaattattgcaaatcatcaggcagaggactatatccaactcaaggggcatgcggaactttcgcagatttatagccagtatgaggtctacttaacggcttctaccagcgaaggatttggtctgaccttgatggaagctattggttcaggtctacctctaattggttttgatgtgccttatggtaatcagacctttatagaggatgggcaaaatggttatttgattccaagttcatctgaccatgtagaagaccaaatcaagcaagcttatgccgctaagatttgtcaattgtatcaagaaaatcgtttggaagctatgcgtgcctattcttaccaaattgcagaaggcttcttgaccaaagaaattttagaaaagtggaagaaaacagtagaggaggtgctccatgattgaactttatgatagttacagtcaagaaagtcgagatttacatgaaagtctaggcgctactggtctttctcaacttggagtggtcatcgatgcagatggttttctgcctgatggtctgctttctccttttacctattatctaggttacgaggatggaaaacctctctattttaatcaagttcccgtttcagatttttgggaaattttaggagataatcagtctgcttgtattgaagatgtgacgcaggagagggctgtcattcattatgctgatggaatgcaggctcgcttggttaaacaggtagactggaaagacctagaaggtcgagtacgtcaggttgaccactacaatcgcttcggagcttgttttgctacaacgacttatagcgcagatagcgagccgattatgacagtttaccaagatgtcaatggtcaacaagttttactggaaaaccatgtgacgggtgatatcttattgactttgccaggtcagtccatgcgttactttgcaaataaagttgaatttatcaccttctttttgcaagatttggaaatagataccagtcagcttatctttaatactctagcgactcctttcttggtttccttccatcatccagataaatctggctcggatgtcttggtatggcaggaacctctctatgatgccattccaggtaatatgcagttgattttggaaagtgataatgtgcgtactaagaagatcatcattccaaataaggcgacttatgagcgcgctttagagttaactgacgagaaataccatgatcagtttgtgcacttgggttatcattaccagttcaaacgtgataatttcctaagacgagatgccttaatcttgaccaattcagatcagattgagcaagtagaagcaatcgcaggagccttgcctgatgtcactttccgtattgcagcggtgacagagatgtcttctaagctcttagacatgctttgctatcctaatgtggccctttaccagaacgctagtccacagaagattcaggagctgtatcaactgtcggatatttacttggatataaaccacagtaatgagttgctacaggcagtgcgtcaggcctttgagcacaatctcttgattcttggctttaatcagacggtgcacaatagactttatatcgctccagaccatctatttgaaagtagtgaagttgctgctttggttgagaccattaaattggccctttcagatgttgatcaaatgcgtcaggcacttggcaaacaaggccaacatgcaaattatgttgacttggtgagatatcaggaaaccatgcaaactgttttaggaggctaacatgtcagaggaagatttattttacaaagacgttgaaggccgcatggaagagttgaaacaaaaacccatcaagaaggaaaaagaaacccgaggggaaaagattagtaagactttttcacttttactgggtttgatgattctgattggtttgctctttactttgctgggaattttgaggtagatctatgattgaaatactaattgttttagctattatcctatctcttgctttgattgtattggtaactatacaaccccgtcaaaatcaactattttccatggatgccactagtaatattggtaaaccaagctactggcagagcaacaccttggtcaaggtgctcactttattggtgagtttggctttatttattctactattaacctttatggtgattacttataaataaaagaaaacttcagatattcaccttttgtggattggtctgaagttttcttttttatactcaatgaaaatcaaagagcaaactaggaagctagccgcaggctgctcaaaacaccgttttgaggttgtagatataactgacgaagtcagctcaaaacaccgttttgaggttgtagatataactgacgaagtcagctcaaaacaccgttttgaggttgtggatagaactgacgaagtcagctcaaaacaccgttttgaggttgtggatagaactgacgaagtcagctcaaaacaccgttttgaggttgtggatagaactgacgaagtcagctcaaaacaccgttttgaggttgtggatagaactgacgaagctcagtaacatatatacagcaaggcgacgctgacgtggtttgaagagtattactgtctatatttttggtaaaaatcaacttttacttggatgaaggttttggcttcacgtaggagttgaagaagggtggcgcgggtttcaaattcttctcttgtcttgggcagactgcggttccggaagacttccagataacgttcaatttcatctagcaaatcagaagcaggattggtctggctcagttgacctgcaatttttgaaaagagttgcgctaagatcaggctttcactggcggcaaggtgacaagtgttaatctgttgggccatgtttctcaggatacgactttgtcgctgtctcatctcaaagtagtggatatggtagtctgtctggtgaaagaggtggtcagagtgatccaaatagaccagtctgagggcttctttcaaaagcgtgtctaattctgctaccagctgtgctcggttgcgtccgtctcctctggataaatagtatttgaagcgctggaggatatcttttaacttttcttccaccagcgtgtggtagtgctggatttcctcttctcgtgaaggcatatagagattaacaagcaaggcaaatcctgtaccaatagcaaagagaaggaattcattgactagaaggtctggagaggttgactcttgaaccaagagatggctaaccaaaacagtgcttggtgtgatgccaatttcccagcccatcttgtaggctaaaggaacgtagaaggccagatagaggccgagactccagatatgaaatccgctcaagtgaaaagctagaacaccgatagccagagctagaagcatagaaaaaagacgattgcgagccagttttaaagtacttctacgcgtatcagataggctcaagagagcgataattccagccgaaactgctgacgaaagattgagaaaataagcaagcaggcaggcaagacaggtagctaagatgagcttggtcgtacgttggctaatagacataagaatttcctaataagttagaataaaagcgtaaaagacaagacatgagcaggcttgccttgatgagttattttttacgggttgctgcgtattcggcaacggcggtaaagaggacatctgtagaagagttaagggctgtttcacatgagtcttggatgacaccaatcacaaaaccaaccccaacaatttgtatggcaatatcgttagaaataccgaaaaggctacaagcaactgggataagaaggagggaacctccggcaatacctgaagcatcacaggatgagatagctgctaccacactgaggacaaaggctgtggcaaagtcaacaggaattccaagagtgttaactgcagcaagggtcaaaaggttaatggtaatcgctactccagccatattgatagtagaaccgagtgggatagaaacagaataggtatctgggttgagtccaaggtcatggcagagtttcatgttgacaggaatgttagtcgcagaactacgagtgaaaaaggctgtcacaccgctgacacggaggcagttccaaactagagggtaaggattgcgtctcataaagaagaaggcaatcaaagggttgaccacaggggcaacaaaaagcatagtcgttactaatagaaccaataaaataccgtagttggcaaggcttccgactcccttgtcagaaatggttttaaaaacaagaccaaggattccaaatggagccagattgatgatccattcgacaattttagaagtcacgtcagcgatagtttttagcaattcttgactatttttactggcttctctcatagcgattccaaaaatgactgcccaagataagattctaatatagttagcagtaagcagggcgttgactgggttgtcaaccagtttgagcaagaggttgctgagaacctgcccaatcccatctggtggtgcaatttcagtattggcactatttggggtaatttcaatagggacgatgaaatttgctagtacagctacaagagcagcggcgaaagtccctatcataggatatacaagaaaacaacagttttcatattgctatcttgtcccttttgatgttgggaaagggcattggcaacgagagcaaagactaggataggagcaacagcttttagacctccaacgaataaatcctcgagtagcccaatccctgagagattaggaagggtcagtcctaggattccccacaaagcataccaatcaagatacgcttgacaaggcttgccttattccaagcatgaatgattcttttcataataatctcctttttgtgtagtgattatgattatagtataaatgatagacaaaatcaagaattttctgtctattttttgaatatttatggagaatgagactgatgaaaatatggtataatgaaataaaggagttttatatgcaaaaatttattcaggcttatattgaaaagctagatgtgacaaccattatcgagaatattctaaccaaggtcatttctcttttactgcttttaattgtattttatattgctaaaaaaatgcttcataccatggtgcagagaattgtcaaaccttctctaaaaatgtctcgtcatgatgttggacgccaaaaaaccatctcacgtttactagaaaatgtgtttaattatacgctatatttctttttactctactgcattttgtcgattttaggtttgccagtttctagtttgctggctggagctggtattgctggggtagcgattggtatgggagcccaaggctttctgtctgatgtcatcaatggctttttcatcctctttgaacgtcaactggatgtgggagatgaggtcgttctgacaaatggaccgattactgtatcgggtaaggttgtcagtgtgggaattcgtacgacacagcttcgtagcgaggagcaagcccttcactttgtccctaaccgaaatatcacagttgttagcaatttctcacgcacagactagacctgttattttaagtaatttgtggtacaatagagggagtttaataaggagaaaagatggttttagaaaagcagttgggcaatggttgtacctggatagacctagacctaggaaagttgaataaactagaagacctttctgaaatttacggtttggacaaggaaaccattgaatacgcactggatagaaacgagcgcgcccacatggactaccaccgtgaaagtgagacggttacctttatctataatgtcttagacgtaaaaaaggacaaggcctactatgagacttttcccatgacctttattgtcgagcatcgtcgcctgattaccattagtaataccaagaacgcctatgtcattgaacagatgactcgttatctggagaaccatgacacgctttcgatttataagtttctctttgccagtctggaaatcatcagcaatgcctactatcctgtcattgagcagatggacaagagtagggatgaggtcaatgacctcttgcgccagcgaactaccaagaaaaacctctttgtcctgtctgatttggagactggtatggtttatctgacggcagctgccaaacaaaatcggattttgttagagcatattcaaggtcatgccttgtatcgtagttttgatgagattgagagagaacagtttgatgatgccatgattgaggctcatcagctggtatccatgacagacctaatctctcagattttacagcagctttcagcctcttacaacaatattctaaacaataatctgaatgacaatttgacaaccttgactatcatttcagtcttgctagctgttttggcagtcgtgacaggctttttcggaatgaatgttcccttacctttaacagatgagccccatgcttggctctatatcagtttggctagtgcaggtttgtggattgttttatccttgttactaaggaaaattgcgaaaaaaagttaagaaaaggagccagaatggcgattgaaaattatataccagattttgctgtggaagcagtctatgatctgacagtcccaagcctgcaggcgcagggaataaaggctgttttggtcgatttggataataccctcattgcttggaacaaccctgatggaacgccagagatgaagcaatggctacatgaccttcgggacgcgggtattggcattatcgtagtgtcaaataacaccaaaaaacgcgttcaacgagcagttgagaaatttgggattgattacgtttactgggccttgaagcccttcacatttggtattgaccgtgctatgaaggaattccactatgacaaaaaggaagtggtcatggttggtgaccaactcatgacagatatacgagcagcccaccgtgcagggattcggtcaattttagtcaaacccttggtccaacatgactcaatcaaaacgcagattaaccgaactcgtgagcgtcgtgttatg

SEQ ID NO: 72 - DNA, 14872 bp; double-stranded, linear
ccagtcacaaagaaattgagcgcgttcagctgaggatgcactatgatgcaagctacatttcatttgatgggatattaagaaaggagattttcatgacacttttagatgtaaaacacgttcaaaaaatttataaaacacgttttcagggcaaccaagtagaagccctcaaggatattcactttaccgtagaaaagggtgactacgttgccatcatgggtgagtctggttctggtaaatcaactcttctcaatattctagctatgttggataaaccaagtcgtggtcaggtttacttgaatggaactgacaccgcaactattaaaaattcacaggcttctagtttccggcgtgaaaagctaggatttgtcttccaagactttaacttgctagatactctgtctgttaaggacaatatcttgcttccgcttgtcttgtcaagaagacctataacggagatgatgaagaaattggtggtgacagctgagaatctgggtattaaccaattgcaagagaagtacccttacgagatttctggtggtcagaaacagcgtgtagcagtagcccgcgccatcatcacagaacctgaaattctccttgcggacgagccaacaggagcccttgattccaagtcatctgcagccttacttgatgtctttaatgaaatcaatgagcgtgggcaaaccatcctcatggtaacccactcaacagcagctgctagcagggccaagcgtgttctctttatcaaagacggcattctttacaaccaaatctaccgtggagagaagacagagcgtcagatgttccaagaaatctctgataccttgactgtcatggcaagcgaggtgaattagtatgtttcgattaaccaataagttagcggtatcgaacttgattaaaaaccgcaaactctactatccctttgcactggctgttctcttggcagtcaccatcacctatctcttttactccctaaccttcaatccaaagattgcggaaatccgtggaggaaccaccattcaagcaacacttggatttggtatgtttgtcgttacccttgcgtcaccattatcgtcctctatgccaatagttttgtcatgaaaaaccgttccaaggaactgggtatatatggcatgttaggcttggagaagcgccatctaatcagtatgacctttaaggagttagtggtatttgggattctaactgttggagcgggtatcggtattggagccttgtttgacaagttaattttcgctttcctgctcaaactaatgaaactgaaggttgagctggttgctaccttccaaatgaatgttgtcattgcagtacttgttgtctttggattgattttcctaggcctcatgttcctgaatgctcttcgaatcgcccgtatgaatgccctccagctctcgcgtgagaaagcaagcggagagaaaagaggtcgcttcctacctctccaaacgattcttggttccataagtttagggattggctattatcttgcccttacggtaaccgatcctcttacagccctaacaactttcttcctagctgttttgctggttatctttggtacttatctattgtttaatgcagggattacagtcttcctacaaatcttaaagaaaaacaagaaatactattaccaacctaataacctcatatctgtttccaacttgattttccgtatgaagaaaaatgcggttggactagcaaccatcgctattttgtcaacaatggttttggtaaccatgtcagcagcgacaagcattttcaattccgcagaaagctttaaaaaagttctaaatcctcatgattttggggtttcagggcaaaatgttgaaaaagaagatttggacaaactcttgagccagtttgcaagtgacaaaggttatagtgtcaaagagaaagaagtacttcgttacagtaactttggtattgcaaatcaagaaggaaccaagttaactatttttgaaaaaggacaaaaccgtgtccaacccacaacagttttcatggtatttgaccaaaaagattatgaaaatatgactggtcaaaaactgtctctatcaggaaatgaggtcggtctctttgccaaaaatgacggactgaaaggacagaaagctctaactctaaatgatcatcaattttctgtcaaagaagaatttaataaagatttcattgtgaaccatgttccaaataagtttaatatcttgactactgattacaattaccttgttgttcctgatttacaagcctttttggatcaattcccagattcggctatctataatcagttttacggtggtatgaatgtaaatgtcagtgaagaagaacaactcaaggtcgctgaggagtatgaaaactacctcaatcaatttaatgctcaattagacacagaaggtagctatgtttatggtagcaatctagcagatgctagttctcagatgagtgccctctttggtggtgtcttctttatcggtattttcctatccattatctttatggtcggaactgttctggtcatctactacaaacaaatttctgaaggctacgaagaccgtgaacgctttattatcttgcagaaagtcggtttggaccaaaagcaaatcaagcaaaccatcaacaaacaggttttaactgttttcttccttcctttgctctttgccttcatacatctcgcctttgcctaccatatgcttagcctgattttaaaagtgattggtgtactggatacgactatgatgttgattgtgaccttgtctatctgcgctatcttcctcatcgcctatgtgctgattttcatgattacttcaagaagttatcgcaagattgtgcaaatgtaaaaaagatacctcgacttcaaaatcgaggtatttcttgtattctaaatgctgaaaagttgtccgagcaggaaggtaactcccatggtcaagagaccaatagcaaggttccgaatcatagctgttttggttggggcttttccaagtctagcacttgtgtaaccagtgagaagaagggccacaccgacaataaggacggtagcagggatgcggtaatcacttggaaaaatggtcactgacagcattggaggcaaacttctaaggaaaaaggcaacgaagctagaaatggcagcgtgccaaggattggtaaattcttcatactcaatcccatatttttcctctaccagagccttgagtggatttttaagaaagatcttattggtcaagagttgggcagaagttttgaattctccattttggatataagcagcatagagggattttttggctagttccctatcttggtctagcaagagtttttctcgcgaaacggcagcttcctcggtatcttttggagttgaaacggatacatattctccaccagccattgaaaaggcaccagctaagatagccgtaaaacctgataaaaagataatccagatattggtcgtggcactggcaactccgataaccacaccagcaatggaaataattccatcgttagcatcaagaacacccgcacgcaggatatttaaacgacctgcaaaatttgaatcaatttcgtgatttgtttctgacgctaaatttcaagttcaagttagccatcaagaagtcttctctgggtgacttgtagtccaagcattttttaggatagttgttaatccacttttcgatgaatgcgacttctttgggagtcattttcttggttcccttaggtaaccatctacgaatgagcctgttgtgattctcattagttcccctttcccaagaggcatagggatgtgcataataaatgtgctcctcagaaaatacattagacaagcgattgaattccgttccattatctgccgtgatggaaagaatcttgtgttgttttaagatgagttttagagcctgattgaccacatcagcacttttatttggaatcaatcggatgatctgatgtctactttttcgatccgtcaagacaagcaagcagtagtttttcgctctcgtaagtagaactgtatcaatctcataatgcccattctccaagcgaaaattgatagcttcaagccgctgttcgatggattgaccagcaggtttaaagttggtgctggcctgtttcttaagcgcttttccttttctagggtaaagcagatcctgtttgcttaaccccaattttccatgatgaatccaatagtaaatggttgaaattcccacgttaacccctttagccatcaccatcatttcaggcgaaaatttttggttatgatagtggagaatcttttcctttagttccttggtcaagcttgatttcttgaccgagcgcttgcgattgttttcataagactgttgagcatagtcggcagaataaacctctttgaagcgcccttttccaagacattgtcggactgtcccacgcttgatttcagtgtggatagtttgaggaacttttccaagcagagaggcaatttctctatttgatttcccttcttttttccatctttcgattaagcgacggctatcgattgtcaaatgttcgccttttgtagtataatggttttgcatctctgtgcctttcttgtgtttgtggttgaacaacaagtataacacagaggtgttttcttatgcctacaagagctatcggctagttgaaccatctaatttttaggagggctgggtggctaacttcattatagaactttcatttacgaacatatagtaaaatgaaacaagaacagaacaaatcgatcaggacagtaaaatctatttctaacaatgttttagaagcagaggtgtactattctagtttcaatctattatatttttgttttttatcaaaaaatactttacaagttcttaaaaacatgatatagtaataaagcttagaaaatgagatgatgttttctagcaaatataaacccgagtaaaaaatgcctacggacaggcagggttgaatgccgaagcgtggttgaaaagccacattattgatagggttaaaagcctacttttataagttgatgttaggacacttgtcctaattcataaatttttagtgtggtgaaagcacacgtcatcttgtgaaacgatcaataaagtacgtaatatttgctactagagagttaggaaacatcgggaacagacatactcaacagaaaccaaaataaacacgtcagaagattgcagagcaggtgaaaacctgctcttttttcatgagtcaacctttagttccttagttttcataaggtcctaaaaatattgaaaggagtatgttttgaaagagttagatcaaaaccaagccccaatttatgaggccttggtgaagttacgcaagaaaaggattgttccctttgatgttccaggtcacaagcgtggacggggaaatccagaacttgtcgaactcttaggagaaaaatgtgtaggcattgatgtcaattcgatgaaacctttggataatttaggccatcctatttcgattattcgtgatgcagaggagctggctgcagatgcttttggagctagccatgcctttctaatgattggtggaacaacttcatcggtgcagactatgattctggcaacctgcaaggcaggagataagattattctgccacgaaatgtccataaatctgctatcaatgcgttggttctatgtggtgccattcccatctatatcgagatgagtgtagatcctaagattggtatcgctttaggtcttgaaaatgaccgagtagcacaggccataaaggaccatccagatgctaaggctatcctaatcaacaatcctacttactacggcatctgttcagacctaaaggggttgacagaaatggctcatgaagctggcatgatggttttagtagatgaagcccacggagcgcatttgcatttcactgataaacttccaatttctgctatggatgcaggggctgatatggcagcagtttccatgcataagtctggtgggagtttgacccaaagctccattttacttatcggggagcagatgaattctgaatacgttcgtcagataattaacctgacccagtctacatctgcctcttacttgttgatggctagtttggatatttcacgtcgcaacttggcccttcgtggtaaagagtcgtttgagaaagtcattgagctatctgagtatgcccgccgtgaaatcaatgctatcggtggctactatgcctactcaaaagagttaatagacggtgtttcggtttgcgattttgacgtaactaagctgtcagtttacactcagggtattggcttaacaggtatcgaggtttatgacctcttgcgagacgaatacgacattcagatcgagtttggtgatatcggcaatatcttggcctatatttccatcggcgaccgcatccaagacatcgagcgcttggttggtgctctggctgatattaagagactctattcaagagatggaaaagatttgatagcaggagaatatattcagcccgagttagtgctgtctccgcaagaagccttctattcagaaagaaaaagtttaactttggatgattctgttggacaggtctgtggagaatttgttatgtgttaccctccaggtattcctatcttggctcctggtgaacgcattacacgagaaattgtcgactatatccaattcgccaaggaacgtggttgctccctccaagggacggaagatccagaggtcaatcatatcaacgttattaagagaaagacaaactataagaaaagtcaatagttttatctaaactatttcttatttcaatttgatgatttggcgatgattttagagcacggcaaaaagcccttgaattagaagcggtcaatcgcttaatttctatcagcttatcaaatcctgcctcaagccttttctgaggattagggtagcgtgtcaagagttggtaggtatattctgaatgctttccaacgattttatccaactcaggaaagatgatatcaagacaacgagtgtattgtactttccaatcagactgttttttcttgagacgatgaatatgtctagccagtatttttagttctacttgccgattatcgtgttgaaattgttcacgattggggtcagaaagaagtttaagagcgatgccatgagcgtctttcttatccgttttagttttgcgaagtgataatgatttggcaaatttcttgatgagcaaaggattgtaggtgtaaactttatatccttgttcatgcaggaagttcagtagattaaaggcataatgtccggtattttcaagagcgatgagacagtcttggttgagctgtcgaagagacagatctaagagttcaaaaccagctttattatttgaaaaagtgagtggtttaagaacagtttttcctggaacattcaaggctgtaacatcgtgtttatttttagcgacatcaatgcccacataaagcatgggagtatctccagatatagtatttcaagtctactgggttatccacgaactttttgccttgttaccttagacgagataaaacgtctatgcgttatcaaactcattaccaattgaaacaaaaaactgtggttagagcctttcggaaatcgtcaagcgattggaggaaatgaactaatccacagtggcttattccaagtataccacttgggctttggcagtagctaactgcgctaaatataatataaggagaaatagatggatttatggttttctgaagttcatactccagatgtcaaattgtctctgagaacagccaagcaactttacgctggaaaaagtgaatggcaggatatcgaagtcttggatacgccagcttttgggaaaatactgattttaaatggccatgtcttgttctcagatgcggatgatttcgtctacaatgaaatgaccgttcacgttcccatggctgtccacccaaatccaaagaaagtattggttattgggggtggtgacggcggtgttgcccaagtattaaccctctatcctgaactggagcaaattgatattgtggaaccggatgagatgttggtcgaggtctgtcgtgagtatttcccagactttgctgcagggctagatgatcctcgtgttaccatttactaccaaaatgggctacgctttttgcgaaactgcgaagatgattacgatattatcatcaacgatgcgacagatccatttggccatacggaaggactctttaccaaggaattctacggcaatagttatcgagctctgaaggaagacggcatcatgatttaccagcatgggagtcccttctttgacgaggatgagtcggcctgccgaagcatgcaccgcaaggtcaatcaagcctttccaatcagtcgggtttatcaggcccatattccaactagcccagctggctattggttgtttggatttgcatcgaaaaaataccaccctgtcaaagattttgacaaggaaggctggaaaaaacgccagcttttcacagaatactacactgcaaacttacacgtgggagcctttatgttgcccaagtatgttgaggacattttagaagaagaggaaggaaaaaaatgagtcgtttactagttattggttgtgggggcgttgcccaagttgctatttcaaagatttgtcaagatagcgaaacatttacagagattatgattgctagccgtaccaagtcaaaatgcgatgacttgaaagcgaagctagaaggcaaaacaagtactaaaattgaaactgcagcacttgatgctgacaaggttgaagaagtgattgccctgattgaaagctacaaaccagaagctgttttgaatgtagctctgccttatcaagatttaaccattatggatgcttgtttggcaacaggtgttcactatatcgatacagccaactacgaagcagaagacacagaagaccctgagtggcgtgctatctacgaaaaacgttgtaaggaacttggttttacagcctactttgactactcatggcagtgggcttatcaagagaaattcaaagaagcaggcttgactgctcttcttggttctggttttgacccaggtgtaactagtgtcttttcagcttatgccctcaaacactattttgatgaaatccattatatcgacattttagactgtaatggcggtgaccacggttatccatttgcaaccaactttaatccagaaattaatctccgtgaggtttctgcgccaggttcttactgggaagatgggaaatgggtcgaagtcgaagctatgtctatcaagcgtgagtatgatttccctcaagttggacaaaaagatatgtatctccttcaccatgaagaaatcgaatcattggccaagaacattccaggtgtcaaacgcattcgtttctttatgacttttggtcaatcttacttgacgcacatgaaatgtcttgaaaatgttggactccttcgtacggataccattaactttaacggccaagaaattgttccaattcaatttttgaaagccttgcttccagatcctgccagtcttgggccacgtacagtcggaaaaaccaatattggatgtatctttacaggtgtcaaagacggtgtcaaaaagactatctatatctacaatgtctgcgaccatcaggaatgttacgcagaggttggttcgcaagctatttcttatacgacaggagttccagccatgattgggacaaaattagtcatgaacggaacttggaaacaagctggagtgtataaccttgaggagttagatccagatccattcatggaagctttgaatgagtatggtttgccatgggttgtggttgaaaatccacaaatggtggactaatgaagttagaacaagtaccaacaccagcctatgttattgacttggccaagttagaagctaattgccgcattctacaatatgtacaagaagaggccggttgcaaggtcttgcttgcccagaaggcatattccctctacaaaacttatcccttgattagccagtatctatcaggtacgacagctagtggactctatgaggccaaattggcaagggaagaatttcctggtgaagtccatgtatttgcgcctgctttcaaggatgcagacttggaggaattgctagagataatggaccatatagtctttaactcagagagacagttgcgtaaacacggtccgcgttgtcgagaggctggtgtcagtgttggtttgcgcctcaaccctcagtgttcaactcaaggcagatcacgcgctctatgacccttgtgcaccaggttctcgctttggagttactatagacaagattccgagtgatttgctagatttggttgacggacttcattttcataccctttgcgagcagggagcagatgatttacaaacaactttgaaagcagtagaagaacagtttggtccctacttacatgaggtaaaatggctcaatatgggtggtggtcatcatattacaagagaaggttacgatgtggatttgctgatttcagaaatcaagcgtatccgaaaaacttacaatcttgaaatctatatcgagcctggtgaagccattgcgcttaatgcgggttatttagcaactgaggtattagatattgtagaaaacggtatggaaatcttggttttagacgcctctgcgacctgccatatgcctgatgtacttgagatgccctatcgtccacctttgagaaatggctttgagtcacaggaaaaagcccatacctacagactttcttctaatacctgtctgacgggcgatgtgattggtgattatagttttgaaaatccagtccaaatcggagacagactttattttcaagacatggccatttattcttttgtcaaaaataatacctttaatggtattggattgccaagtctctatctcatggacgaacagggagactgtagcttactcaaagcttttggctatcaagactttaaagggagattatcatgatggacagtccaaaaaaattaggctatcacatgccagcagagtacgaaccccatcatggtaccctcatgatatggccgactcgaccaggatcatggccttttcaaggaaaggctgctaaaagagcatttactcagattatcgagaccatagcagaaggggaaagagtctatcttttggtggagcaggcctatctatctgaagcccaatcctatcttggagacaaggttgtttatttagacattcccaccaatgatgcctgggcgcgtgatactggcccaaccattctcgtcaatgataaaggtaagaaattagccgtggattgggccttcaatgcttggggaggcacctatgatggtctttatcaagattatgaagaggatgaccaagtagccagtcgttttgctgaggccttggaaaggcctgtctatgatgctaaaccttttgtactggaaggaggcgcaatccatagcgatggtcaaggaactattctcgtaactgaaagttgcttgcttagtcctggtcgcaatcctaacttgactaaagaggagattgaaaacacattattagaaagtcttggtgctgaaaaagttatttggcttccttatggtatttatcaggatgaaaccaatgaacacgtcgataatgttgctgcctttgttggtcctgctgagcttgttttggcttggacagatgacgaaaatgatccccagtatgccatgtcaaaagcagatctcgaactcttagaacaggaaacagatgcaaaaggttgtcacttcaccattcataaattgcctatccctgcagttcgacaagttgtgacagaagaagatttgccaggctacatctatgaagaaggagaagaaaagcgatacgcaggtgaacgactagcagcttcctacgtaaacttttatatcgccaacaaggctgtcttggttccacagtttgaggatgtaaacgaccaagtggccttagatatcctcagcaagtgtttcccagaccgtaaagttgtcggaataccagccagagatattctcttaggtggtggcaatatccactgtatcacccaacaaattccagaataggagaaaaagatgagaaatgtaagagttgcaaccattcagatgcaatgcgctaaggatgtggcaacaaatatccaaaccgcagagcgtttagtacgtcaggctgctgagcaaggagcccaaattattctcttgcccgagttgtttgaacatccctatttctgtcaggaacgtcagtatgactactaccagtatgcccaatctgtagcggaaaatactgccattcagcattttaaggtgattgctaaggaactacaagttgttttaccaatcagtttctatgaaaaagatggtaatgtcttgtataactctattgccgtcattgatgcagatggggaagtgctgggcgtttatcgaaagacccatataccagatgaccattattatcaagaaaaattctatttcacgcctggtaacactggtttcaaggtctggaatactcgctatgctaagattggtatcggtatctgttgggatcaatggttccctgaaacagcgcgctgtcttgcattgaatggtgctgaattgctcttttatcctacagctatcggttcagagccaattttggatacagatagttgtggtcactggcaacgtactatgcaagggcacgcagcagcgaatattgttccagtcatcgcagccaatcgttatggtttagaggaggttactcctagtgaggaaaatggcggacagagctccagtcttgacttctacggttcctcctttatgacggatgaaacaggagctattctagaacgagctgaaagacaagaagaagctgttctgttagctacttatgacctagacaagggagcaagtgaacgcctaaactggggcttgtttcgagatagaagaccagaaatgtatagacaaattacagattagtgtgggagaaatgagagattcattctgctagactaacttcttattagtaactataagatactatggcatctagtaaatcgatttttatgattcgctattcttgtctattgattagtccgtattttaaaatattagcaaaaaagcaaatagcagtaacttctgtctatttgcttttcttttttatagaatatatttctcaatagcacgcgcaacgccgtcttcttcgttgcttgaggtaacggcatccgcaagagatttgatataatcgctggcatttcccattgcaatcccaagccctgcaaactggagcatttcgatatcgttattagcatcgcccatggccataatctctgaggaatcaatcttcaaaatctcagctagtcgtgaaagagcagtagcctttgtcgttccaagcggcattgcttcataaatgacaggctgcgaacgaactccactgaatcgttggcaaagctcttcagcaaaacgctgctcaaaatcgtctgtttgttcttttgttcctaaacacataccttggaacatccggaactttccactagtcgcttcttcaagagaaatttcagtcaggtctgaaaatactagtttagcatcattttcaataacttgattgggcttgtcaccgagaacaaaataatgtgactcgtcaaaaagtgtcaactgaacatcactcttttcagcaaggtcatagaggtattcgatgtcagctggactcagttctttccagtcaactagactccaatcactggtctggtgagttgaacaaccgttgttaacaataatatattcgttctggaggtcaagctccagttttttgtagtaggggaggacaccgaaaagggggcgacccgtacagagaaccagtttgacacctttttcaatggctttgtgaatagcagtaatgtgtgcttgtgggatttccttggcttcattgaggagggtgccgtccatatccaaggctagtagtttaatcataggtcttcctctttatctttgctattattatagcatattttggagaagaaattgatagaaagcttgagactaattgattttatagtttaagatgttttgatgacaattcatgatttgaagaggatatttcgcaaagatatgctatactatgtttgtcaatgttgcaactagacaaattaaaaaaccaacttaatataatagtttttttgtaagtaggtatgagtagcagattactcaactaatctgaagaataatggaggaaatatatcatgattttaatgacaaaaaatataaatctaacaaatgaagaattagagctgatacaaggtggagcagatccatatggtaaaaatcctaatggtaggtacgattgggaaatagaaccagtattaactctgctggttcatggattttgtcccagaggcacctatgattcaggatatattggaggaggtaatcatctttgcaaaggaagtgctgcgagattttaagtaaaatttattaggaatatgaagaaacaaggggagaaaacagaggatttaatatgaaaaaacgagctattcaaattttactagcattgtccttaattttttacaaatcaacttggttttggaggcttttcaattatctcgcaaagccctatctaccagcaagtcgtgaattttttcagattctgcttttgatggagagcggagttcttttcttagcggtcatctatctactggtttttgcaggaaagaaaatttttcatttcaagtggcagctgaggtacttcatctaccttttactgggctacatcatttcatatatgtctgacttcctcttttcgtatttcatatccctgtcttcaaatcagatttctttgaatgaaacggtagaaatgatggggagacaggagttcccttatgtcttgctcatcgtttgcttcatcgcccctattgctgaggaattgatttatcgaggtgtgcttatgacaacctgttgcaaaaactcaccttggtacg

SEQ ID NO: 73 - DNA, 10223 bp; double-stranded, linear
cgtgctatcggtctcaaaaccaatctggtcgctatggtcaaatccagttggaaaatccattcttcttggagccatctgctggattgccatcatcctcaccactcttggtatgcagacccttatcggcattttctaatactcttcgaaaatctcttcaaaccacgtcaacgtcgccttgccgtaggtatatgttactgacttcgtcagttctatctgcaacctcaaaacggtgtttgagctgacttcgtcagttctatctgcaacctcaaaacggtgttttgagctgacttcgtcagtcgtatctacaacctcaaaacagtgttttgagctgacttcgtcagttctatctgcaacctcaaaacagtgttttgagcagcccgtggctagtttcctagtttgctctttgattttcattgagtataacacaaaaggtagcccatcagctacctttttcttatgcttcctcaatcaagcgagtatgttctctcttgatacagcgattcatcacgatatcatcacatccaccatcacgcaaaatctctttcgcttctaaactttcaagtcctagctgtgcccaaaaaatcttggcatcagctttgagaaaatcacgcgccacatcgggcagaaattcactgcgacgataaacattgacaatatctacaggaaaaggaatttcagcgaggctagcataagccttttcacccaagatttcgccacctgccgccttgggattgactgggatgattttatagccccgagcctgcatttcctttgttactcgattgctggttgtttcttcacggtcagacaaacccaccacagcaagggttttactcgttgcgagatactgacgaatcacgccatcacttggattgataaattcttgactcatagaaatcctcctttttcatcagtatagcacattttgaaaaggtttgcagaattatactacaaaaaaggaggactagccccctttttatttagcctcgtaccaggttgccccttcattctcatctgcgataagaggaacactgagttgaatggcttcttccatggtttgtttcaccaattttttcatctctaccaattcagatttaggcacttcaaggacgatttcatcgtgcacttgtaacagcatcttagtctgataaccacctgcaaccaaggctttatccagctgaatcatggcaatcttgagaatatctgctgccgaaccctggataggtgagttgatagcagttcgctccgcaaaaccacgaatattgaagttgcgcgaattgatatctggcaactcacggcgacgcttaaagagggtctctacatagcccttatcacgcgcctcccgcaccacttcatccatgtagtttttaatacctggaaaacgttcaaagtaggtatcaatgtaggctttggcttccttacgactaattcccaaattattagacaagccaaagtctgaaatcccataaaccactccaaagttaactgccttggcattgcgacggtcgtttgcagtcacatcatcaggacgctcaatgccaaagacccgcatggctgtcgaagtatggatatctgccccctcttggaaggccttaatcaagtgctcatccttagaaatatgcgccaaaacgcgcaattcaatctgtgaatagtcagagctgagtagcacactatcctcccactctggcacaaaagccttccgaatcaagcgcccctgttccaatcgggcaggaatattttgcaagtttggatccacactagacaaacgcccggtctgggtcaaatcctgcacatagcgagtatgaatctttccatcagccaaaatccagtcctgcaagccaattacataagtagattgaatcttagcaatttgacggtaatccaggattttcttaacaatcggagcaataggagcgagacgctctaaaacatccactgctgtcgaataacctgtcttggttttcttagtgtattctagaggaagtcccaatttctcaaagagaagcacgcccaactgcttaggcgagttgacattaaactcctcaccagccagctcgtaaatctcttgagtcagtttttcaatgacaagctcattttcagcctgcatctcaagcaaggtctctttcttgaccataatcccagcaatttccatcttggcaaggacaaaagccagaggttgctccatatcataaagaagctctaattgcccattttcgctgagtttttcaagtaaaataggctctgtttctaccaaaacagcaagtttacaagctaagtgttccaagaatttctcacgttcaggaatggcctttttaacacccttaccgtagaaagtttcatcatcaaccaagtaagtctgaccataaagactagcgatggtcgcaatttcattgtcctccacagtcgaaaggaggtatttagccaaacggatgtcaaaagcaggcgcctgcaaatccacaccaaaacgttgcaaaagaactttaaccttcttaaagtcataaactctcagagatgttttttctaagaaatccttgaaaatcgggtcttgcaacagctcaagcttgtctgtggcatagagcttatccccacaagaccagacaaatccaaccaaattatccgtatggtaattctcaccaaaaagctcaaagtggaagatagactcttcactcagcatatcttgactgatttggtcaacaatagtaaaatccaaactctcagacacatcagctgacgacacatttaaagcctgctttagctgtttgaagcccatctcatcgtagaatttcccaagattttcaacatctggaccactatagaccaagtcctctaaaccaatcgcaatcggtgccttggtatcaatggtcgctagtgttttagacaaaaaggcctgttccttgtcattgatgagattttccttcatcttagaagtcttcattccatcaatattttcataaatcccctcaagcgaaccatgctccagcaagagcttaatacccgtcttttcaccgactttggtcaccccagggatattatccgacttatcacccatgagcgccttgagatcgataaactgagctggtgtgaggcccatttcttccatgaggtaatctggcgtaaaggcctcaaactcagccacacctttcttggaaatttcaaccaccgtatgctcatccgtcagctgaatcaaatccttgtccccactgacaatagtaatatcaaaaccatcctgctctgctagcttatccagcgtcccaatgatgtcatccgcctcatactgagccagatcatagtgacgaatccccatatgatccagcaactcacgaatgaaaggaaattgctcacgaaactcatcaggagtcttggcccgaccacccttatagtccgcatacatctctgtccggaaggtcgtctttcccgcatcaaaagccaccaaaatatgactcggctcaacccgctccaataaatgactcaacatcaactgaaaaccataaatcgcattggtatgcaaaccagccacattcttaaaacggtccaactgctgatacagcgcaaaaaacgcccgaaaagctacagaagacccatcaatcaataataattttttcttatccatacacccattataaaggaaagaatcaaaaaataccattgggaagagctagagcaagtatttttcaaactttttccgaataaatagatagagccagagaatttagtaaacctagatttaaaaatgtgctataatatagtatattgaatctataatagtacaccttgactgctaaaatatttctataaattaatttgactttcctgatagagttattcacatcttatttcaactcactatagaaggaggaataggaggattctcagacatccgggcatcagcccaactaatgatttgattgctaagaaaatattcagcaatccagaaatcacttgtcaatttattcgcgatatgctggacttgccagcaaaaaatgtgaccattttggagggaagcgatattcacgtattactctccatgccttactcggtgcaggatttttataccagtatagacgtcttggcggagttggataacggtactcaagtaattattgagattcaagtccatcatcagaattttttcatcaatcacttgtgggcttacctgtgcagtcaggttaatcaaaatcttgaaaaaattcgtcagcgagaaggtgatactcactagagctacaaacacatcgctcctgtttacgccattgctatcgtggatagtaattatttctcagatgacctggcttttcatagctttagtatgcgcgaagacacaacaggtgaggtattggcgattaccaacaatggacaggaaaaccatctggttaagatggcattcttggaattaaaaaatacagagaaaccagcaaagacaaggttcgcaagccatggttggagtttttcggcaacaagccctttacccagcaaccgcaacgagccattacccaagcaaatcaactgctggactacaagagctggtccgaggaggacaggaaaatgtttagtcaactacatatgcgagaagaacaagtcttgttagcacaggactatgccttggaaactgctagggctgaaggccttgaacaaggactagagcgtgggaaagttgaaggaagggcagaaaggaaactttttgccttcctagacatagtacgccaaggtcttctgacttctgaggttgccagccagcaattaggtatgtcagtatctgaatttgaggcactgttgtaaaatggctccataatatccatagtgggtaaatcccctatggatattatggagcctattttgtgtagaaaaaaagtcccatatgacctataatgaaaagcgacaaaacaactcattagaaagaatcatatggaacaattacattttatcacaaaattactagacattaaagaccctaatgtccagattttaaacatcatcaataaggatacacacaaggaaatcatcgccaaactggactacgacgccccatcttgccctgagtgcggaaaccaattgaagaaatatgactttcaaaaaccttctaaaattccttatcttgaaacgactggtatgcctacaagaattctccttagaaagcgtcgattcaagtgctatcactgttcaaaaatgatggtcgctgaaacttctgatgacgtacagtcatatttcttctctttttattatatcacagttttaaatctagctttactagattcaccgctactatctatttattcggaaaaaagacgaaaaaacctgagaatcatctcaggcttggtcattaaatttttttctcaatatcgaaaagtggagaaagtggtcgtttttcatgaatacgtacgatagcatcccctaggagatgagcgattgaaatctgctcaatcttatcaatcaaacgctcttctggcagatagatggtatccaaaacaaccaatttcttaatagctgatttttggatattgtccgtagcaggaccagaaagaactgggtgcgtacagcttgcatagacttcaacagcaccagcttccgcaagagcatctgccgcatgacaaatcgttccagcggtatcaatcatatcatcaatcaagatacaagtcttgccttcaaccttaccgatgatattcataacttcactagtattcatcttatcaacgctacgacgtttatcaataatagcgatagatgttttcaaaaattctgccaacttacgagcacgagtcacccctccatggtccgggctgacaaccacatagtcagaaccaaccataccacgacgctcaaaataatctgcaatcagaggagcacccatcaaatgatccacaggaatatcaaagaatccttgaatttgcgcagcatgcaagtcgatggtcaataaacgatccactccagctacttcaagcatatttgcgacaagttttgaagtgattggctcacgcgctctcgcctttctatcctgacgtgcatacccatagtaaggcatgacaacattgacagattctgcactcgcacgcttcaaagcatctaccataatcaaaatttcaagcagattgtcatttacaggcgaactagttgattgtaagataaagacgtgtttcccacggattgattcttcaatgttgacctgaatctctccatctgaaaattggcgaacacttgatttccccaactctatcccaatctcctgcgccacacgttctgccaattctttattagaagaaagggcaaacagctttaaatcagaaaaagacatgatttcctccggtatatatgtataacttgtgcttttcacaagattttccatctaccattgtagcgctttttgcactatttttcaatcaaaaataaaagaagggcaccatatttgtacccttgcatcattcttttgaaaaatattctaggtcatcaactcattgtgtttctcaacaaagcaataagcatgataaaaaccatagagagcaatagccgtaaccactggaatcgctaaaggcaactctgtttccaactccacaaaaggagagttaaacaagaagtgagttcccaaggctaaacctagaaaaataaggccctgtttcttgccaaccttctgtcctttataggctctgtaaagcaagtaaacacctactacagctagacctgaaaaagtccagtgagaggcaattcctgagatgatacgctctaaaattcgcgaaatagtaaagtcaaagccctctggcaaatccgtacgaatataaccaatatccttaatcatttggaatcccaaaccggaagcaattccaagtaaaaacaaagattttaattttcgcacaggaatcaaagccaaaacaaaaacaagtgacaataatttcaagggttcttctaccaaaggagccgcaatagcactttcaaaggcatttaaaaatggactatctgggaaaagaacccccagtaaatcatggatataagtattagcaaaactagacaaccagcctgaaaggaacatccctcccaataaagacagaatcaaaaccttctttggcaattcccatttttcccaatacggaagagaaaataaagagccggaatcatgtaaaagagagctagaaagatagaaactcccattagtccatattccgcacctgacctcgaaccgtccgtatagtagatggtttcatactgtaaaccaatacatagcaataaaataaaaataaataaaatattgcttttcttcatacactttctttctaaatgaagtatttataattctacgactgtcatacttcctgtatcaacattgtaaatggcaccagagataatgacatcgtctggtattaggggagactcgataagcagttgcatatcctcgcgtacactctcttctatatcttggaagggcaagaagtcctggtctgacacatcgacacccaattcttccttcaaatactcctgaaaaggttcattttcaaaggtctgagcaccacagtctgtatgatgcaataccacaatttctcttgtccccatttgttgctgggaaataactagagaacgaatcatatcctcagtcactcgaccacctgcattccgcaaaatatgagcatccccaagtgccaaacctagagcttgcgcaacgtgcaaacgtgagtccatacaggtcacaatggctactctggttttaggtttaagtggcagatttaactgcccatgtagggcaacataagcctgattggcttgcataaactgttcaaaatacgacacgattccctccttgaaaatttgatagtcaaatatttctcctatcttatcatttttaagagaatttgtcacggattatgcaaagacctttttcaagacttcctgaatcgttgtcacgccaatgacctgaatttccttaggcagagtgattcctgtcaaggaattcttaggtacataaatcttagtaaagcccagtttagcagcttcgttgatgcgttgctcaatacgattcacgcgccgaatctctcctgtcaagcccagttctccgacaaaacattcctgaggattagttggcttgtctttgtagctcgaagcaatagcaactgcaacagccaagtcaatcgcaggttcatccaatttaacaccaccagcagatttgagataggcatcctgattttgcaagagaagccctgcccgtttttccaaaacagccataatcaagctagcacggttaaaatcaagtcctgtcgtagtacgcttggcatttccaaacatggtcggtgttaccaaagcctgaacctccgccaaaatcggacgcgtcccttccatggttacaacgatggaggaaccagtcgccccatccaaacgctcttctaggaaaacttgactcggattgagtacctcaaccaagccgcccgactgcatctcaaaaatcccaatctcattagtggaaccaaaacgatttttgaccgctctcaaaatacgaaaggtgtggtgacgctccccttcaaagtaaagcaccgtatccaccatatgctccaacatacgaggcccagccaaggttccttctttggtcacatgacctacgataaagatggcaatgttattggtcttggccaactgcatgagttcagcggtcacttcacgcacctgagaaacagacccctgcacccctgaaatctcaggagacatgatggtctggatggaatcaataatgagaaagtctggctggatacgctccacttctgcacgaacactctgcatattggtctctgcatagagataaaactcactatcaatatcacctaagcgctctgcacgtagtttaatctgctgggcagactcctccccactgacatagagaactgtccccacttgggacaactgggttgagacttgtaggagaagagttgatttcccaatcccaggatccccaccgataaggacgagacttcctggtaccactccgcctccaagcacacggttgaattcctccatctccgtcttggttcgattgacattgatggaagtcacctcagctagtttcatgggcttggttttctcacctgtcaaggacacacgcgcattcttaacttcggcaacctcaacctcttccacaaaagaagaccaagacccacagttggggcaacgtcccagatatttaggggaattatacccacaattttgacatacaaatgtcgcttttttctttgcgatgacaaacctctttctatatctctaactcacactcaatcacttggcaaaaatcaatcttctcatttggcacaaactggcgcatgagcattcgatgagcaacaactaccacagtctgatgttctcgatacttagacatacattctagaaaccgagacttcatttccgtagctgtctcatattgaataggactattaggaagcaactcccccttgttttctaaaaacagtcttctagctgtttcaaagttttctattcctgttttatagacctgccattcatgtaataaaggctctactcttaaaggaagacccgtagcacagaccacatacgaagccgtttctaaagctcttgtgactgcagaagatacgattatttcagctgacgagagtaaaggatttttgctcaatttctggacttgctgccgtcccatctcagacaagggtgccaaatctatcccaaatcctatataagaacgctcctctaactcacggtaatctggctccccatgacgtacaaagataatcttcattctagtgccctgtcgatccaaatccaccagttcgaacgccatcagctgcatctccatctgcaattaagaaagtagcaaaaacagcctggacaatacgctccccaacttcaagaacaacctcttggtctgtgatattcttcatctgcgcaaaaatatgcccttcatttccaggatttccataataatccccatcaatgactccaactgagttaattaaaaccaagcccttcttacgaggatttgaagaacgatcatagaggtagagaacctcagtcggctgcatataagccttaacccctgtcggaaccaagacaatctctcctggcgcaacaactgtacgcacagcaacctttaagtcgtaaccagtcgcatgcgctgtctcacgcttgggcaataaattttcatctgtaaaactcgaaaccaattcaaaaccacgaattttcataattttctcttttctattatcatttattctagattattctatacttattta

SEQ ID NO: 74 - DNA, 16535 bp; double-stranded, linear
tggttctgtccttatcggcgccttgtcttgcttgccatggctacaccaactatctcatccgacgaaagtacaccaaccactaacgaacccaacaacagaaatacaaccacccttgcccaacctcttactgatacagcagctggctctggtaagaacgaaagtgatatttcttcacctggaaatgcaaacgcttccctagagaaaacagaagaaaaacctgctgcaagcccagccgatccagcaccacaaactggacaagatcgttcaagtgagccaactacttctactagtccagtaacaactgaaactaaggcagaagagcccatcgaagataactacttccgtatccatgtcaaaaaacttcctgaagaaaacaaggatgctcaaggactatggacttgggacgatgttgaaaaaccatctgaaaactggccaaacggagctttgtccttcaaggatgccaagaaagatgactacggctattacctagatgtcaaattaaagggagaacaagccaagaaaattagcttcctcatcaacaatacagctggaaaaaatctaaccggcgataaatctgtagaaaaactagttccaaaaatgaacgaagcttggttagaccaagattacaaggttttctcttacgagccacagcctgcaggaactgttcgcgtcaactactaccgcacagatggcaactatgacaagaaatctctctggtactggggagatgtgaaaaatccaagtagcgctcaatggcctgacggaacagactttacggctacaggcaaatatggccgctatatcgacattcctcttaatgaagccgcaagagaatttggatttttattactagatgagagcaaacaaggagacgacgtgaaaatccgtaaagaaaattataagttcacagatttgaaaaatcatagccaaattttcctaaaagacgatgatgaatcgatttacacaaatccatactatgtccatgatatccgtatgacaggagcccaacacgtaggcacttctagcattgaaagtagcttttcaacacttgtcggtgctaaaaaagaagatatcctcaaacactccaacatcactaatcacctaggaaacaaggtaactattaccgatgttgcaatcgatgaagctggtaagaaagtgacctacagcggagatttctctgacacaaaacatccttatactgttagctacaattccgaccaattcactaccaaaacaagctggcgcctgaaagatgagacatacagctatgatggcaaactgggagctgacctaaaagaagaaggaaaacaagttgatttgaccctttggtcaccaagtgctgataaggtttctgttgttgtctacgacaagaatgaccctgacaaagtagttggaactgtcgctcttgaaaaaggggaaagaggaacttggaaacaaactctagacagcacaaacaaactcggaatcacagatttcactggctactattatcaataccaaatcgagcgtcaaggtaaaactgttcttgcactcgatccttacgctaaatctcttgctgcttggaatagcgacgattccaagattgacgatgcccataaagtggctaaagccgcctttgtagatccagctaaactcggacctcaagacttgacttatggtaagattcacaatttcaagactcgtgaagacgccgttatctacgaagctcatgtgcgtgatttcacttcagatcctgccattgcaaaagacttgaccaaaccatttgggacttttgaagccttcattgaaaaactagactatctcaaagacttgggtgtaacccatatccagctccttccagtcttgtcttactactttgtcaatgaattgaaaaaccatgaacgcttgtctgactacgcttcaagcaacagcaactacaactggggatatgaccctcaaaactacttctccttgactggtatgtactcaagcgatcctaagaatccagaaaaacgaatcgcagaatttaaaaacctcatcaacgaaatccacaaacgtggtatgggagctatcctagatgtcgtttataaccacacagccaaagtcgatctctttgaagatttggaaccaaactactaccactttatggatgccgatggcacacctcgaactagctttggtggtggacgcttggggacaacccaccatatgaccaaacggctcctaattgactctatcaaatacctagttgatacctacaaagtggatggcttccgtttcgatatgatgggagaccatgacgccgcttctatcgaagaagcttacaaggctgcacgcgccctcaatccaaacctcatcatgcttggtgaaggttggagaacctatgccggtgatgaaaacatgcctactaaagctgctgaccaagattggatgaaacataccgatactgtcgctgtcttttcagatgacatccgtaacaacctcaaatctggttatccaaacgaaggtcaacctgcctttatcacaggtggcaagcgtgatgtcaacaccatctttaaaaatctcattgctcaaccaactaactttgaagctgacagccctggagatgtcatccaatacatcgcagcccatgataacttgaccctctttgacatcattgcccagtctatcaaaaaagacccaagcaaggctgagaactatgctgaaatccaccgtcgtttacgacttggaaatctcatggtcttgacagctcaaggaactccatttatccactccggtcaggaatatggacgtactaaacaattccgtgacccagcctacaagactccagtagcagaggataaggttccaaacaaatctcacttgttgcgtgataaggacggcaacccatttgactatccttacttcatccatgactcttacgattctagtgatgcagtcaacaagtttgactggactaaggctacagatggtaaagcttatcctgaaaatgtcaagagccgtgactatatgaaaggtttgattgcccttcgtcaatctacagatgccttccgacttaagagtcttcaagatatcaaagaccgtgtccacctcatcactgtcccaggccaaaatggtgtggaaaaagaggatgtagtgattggctaccaaatcactgctccaaacggcgatatctacgcagtctttgtcaatgcggatgaaaaagctcgcgaatttaatttgggaactgcctttgcacatctaagaaatgcggaagttttggcagatgaaaaccaagcaggaccagtcggaattgccaacccgaaaggacttgaatggactgaaaaaggcttgaaattgaatgcccttacagctactgttcttcgagtctctcaaaatggaactagccatgagtcaactgcagaagagaaaccagactcaaccccttccaagcctgaacatcaaaatgaagcttctcaccctgcacatcaagacccagctccagaagctagacctgattctactaaaccagatgccaaagtagctgatgcggaaaataaacctagccaagctacagctgattcacaagctgaacaaccagcacaagaagcacaagcatcatctgtaaaagaagcggttcgaaacgaatcggtagaaaactctagcaaggaaaatatacctgcaaccccagataaacaagctgaacttccaaatacaggaatcaaaaacgaaaacaaactcctatttgcaggaatcagcctccttgcgctccttggtctcggtttcttactaaaaaataaaaaagagaactaaactagccctcctatagaaaaatcccccaagcattatagctcgggggattaatttttgtacaatatttgttgtcctaataaacttgattaggattttttattaagcctctttcatagcaaaataagctcgtactttgggtgcaacttgtgttccgaagagttcaatagctctcagaacctggtcatgaggcatagaaccaagcggtagatgaagcatgaagcggtccaatcctaaatcctctatcatgcgaatcaatttttcggccacctgatctggattgccaacaaacatggcgccatttggccctacctgctccaaatattgctcataacgcaattcctgccagtgcggacggtctttggaaatagcatccaccacttgcttagtcggatggaaataatctttcaccgcctgctcaccatcttccgcaatccacccccaagaatgggctcccactttcaagtctttgtcagcatggccccttcgcttccaatctcacgataagcctgaatcaactttttaaaataacgtggattaccaccaataatagcatatacaatcggtagaccagcctgagcaatcttcactgttgattcgacatgaccacctgtagctatccacaagggcaatttgtcctgaactggacgaggataaacttctttaccagcaatcgtttgagtcaatcgaccttgccagtctaacttggtcttttcattgactaactgaagcaagtctaatttctcatcaaaaagagagtcgtagtctttcaagtcataaccaaacagagggaaagattccgtgaaagagccccttccagccataatctccgatcgtccatttgacaaagcatcgatagtggcatactgttggaacaaacgaatcgggtccatgcttgacagaatgctgactgcactggtcaaacggattttcttggtattgactgccccagcggccagaacaatctctggggctgatactgcaaaatccgcccgatggtgctcaccaatcccatatacatccaaaccaaccttgtcagccagctcaatctctgccaccaactggcgaatgcgttcagcatgactgtaagtttgtccagtcccttcaagctccgttatttccccaaatgttgaaattcccaattctaccattgtgattctccttatctatctctgtacttcaatttgaaaaattattctaacacgaatcttgagtacaagcaaccgatttgctcattagaaaaagcctagataactagacttttttagcttattctaccgttactgacttggcaaggttacgtggtttgtccacatcgaggccacggtggagggttgcaaagtaagcgactaattgcgttggtacgaccattgaaattggtgagaggtatggatgtacggtcgtaaggacgatatcgtcggtatctttggctacattctcttctgcgatagtgaggactttggcaccacgggctgcgacctcttggatatttccacgagtatgattggcaagaactggatctgacaagagagccaaaacaggcgttccttcttcaatcaaggcaatggttccgtgcttgagttctcctgcagcaaagccttcacactggatataagaaatctctttgagtttgagacttgcttccatggctacgtagtaatcttgaccacgtccgatgtaaaaggcgttacgagttgtttcaagaagttcacgaaccttgacttcaatggtttctttctctgaaagagttgattcgatagactgagctacgattgacaattcatgaaccaggtcaaaggcttgcgctttagcattaccatttgcttctccgactgcttttgcaaggaaggcaagggctgcgatttgcgctgtataggctttagttgatgccacggcaatttcaggacctgcgtgaaggagcatggtatagttggcttcacgtgagagggttgaacctggaacgtttgtcactgttaagcttggaattcccatttcattagccttgaccaaaacttgacgactatccgctgtttcaccagattggctgataaagatgaagagtggtttcttgctgagaagtggcataccgtagccccactcagatgagattccaagttcaactggtgtatctgtcaattcttccaacattttcttagaagcaaatcctgcatggtaagatgttccagctgcaaggatgtagatgcggtctgcgtcttgaacagccttaatgatatctgggtctacgacaacttgaccagcctcatctgtgtaggcttggatgagtttccgcataacagttggttgctcgtcaatttccttgagcatgtagtaagggtaagttcccttaccgatatctgacaagtcaagttcagcagtgtagctagcacgctcacgacgatttccatcatagtcttgaacttccacactatcagccttgacgattaccaactcttggtcatggatttccatgtattggttagtttcacgaatcatagccatggcgtctgagcagaccatgttatagccttctccaagaccaatcaaaagtggtgatttatttttagctacgtagatgacttcaggatcttgtgagtcaaccaaggcaaaggcataagaaccacggatgatgtgaagggcttttttgaaggcttcaagaactgagagcccttcttcttccgcaaattttccaatcaaatgaacggctatttcagtatctgtctgccccttgaagtggtgacctgcaaggtattcttccttgatttcaagatagttctcaatcaccccattatgcaccaagacaaaacgttccgtctcagagcggtgtgggtgagcattgtcctcagttggttttccgtgagtagcccaacgagtatgtccgataccagttgttccctcaacaccagctgtcttggcagacaattctgcaatacgaccaaccgccttcaccaaatggttatcagcaccatctaggacaaaaattcccgcagaatcatagccacggtattcaagcttttcaagcccttgaatcaaaatatcagttgcatttgtgtttccaacaacaccaacaattccacacatagtatatacgacacaggcaagctgtgctttctccttaaaattggtatagtctaattcatcttttatagaatcagcaaaaacagtatatacttgtttctttcacttgtcaagagtaaaaattggtatagttcaaattaagctcctgtaagcataaaaactctgaccgattgggataatcagtcagagtcctttttaaaatccattattatcgcttaattctttgaaccagtggcctgatttcttcagacgacgttcttgcgtttccaagtctaattcgaccaaaccatagcgatttttatagctgttgagccatgaccagcagtcaataaaggtccaaatcaagtagcccttacagttggcaccatcttcaatggcacggtgaagttcacgaagatgaccttttacaaagtcaatacggtaatcatcttgaatcattccatcttgacggaatttttcttccccttcaacacccataccattctcagtcaacatccactcaatattgccataattttccttgatattttgggcgatgtcataaatcccttgctcataaatctcccaaccacggtgagaattgattttacgtccaggcatcacataaggctcgtaaaaatgttctggtaagagtggactctctggatgcttagcaaatcgaggagccataacacgcaaaggttgatagtagttcacaccaaggaagtccaccgtattatcacgaatgagttccaactcttcctctgtagcatcaggtaaaagaccgtgttcatgcaagatttctaccaactcctgtggataagtccccaagacagatggatctaagaaagattgggcctgaaaaagggccgcaatacgagctgccttgacatcagcaggatgctggctacgtggataagccggtgtcaagttgaggacaatcccaatcttggaatcaggcaaaagttcatggcaagccttaacagcccggctgctggccaattgtgtatgataggctaccttaacagctgcctctgcatccaccttatgtggataatgggcatcataaaaataaccaaattctacaggaacgatgggctcgttaaaggtaatccattgatccactaaatctccataagtctcaaaacaaaaacgagcatagtcttcataggctgagactgtcgccttattttcccaaccatcaccatcctcttgaagggcaaaaggtaaatcaaaatgatagagattgactaacagacgaattcctttagccttaatagcctcaaagaccttacgataaaaatccacaccttgagtgttgacttttccacagccttgtggaaaaatccgtgaccactgaatagaagtccgaaaggctgtgtgaccagtctctaacaaaagctcaatatcccgctcccaattttcataaaaagtcgatgtcttatctgaaccaatcccattatagtaacgatttggctccacttggaaccagtaatcccagagattgtctcccttaccgtcaccagctacacgtccttctgtctgcggtccagaagtagaggatccccagacaaaatcctttggaaatcttagcatacatttacctctttatctactcatttctcccattatacagaaaaaacaaggtaaaaactagttacattttttccttgtttttcttctgattatagtttttatttcttgcttaggatttcaagcgtttcaagcacgttatctgcatgaacctcaatggtgtcaccagttgccttgatcttaacttctacaatgccatcggccgcttttttaccaacagtgatacggattggaagaccaatcaagtcactatcgctaaatttaacaccgacacgttcgttacggtcatctgtcaagacttcataaccagctcccatcaagcttgcttcaagtttttctgtcaaggcttgcgcttcttcatccttgacattgacagtaatcaaatgcacatcaaatggtgccaattctttagggaaattgattccccaagcgtaacggtattcaccttttggcgttttgttaacaaagaggcgagcgtgttgctccatcactgctgaaagaagacggctgacaccgataccgtaacatcccatgatgattggcacagcacgaccattttcatccaagacatctgctcccatgcttgctgaatagcgagttccgagtttgaaaatatgaccgatctcaataccacgcgcaaagttaaggacaccttgtccatctggggaaatttcaccctcacgaacttcacggatatccacatattctgcagtaaaatcacggcctgggttcacaccagtcaagtggtagtcatcttcgttagcaccgacaactgcattgcgaacatcttgtaccttacgatctgcaataattttaatattctctggcaaaccaactggtccaagtgaaccaaatcctgcttgaacaacattcgccacttcttcttcgctagcaacgtcaaagaaatctgctcccaagtgatttttcaacttgacttcgttgagttggtcatttccaactagaagggctgcaacaagctcaccatctgcaatgtagaagagggttttaatcgtttgttcttctggaacattgaggaaggctgcaacttcatcaattgatttaacatctggcgttgcaacacgagtaacttcttcttcagcgacaacacggttgcttggtttgtactcgtttgttgccatttctaagttagctgcatagctagactcacttgagtaagcaatggtatcttcaccagagactatccatttgagcaattctgccttgatttcttcttgcacttctgcaggaatttcgtcaaatgaggcaactgacttgtccaagacaacccagcggtcaaggtctgtacgagcagatgtaatggccataaattcttggctatccttaccacccatggctccaccgtcaccaataatagccttgaagtctaaaccactacgagtgaaaatacgctcataggctgctttgtactcatcataaacactatccaaactatcatagttagcgtggaaactataagcatccttcatgataaactcacgtgtacgaagaagtccattacgcgggcgtttttcatcacgatacttgggctgaatttgataaaggttgagtggcaattgcttgtaagatttaacagaatcacggacaatagctgtaaaggtttcttcgtgagttggacctaagataaagtctgatttttcacggttttttagtttgtaaaggtcttcaccataggtttcgtaacgacctgattcacgccacaattctgcactaagaagggctggagccaacatctcaacagcaccaatcttttcgaattcttggcgcatgatgtttttagctttttcaatcacacggttggcaagtggtagataagaataaacacctgctgaaacttggcgaacataaccagcacgcaacataagagcatggctgataacttgagcatcgcttggcatttcgcgaagcgttgggataggcattttactttgtttcataatattcctcgattatctaaaaaagagtcgcataatgtcattccaagtcacagcaatcatcaagacaaccatgatgaccactccggccaaggtgacataggtttcaatttcttgtttcaatggtttgcggcggatggcttctaggatattgagcacaatcttaccaccatccaaggctggaatcggaataagattaaaaatcccaatattgatggaaatcattgccaagaagtacaagatattttcaattccatttttagcagcatcactacttgccttaaagatagcaacaggtccacccaacttgttcaaatctggttggaaaatcagatttttcagagctgagagaattcggagagctgagtcagcagcagttgtaaaaccacctacaaacatggatagaaaatctgacttaacccccggttgaacacctagaaggtaacgaccttgactatctttgggtgtaacagtgacttgtttgtcactccccttttcagaaatagtcacatccaaagtcggtgccgtcttatctttggtttctgtttccacagcttggatcaagctttcccagttgctaacctcatgtgagccaatcttggtaatttgtgccatttctggtactcctaccttggccaaggcaccttggggcatgatatggaactgattggtatcaacatctctgacaccaccctgcataaagattaaaacccaaaaaacaacgacacctaagataaaattgttcataggacctgcaaaattggtaatcagtttgccccagatagtcgcattttgatattgaacatctaaaggtgcaatccgaacctcagtaccatctgcttccacaaccgttgcatcgtgatccactgcaaatgttttttcttcttccagaaccaatcctttgataaagagcttgtcttcaaaatcaaactgggtcacctgcatagggagggctgtttgatccaattttttacctgagagattgatgcgtttaaccttaccatcatcagcaagtgtcaaactaacaggcgttcctgtcttgatttcagttgtatcatcaccccaaccggccatgcggacatagccacccagaggcaagattcgaatggtataggccgttccatccttgccaatgtgagcaaaaattttaggtcccataccgatggcaaattcacgtactaaaatccctgatttcttggcaaagtagaagtgaccgaactcgtgcaccactacaataatcccgaaaaccagaataaaggttaaaattccgagcatagcgtttcctccgtcttttgattaaaagagtccaaataagtgcatgattggaaatacaagcaacatactatcgaaacgatccaaaacaccaccatgtccagggataaatttcccagaatccttaacaccaaaatgacgtttgatcgaactttctagtaaatcaccaaattgtccagcaatgctaaagaaaatagcaaagactgacatcttgtaaattccatatggaagagcaactgtactgtcaactatcataaggataatggttactaaaattgctcctaaaataccacccaaggcaccctcaagggttttattaggcgatacccttggtgctaactttcgtttcccatagttcatcccaacaagataggcaccactgtctgtcgcccagacgatacacaaggctaagagagccttgtccaaacctgcaacacgagcatctagtaaagcattaaatccaaagcccacgtagaagctcatagcaagagggaaaaccgcatcctcaatcgtataagacttgctaaaaacggtcgttcctaacatgattgaaatcaaaacactataggcaaccacattcccatcaactggcaaaaaagtcaggtaattctccaagggaatggtcaatgcaaaggttgcaaagagggtcaagaggccctccatcgtcatggtctctagacctctcatcttcaaaagttcatgcatggctagcatggctatgattccgattgctatctgaagcaagaggcccccaatcattaaaattggtaggaaaatagccagggcaatccctgcaaacaaggttcttttctgtaaatcctgggtcatatttcctcctaaactcctccaaatcggcgatgacgacgattataggcaagaatagcttcctgcaaggccgcttcgtcaaaatcaggccataaggtgtccgtaaaataaagctcactataggctccctgccatggaaggaaattgctcaaacgtaattctccactagtacggataatcaagtctgggtctcgtaagtccttaggcaaatgctgagtaaagagatagttaccaatcaattcctctgtgatgtcacctgggttgattttggcatctaaaacatcctgggaaatcaacttaagcgcctgtgtaatctcagcacgtccaccatagttaagagcaaaattaagaatcaatcctgtgttgttcttagtcaattcctcagccttggttaaagcttcaaaggtttgcttaggcaggcggtctgtctccccaatcatttgaatcttaacattattcgcatgtagttccgggacataattatcataaaactctactggcaagttcatgataaacttgacttcctgatctggacgggtccagttttccgtagaaaaagcatagaccgtaataaccttgacgcccagtttgttggctgccttggtcacggtttgcaatgcttccatgcccgccttatgtccaaaaactcgcggttgcatacgttttttagcccaacggccattgccatccatgatgatgccgatatgagcaggaacctgtgtcggaacctctacttccacagccttatctttcttaaaaaatccaaacatgatcttattcctattcaaaaatctatcgtttcattataccatatttccccattttcttctatcactaagctatttattctcaggcaccaagcccatttttcaaaaaaataagccgcctgattgggcgactttatttttatagggagattattatgaaaaagttttaggagtttaagttaaggtcttcttaacttatgaacttagtgtacactccctagcttaaagtttccttaagtatttttaaaaatcaaatttttccatttctcctgccaatttttcttggataaacgtgtttgatagagttccattcggtcttcattttctaagaaatgaggagttggacgaacttgaaaattcaaaatatcctccaaaccataaggtacatagagttcaaaatctaattcttcattcaagcgcagtccaactgccgtacaccgttctggatacttactcatagcatcacgagaactggtataggaagcagtgtgaggactgtgctgatgcatatagacctgatttttcaattcccactggtactgaggaaaatcctctctcagctttttctccagtaataaggtttcctcataagaaaaatctggatcaaagaaaatcacatctatatctgtttcatgatcaaaaggggatttgtctgacaaaagattccagatgaaatttctgacagaacctgctgccaaccacgagtctttcaaaccaaggtctcggatgatcgtcagaatggccatcatatctggactttctctaaaagcctctaagatttcttgcttatttttcactgtattcataacctaagtgctcatatgccttagcagtcgccacccgtccagaccgtgtccgcatgataaaacctttttgaatcaagtaaggctcatacatgtcttcaactgtctcacgctcttcggcgatattcacagaaagagttcctagaccaacaggtcctccactgtacatctcaatcatggtgcgaaggattttttgatccacatagtccaaaccttcatggtcaacatccagcatagtcaaagccttatcggtaataacatcatcgataaccccattccccattatctgggcaaaatcgcgcacgcgcttgaggagacgattggcaatacgaggggttccacgactacgtagggccaactcagatgctgcctcatgggtgatttccatctcaaaaatatctgccgtccgctcgacaatttctgtcaagtcagcatgagcataatactccatatgacctgtaatcccaaaacgtgcccgtagtggatttgagagcataccagcccgagtcgtcgcaccaatcaaggtaaaaggaggcaactccaaatgaacactgcgactgccttcaccagccccaatcataatatcgatgtagaagtcctccatggcactataaagcacttcttccactgacatgggtaagcgatgaatctcgtcaataaagaggacatctccaggctctaaatcattcaaaatcgctaccaaatcacccgctttttcgataacaggaccagacgtttgcttgagattgactcccagttcattggcaatgacaaaagccatggttgttttcccaagccctggagggccaaataagagcacatgatccagcgcttcatcccgcattttagcggcttcgataaagatctgaagttgatccttaaccttatcctgaccaatatattcacgtaaatactgaggacggagcgtgcgttctactaactcctcatcacccatcatctcattatctaaaattctactcatggctctattatatcaaaaaaaacaagccacaaacaaaaaagccacctgattgggtgactcctaagtttagcacttatgtggtataatattatacggcacttctacaccgcctacgaaaggaggtgagatagcccatgatggaattagtactcaaaactattatcggaccaattgtggtcggtgtcgttcttcgtatagtcgataaatggctaaacaaggacaaatagtgtcaaaaaagacctcaagcttatttggtcgtgagcttggggtcttttctagcctatgatatagaactagtactcaattcctttttattatcccatagttcacgaattttgtcaaaactttacattttcttcaaccgctgtacgacaagacggttaagattaagagaacgttagggattctatcaatttcatagaaattttgatttcgtaaacgaagagacaatcttacatgtcacttctcatttaatacgccactactagacaagcaaaatcattattacagtagttccagtccttcaattaacagtcacttacaatcaaattgagtttgaactagctgaagcgaccacagacctatttcttagtcatattcgctaaaaaaatccccgccaaaatctcaaaaagtccccgccaattccccgaccaaaatccgaaaaataccgaaaaatatcgaaaaattatttttagaatagtcccaaaaatcctgaaatagagctaaaaaactccacctgattcggtggagttaagggagattattatgaaaaagaaaagtttaggattttattaaataaagttaggaggtctttatttaataactacatgatacaagacgaaacttaaaactagcttaacttttctaaaattttactattttgcaaaaaatttctatcaccagcacctcaccaatcgagtaggggataatctctagcccctctcacaccaccgtacgtgccgtttggcatacggcggttcaactaacttttaacgcatgtcgttcaaggtaataatccaaacacgaaaccagtccacgtttttccaggactggttttgatatagcacgtttaagtaccgacttctgagctactaattgataatggtcgccccagccagataccttatctgctatccatttaggaactcctaacttaagcaatccccataatcgtctcgatttcttcttccattgcttccagataatcactcgtaggcgagtacgcaagcgctcatctatgctggcgactatacttttcatatttcccaatgagcaatagtttatccatcctcgaatagacaaattcagttgctcaatacgtcttgttaggtctatactccatttcctctgtgttagtttcttcaatttaaacttaaatctccgaacactatcttgatgtggacggcttttccaaccatctgataatttccagaacccaaaacctagatatttcaactctcttggtcatgtttactttcaaacctagccgtttctcaataaacgactgactgaatacatc

SEQ ID NO: 75 - DNA, 8136 bp; double-stranded, linear
ccagagcgttgcgtccgaaagtctatccagacacggctctttaaaaacaaaaggagaaatgatgcatacttatttgcaaaagaaaattgaaaatatcaaaacaaccctaggtgaaatgtcaggtggttaccgtcgtatggttgcggctatggctgatttaggattttcaggaactatgaaggctatctgggatgacctctttgcccatcgtagttttgcccagtggatttatttgctggttttaggaagttttcctctctggctggagttggtttacgaacatcgtattgttgactggattgggatgatttgtagcttgacagggattatctgtgtaatctttgtatcggaaggtcgagcaagtaattatctttttggcttgattaactctgttatttaccttattttggccctacagaaaggcttttatggtgaggtgctgacgacactttacttcacagtcatgcagccaattggacttctagtttggatttatcaggcacagtttaagaaggaaaagcaggagtttgtcgcgcgtaaactggacggcaagggctggacaaagtatctttccattagtgtgctttggtggttggcctttggcttcatttatcagtctattggtgccaatcgtccctatcgtgattcaatcacagatgcaaccaatggggtagggcaaatcctcatgacagctgtttaccgtgaacagtggatattctgggcggctaccaatgtcttttcaatctatctctggtggggagaaagcctgcaaattcaagggaaatatctaatttatctcattaacagtctagttggttggtatcaatggagcaaggcagctaagcagaatactgatttacttaactaggaaaagatgtttgaaagtgctgttttgagatttcgattaaaacagatatagttgataatcaaggatttatagtatgaaaaagaggatcggcgggtcctcttttgttgttgaaaagataaaaaactcagtaacctagaaataagacaactgaagctttactctatattcaatttttaggaatgagaaggtctagataaaattggacaacttcctggtctgtgaaatcttgaccttttttgagccaccaggtcaatgtctcgataaagttggacatgaccaagtgttggaggtaagaagtaggcagattagggtgggcttcttttaaattatcagctagcacggaatagacatggtgttctagctctttatggagttgacggaggaagtagtcatttttggaaaatagcagactggtgatatggtcttggtttttatgaaaatggagaaagaggtgggcgaggtagtcctcggttgaaatggcttgctctctttcaaaaagatgatggaagaggtagcggcagagctggtccagaagaagctccttactctcatagtgacagtaaaaggtggatcgtcccacatctgcgagatcaatgatatcctgaacagtagtggcctcgtagcccttagcattcaaaagttgtataaaagcttgatagatggcttttttggttttgctgatacggcggtcaatgttagtcatatggacacttaaggcaaattgttcagaactgaataaagctgacgttttgcttctatcctttctttgagttttagtggataatgataatgaacaaggtgttcataaatctattataacaaaggaatgagaaatatgaaggcaaaatatgctgtttgggtggcttttttcttaaatttgacttatgccattgttgagtttattgcaggtggagtatttggttctagcgctgttcttgctgactctgtgcatgacttgggagatgcgattgcaattggaatatcagcttttctagaaacaatctccaatcgtgaagaagacaatcagtacaccttgggctataagcggtttagcctgctaggagccttggtaacagctgtgattctcgtaacgggctctgttctagtcattttggaaaatgtcacgaagattttgcatccgcaaccagtcaatgatgaggggattctctggttaggaattattgcgattactatcaatctgttagcgagtctggtggttggtaagggaaagacaaagaatgagtctattctgagtctgcattttctggaagatacgctagggtgggtagctgttatcctgatggcgattgttcttcgatttacggactggtatatcctagatcctcttttgtcccttgtcatttctttctttattctttcaaaagcccttccacgtttttggtctacactcaagattttcttggatgctgtgccagaaggtcttgatatcaagcaagtaaagagtggcctggagcgattggacaatgtggccagccttaatcagcttaatctctggactatggatgctttggaaaaaaatgccattgtccatgtttgtctaaaagaaatggaacatatggaaacttgtaaagagtctattcgaattttcctaaaagattgtggttttcaaaatattaccattgaaattgatgctgacctagaaactcaccaaacccataagcgaaaggtgtgtgacttggaacggagttatgagcatcaacattagaaaaaagtgaaaaatacttgggtactatcttatttggaatagagtaatttctttattatttaaatatttcaaaaattggtaagagaagagcattgtataaactccagatatatgattgttaatgataaaaatttttcgattagatacaaaatgcttgacttggagtcaactcaaagttatataataagataagtgagttagaatagcgtgaattcagtgaatgaaatgagaggaggttagcgtgtgaatattaaatctgccagtgatttgttgggaatttcagcggatacgattcggtattatgaacgggttggtcttgtgccaccgattactcgtactgctactgggattcgtgattttcaagatcaggatatcgaagcgctggaatttattaagtgttttcgttcggcgggtgtctctgtagatagtttagttgactatatgtcgctctaccaaaagggagatgaaacgagagaggagaggcttggtattttagaagaggaaaagcaaaaattagaggagcgcttgtctcagctacagacagctttaaatcgtttaaatctcaaaattaaactttataaggaaggaaaattttaaatgaaatcagcagtatatacaaaggcaggtcaggttggacttgctagcattgaacgtccgcaaataatagaagcggatgatgtgattattcgtgtggttcgtgcgtgcgtttgtggttcagatttatggaggtaccgtaatccagaaacgaaagctggacacaaaaatagtggacacgaagcgattgggattgttgaagaagctggggaagccattacgacggtgaaaccaggtgattttgtgattgtcccttttacacatggatgtggtgagtgtgatgcctgtcttgctggatttgacggttcttgcgacaatcatattggcaataatttggggggtgattttcaggcagaatatattcgcttccactatgcaaactgggcgctggttaaaatccctggtcaaccttctgactatacagaagggatgctcaagtcccttttgactcttgcagatgtcatgccgacaggctatcatgcggcgcgtgttgcaaatgttcaaaaaggggacaaggttgttgttatcggtgatggggctgttggtcaatgtgctgtcatcgcggctaagatgcgtggagcatcacaaattatccttatgagccgtcatgaagaccgtcaaaagatggctatggagtcaggtgcgacagctgttgttgcagaacgtggtcaagaaggaattaccaaggtgcgtgaaatcctcggtggaggagcagatgcagcacttgaatgtgttggtacggaggctgctatagaacaggcgctaggtgttcttcataatggagggcgtatgggctttgtaggagtcccacactataataatcgtgctcttggttcgacatttatgcaaaatatctctgtagcaggtggggcagcttctgctacaacatacgataagcaatttttactaaaagccgtccttgatggtgatatcaatccaggtcgcgtctttacttcaagttataaactggaagatatcgaccaagcctataaagatatggatgaacgtaagacaattaagtctatgattgtaatcgaataaaaaacgaataggagttttagaactctattcgttttttatgttatcctattcttgatttagggtactttctcttaatgtcagtctggttcccagcatggtcaggctagggattttccgaccgtggaggacttccttgttaagaatatccatacctgctcggcccatttcttcagtataaactgtaatactagagaggggaggatagacctgtttggtcagactagtgtcgttaaaggaaatgaggctgacgcgatctggcaggctgattccagcttcttggagggcacggagggcaccgatagctaaactatcgctggctgcgaaaaatgctggcggaagttggtctcccaagctctgaatggcctccttcattaagtcatagccagactgggcagtaaatcttccttgaaagaccagttcatcatgatagattcccctcgcttgactatagtttttgaagttttctagacgcttgtcctgaatgatttcttcttggtctgttgtttcttcaaggcctgttagaatcccgatacggtccattccttgactgaggaaataatcgacaacctgtttcatagcagtgtaaaaatccgtgataatacaggtatgtcccagggaaagtgtatcgctgtctagaaatacaagaggcttttggtattcttcaaaggcagaaatctgagctcgactaaactttccgatgcagagaatcccaatcacttcctcgcttagggtaaaagggtggtcattaaaatagcgcaagatatcatagtccaactcttgggctcttttttctattcctaggcgaatctggtagtagtagaggtcgtccagctccccttgttcgctgacccattggataatggcaatcttttgcttgggtttgtgggactcgcctgtcttgaggtgcttggtgtagcccagctcttcagcaacggttaaaatacggtgtctggtttcttctgtaacagataggctctggtcgcggttgaggacgcgggatacggtcgcgatagagacagaggctagctgtgcaatgtcttttaaggtagccataaatcctccttgattaggttagtatatcatgtttttcttctttttactgatattttactaaaattttagtaaaaaggattgaccttggaaaattccttggatataatagaaagaaaacgattacacgttaagatggcttaacggacagtcaaaggagaattcatatggcacaacatcttactactgaagcccttcgcaaagactttcttgctgtttttggtcaagaagcagatcaaaccttcttttcaccaggccgcattaatttgattggtgaacacacagactacaacggtgggcacgtttttcctgctgctatttccttgggaacttacggtgcagctcgtaagcgtgacgaccaagtcttgcgtttctactcagctaactttgaggacaagggcattatcgaagtgcctctcgctgacctcaagtttgaaaaagagcacaactggaccaattatccaaaaggtgtccttcatttcttgcaagaagctgggcacgtgattgacaaaggttttgatttttatgtttatggaaatattccaaatggtgctggcttgtcttcttctgcatccttggaactcttgacaggagtcgtggctgagcatctctttgatttaaaattagagcgtctcgatttggttaaaatcggcaaacaaacagaaaacaactttatcggagtaaactctggcattatggaccagtttgctattggtatgggggcagaccaacgtgctatttacctagatactaatactttagaatacgacttggtgccacttgatttgaaggacaatgtcgttgttatcatgaacaccaacaaacgccgtgaattggcggactctaaatacaatgaacgtcgtgctgagtgtgaaaaagcagtggaagaattgcaagtttccttggatattcagactctgggtgaattggacgagtgggccgttgaccaatatagctatctgattaaagatgaaaatcgtttgaaacgtgctcgccatgctgtgcttgaaaaccaacgtaccctcaaagctcaagtagcactccaagcaggagatttggaaacatttggacgcttgatgaatgcgtcacacgtttctctggagcatgattatgaagtaactggtttggaattggatacccttgttcacacagcttgggcacaagaaggagttctcggtgctcgtatgacaggggctggttttggtggctgtgccattgccttggttcaaaaagatactgttgaggcctttaaggaagctgtaggcaaacactacgaggaagtagttggatacgctccaagcttctatatcgctgaagttgcaggtggcactcgcgtccttgactagtcaaaaggaggctctatagtgaccttagtaaataaatttgtaacacatgtcatttctgaaagctcatttgaggaaatggatcgaatctatctgaccaatcgtgttttggcacgagtgggagaaggtgttttggaagttgagaccaatctggataaattgattgacctcaaggaccagctggttgaagaagccgttcgattagagacgattgaggatagtcagactgcgcgtgaaatccttggtgctgaactgatggatttggtgactccttgtccaagtcaggtcaatcgtgatttttgggcaacctacgcccactctccagaacaagcgatagaggatttttaccaactcagtcagaaaaatgactacatcaaactcaaggccattgctagaaatatcgcttatcgtgttccatctgactacggagaacttgaaattaccatcaatctctctaagcctgaaaaagatcccaaagagattgtggcagccaagttggtgcaagctagtaattatcctcagtgtcagctttgtctagagaatgagggctaccatggtcgagttaaccacccagctcgtagcaatcaccgtattatccgttttgaaatggttggtcaggaatggggtttccagtattcgccctatgcttactttaatgagcattgtatctttttagatggccagcatcgtcccatggccattagtcgtcagagttttgaacgtctgttggctatcgtagaccagtttccaggatattttgctggatctaatgccgacctgccgattgtggggggctctattctaactcatgatcattatcagggaggccgtcacgtatttcctatggaattggctcccttgcaaaaggccttccgatttgctggttttgagcaggtcaaggctggaattgtcaagtggcccatgtctgtcctacgtttgacttcggattccaaagaggatttgatcaatttggctgataagattttgcaggaatggcgccagtattcagatcctgcagtgcagattttggcagagacagacaggacaccgcatcacactatcacacccattgcccgcaaacgcgatggacagtttgagttggacttggtcttgcgagacaatcagacttcagcagagtatcctgatggtatctatcatccccacaaggatgtccaacatatcaagaaggaaaatatcggcttgattgaggtcatgggcttggcaatcttgccaccacgtctgaaagaagaagtggagcaagtcgctagctatcttgtaggagaagctgttacagttgccgattatcatcaggagtgggcagaccaactcaaatcccaacatccagactaacggataaagaaaaagcccttgcaatcgtcaaggactctgtgggtgctatctttgcgcgtgtacttgaggatgcaggagtctacaagcagacagaacaagggcagacagcctttatgcgctttgtggaacaggtcggaattttactagactaggagctttctcgg

SEQ ID NO: 76 - DNA, 10011 bp; double-stranded, linear
cccatagtgaagagtggccataagaaggtcttctaggcttaatttaggttttcgtccaccttttgcgtgtttaagttgataagctgtttttaacacagctgaacatctcttcaaaagtcgtgcgctgaacaccaacaagacatttaaatcgtgtatcagttagttgtttacttgcttcatcattcatagaactactataccatgttttgtttcgcaggaagtctaatattgtcaaatactggaacgctcattgctgggatacggaataagattggcccagcttcgataactgggatacctggttcaaaaccaaggtctgttgcagcgattggtgtaaagatatcgtaacctttcataaggtcttcgtttacatctttcaccataactgcatcacagtgaacatcgtaaccacggtttgaaagttcttcttctagagcacttttaatttggtgacttgagttaacacctgcaccgcaggcagcaagaattttaatcatttggatttcctccgattttattttttaatagacaagattaagcggttgcttcagcaatgtaagcataaagggcttctggttcagaaatttttgataggtcttcaagatgaccatttcctgtgaagaagtccattaactgagcaagaatgttcgtttgacttgaacttgaattattgatgataaagaagagcaaggatacttctacttccttacctggcgcaatcatattatggaaagtcaccggtttctctaatcgaacaaccaccactttctcagctagattatgaacaatatctgtgtgaggaatcattacatttgcaagtcctttcctagaaattccatatataaaccagttggaaatgacttttcacgcgtgatcaaggcttcacgataagttggagtgacaatttctcgttcttccaacaagcttgctacctgatcaaaaagttattcttgattatccgcttctaagcaaaacacaaggtttttgtcaaagaaataatctaataccataaggttttcccttctttccattaactttatgctataagtataacactatatgaaatcgttgttaattactttctattcttttttgtctctttttttatatttttgttttgtttatagtttgttatataaaaataaacacacaaacaaatactccaagcatttttctgttctaatactcaatgaaaatcaaagagcaaactaggaagctagccgcagttgttcaaaacacagttttgaggttgtagatgaaactgacgaagtcactcaaaacatggttttgaggttgtagatgaaactgacgaagcaacagccatacatacggtaaggcgacgctgacgtggtttgaagagattttcgaagagtataaaaactaaaaaagcagaccatctaagcctgctttactattgattcttatataaatttcctgtgaacaaggaaaggcatttctgataacttattcttcatccatactcaagacgctgaggaaggcttcttgcggaacttcaactgatccgatggatttcatgcgtttcttaccagctttttgtttttcaaggagtttacgcttacgagaaacgtcaccaccataacatttagcaagtacgttcttacgaagggccttgatatcagtacgagcgacaatcttgtgtccaatagccgcttggattggaacttcaaattgttggcgagggatgattttcttgagtttatcaacgatgagtttcccacgttcgtaggcaaagtccttgtgaacgataaagctgagggcatccaccttatctccattgagaagaatatccattttcaccagcttagatgggcgatattctgacaattcgtagtcaaagcttgcataaccacgtgtcgaagacttaagtttatcaaagaagtcaaagacaatttcagcaagaggaatttgatagataacattgacacggttatcatcaatatagtccatagtcacaaagtccccacgcttacgctgagctagctccattactgctccgacgaactcctgtggtaccatgatttgcgccttgacataaggctcttcaatggtcgcaatcttagttgggtctggaaactcagatgggttagacacatccatagactcaccgtcggtcaaattaactttgtaaataacagacggagctgtcatgatgaggtcaatattgaactcacgctctaaacgttcctggataacatccatatggagaagtccaagaaatccacaacggaaaccaaatccaagtgcctgagatgtttctggttcaaactgaagactagcatcattcagttgcaatttttcaagcgcttcacgcaggtcattgtacttgtttgattcgattgggtagagacccgcaaagaccataggattcatctgcttataaccatgtaatggttctgccgcaggattggttgccaaggtaacggtatcacccacacgagtatcctgaaccgtcttgatagacgccgcaatgtaaccaacatcaccagtcgcaaggaaatcacgaccaaccgcttttggtgtaaaaataccgacttcggccacatcaaaggtcttactattgctcatgagctgaatcttatcaccaggtttgaccactccgtccatgacacgcacttggaggataaccccacggtaagcatcgtaaacagagtcgaaaatcaaggccttaagtggcgccgtcacatcacccgttggtgctggtactttttctacaatttgctcgaggatttcttcaatcccaataccagccttggcagaagccaaaactgcttcactggcatccaaaccaatcacatcttcaatctctgtacgcacgcgctccggatctgcagccggcaggtcaattttattaatgataggcatgatttccaaatcattatccaaagccagataaacgttggcaagagtttgagcctcaattccttgagccgcatcgaccaccaaaatagcaccctcacaggcagctagcgaacgtgaaacttcataggtaaagtcaacgtgccctggtgtgtcaatcaagtggaaaatataagtttccccatcttttgcagtgtaattcaactcgatggcattcaacttaatagtaattccacgttcccgctctagctccatgctatccaaaagctgggcctgcatttcacgacttgaaaccgtctctgttttttccaaaatgcggtctgctagagttgattttccgtggtcaatatgggcgataatagagaagttacggatcttctcctgtcgttttttcaattcttctaagttcatgattctcttcctttcagggtatctatttattataaattgtttttgatattttgacaagaccataccctgctaggagtactaatcttcagcgacaaagccgtcattttcgataaagtggtgttctgtcattccttggtctgtaaagacaatcccgtgaaggacaccaccataaacagctcctccatccattccaatcttgccatcttctgtagtccaaagctcagatgtaccgcgttcttgctgtaacaaaccatagaccggtgtatgaccgaagacaatggtttttccagtatgattttcagctccgtggaatggttttctaagccatacttttttataatctgttgtttcatgccagtcgtccaaggtcaaatcaatacctgcgtgaacaaagatatacttgtctgtctctactacaaatggcatttgacgaatgaattcgaccaagtctgccgcttcagcggcaacccgcttggcatcttctactccatcaactggtgcatccaagggacgacctaggatagagttaatggttgtatctccaccattgcgactataatggtcataactttcttctgggtcatctagccaagtcaaaaacatatactcgtggtttccggacaaacagatagccccttgattgtccaccaagtccttgaccatttcaagaacacggtgactatcctcacctctgtcaatcaaatcacctagaaagagcaactggggctgaccatcccaggttttgagaaggtcttccagcatcccagcttttccgtgaacatctccaattacataataatctgtcatcttatttctccctgtttctcaacaattctcttgcttgcgtcagggctgcttctgtcacatcatcacctgccaacatcttggcaacttcctccactcgctcttcgaccgtcaagagacgaacagtcgaaaccgttgaatggtcattactaatcttctcaataaagaattgataatctgcaatcgcaattacttgtggcaaatgggagatagccaaaacctgaccatgctgaccaattttatgaattttctgagcaatagcttgagcaacacgacctgaaactcccgtatccacctcatcaaagacaatgctagtcttgccttctttacgtgaaaaggcagacttaatggctaacatgagacgagataattcccctccagaagcaaccttaaccaagggtttaaagtcttctccagggttggttgaaatataaaactcaaccattttatttccctcacgactgaattttcccttactaaaacgaacctgaaactgggctttttccatataaagatcttgcagttcttgtttaatctcagcttcgagttgctgagccaaattatgacgagcagaagcaagttgacctgccaaattgacaagattgacttccaacttcttaagctctgcttccatgtcctcagacgaaagattattgcctgtcaagagattgtattcttccgtaatcttggcaaaataaagcaaaacatcatcaacagtcccaccatacttacgagtaatagtatgaaggaggtccaaacgattctcaacctgcatcaggcgattgccatcaaaatcaaggtcctcaatgatagcttccaaacgtttgctaatgtcttctaaaacatagtaggtctcagacagatagcttgaaatttcacggtattcaggatcatactcttcgacactttccatgtcattcatagctgaacgaacattggccagacttgaaaaatcttcattgtccaacatactgtaggcattggtcagtgtatccgcaatatttttgtggttgaggagtttatctcgctcttgattgagagccaagtcttctccagcctgcaagtttgctgcctcaatctctgccatttgaaattccaacatttcgatacgtgccttgtgttcctgttggtttttcttgacttccagaacctgcttgcgcattttccgataggcatcaaaactcgtttgataggtttctttcaagtcccaaaaagcggcatcaccaaattcatccaacatctggatatgcagttggggacgcattaactcctcatggtcatgctgaccatgaatatctacaagatgttgcccaatagctcgcaaaacagacagattaaccatctgaccatttacacggctgatactacgaccattttgcaagatttcccgacggatgataatttcatcacctaattctaaaccttgctcatcaaaaatttcctgtaaaagacgactattctcaactgagaaaagcccctcaatctctgcctttggtgcaccatgacgaataacatctgtcgtcgcacgagctcccaacatcatattcatggcatcaatgataatcgacttccctgcacccgtttcaccagtcaggacagtcatccccttttcaaaattgagggaaatagcctcaataatggcaaagttttttatcgaaatttcaagtaacatatagacctaccaattttttacttgttcaaagatttcctctgctagacttccacttctggcaatgactaaaatcgagctatcatcagtcaaacagctaaaaatcttgtctgcaaaagtctcgattaactgagcttttacaaaagccgtatttcctggaataacttggagattgatcatcttatccatcaattcagccgattcgatattgtcttcagccagttgcagactttttacgattgattttggcaattcgtagacataggtgttgtctctcaaaggaattttgacaatacctaactctttgatatctcgggataccgtcgcctgagtggcagtgatacctgcttctttcaaatgttctacaatttcttcttgcgtgccgatttgataatctgtcaccaatcttctaattttttcaagtctctcttttttattcatttttaaattgactatgcgccctctctactgcttctttaatctcagcaagaatctgattgcttgctgacttttcttttttcaaatacgctaaaaattcaatatttccatgtccaccttggatgggagaaaagtccaagccaaggactgaaaaacctacctctactgccatagctgttacagattcaaggacattctgatgaaccttagcatctcgaataattccatttttcccaatctgctcacgtcctgcctcaaactgaggtttgacaagtgctaccacctgaccttgatcagccaagacacggtgcaaggctggcaaaatcagactaagggaaatgaaactcacatcaatactggcaaagctcggctcctgctcgaaatcagtcttttcagcatagcggaaattgaactgctccatgctgacaactcgtgggtcttggcgtaatttccaagccaactgattggtaccaacatcgactgcaaagaccaacttggcactattctgtagcatgacatcggtaaaacctccagtagaggccccgatatcaatcgtagtcgcgccatccaccgacaaatcaaagacctgcaaggccttttccagtttcaaaccaccacggctgacatacttgagtttctcccccttgagttttaattcggtgtcatctggaattttctctcctggcttgtcaaaccgttctccattaaggactgctacgactaggccagccatcacacctcgcttggcctgctctctcgtttcaaacaacccctgtttataagctagtacatccactctttccttagccattgattctcaaactttctactacacttacaatcgattctgtttcaaagggaagctgctgggcaatttcttctaatttttcattagcttgatccagggtttggttacaaaaggcaatggactcttccaagcccaacagggcaggataggttgatttttctgcctgcagatccttttgaggtgtcttgccgatttcctcaaaactagctgtcacatccagtacatcatctctgacttgaaaagcaagtccaatcaattcacccacagttttcagcttcacctgcatttcaggtgacaattcagctataatagctgccgcttggaagggataggctagtaacttcccagtcttattggcatgaatagtctgaagttcttccaaagacaagtgctggtgttcgccctccatatccaaaacttgccctgctaccatacccagactacctgaagcaagggataagttggcaatcaagtccaccttaatctgacttggcaaatctgcctgcgcaatcaaggcatatgagtctaagaataaggcatctccagccaaaatggccatagcttcaccgaatttcttgtgattggttaaccgccctcttcgataatcgtcatcatccatagcaggaaggtcatcgtgaatcaagctccctgtatgaatcatctctaaggcagtagctacctgcgcgtgagcaggtttgatggtaacctgcaaggcttccagaacttctaacaagagaaaaggccgaatacgcttgccaccagcatgaatagaatagagaacagactcccgtaaactagaggcaaactgctggtctccataaaaatcttccaaagccgactcgacaagagctaatttttcttgctttttcattcaaaatcactttctgttccgtcttcttgcatgaccttgaccaaggtcttttcagccttgtccagcgtagcttggagctcttttgacaagaccatgcccttttgaaaggcagtaatcgcatcttccagagcaatttcaccattttccaaactttggacaatggtttccagttctgctagattttcctcaaatttcttttgttttgacatctttaacctctaattctacttgaccatctcgcatcaaaagcgttacttggtcttttttcttcaaactctcaaccgaatctacaacggactcttcttttttgacaatagcataaccacgcgccacgattcggctagtatccaacatgagcaaagcttccgaaagtcgcttggcctcagcaaccttggcgtcataaactaacgccatttggctacctaagagcttgtccaactgtcctaaacggtcttgatagcgttggattttggtaacaggtgataattgtactaattgatgagttcttgcttgaactaattgtttgttatcagaaatccgagttcgcaaactttgtttcaaacgcagttgcagttggtccaagcgttgcaaataaccgtcatacaagcgctcaggttgtctaaagataacagactgactgcattttttcaaagcctcttgtttcttagatagaacatttcggactgccgttaccatccgtttttcctgattttgcaaatgagctaatacatccaacttggtcacaggtgttgccagttcagccgccgctgttggcgttgcagcgcgtcgatctgccacaaaatctgccaaggtcacatccgtctcatgccccacactagagataactggcaaacgagattcaaaaatagctcgtaccacaatttcttcgttaaaggcccagagatcctcaatagaaccacctccacgaccaataatgagcaaatccaaatcgtcccgttgattagcacgcgcaatatttctagcaatttcctccgcagccccttcaccttgaaccttggtcggataaagaaggatgtcaacacctgggaatcgcctgctgacggtcgtgataatatctcgaataacggctccactacggctggttactacaccaattctcttagaaaattggggcagagcttgcttgaagcgttcttgaaacaggccttcttctgtcaattttttcttaagttgttcaaactgaatcgcaagcgccccaaccccatcaggctcagctttttcaatgatgatggagtagctaccacttggttcatagacctgtacacgcccaatcacattgatcttcattccttcttccaggtcaaaccctaatttctgataaatcccagaccagatggtcgcttgaataactgcatggtcatcctttagggagaaatattggtgagtaggtcgtttacgaaagttggaaacttgaccagttaaatagacccgttccaagtatgggtctttatcgaatttcattttcagatacttggtcaaagttgttaccgataaatacttttccatctccacctactattcatttacttgctctttcatgggtattattataccaaaaatatgcctaaaaatctccatttatgtaccattatgagggaaaaatagaaaaaggaggcaaggcctccacatgtgattatttgctgtttcgagcttcttccaaaatctttgcaatcttggtcgtcaacaggtcgatagccacggtattgctaaccccttcaggaatgacgatatcagcataacgcttagttgactcgataaactggtggtacattggtttgaccacacctaagtactggttaataacgctatcaaggctacggccacgctcctccatatcacgcttgatacgacgaataatgcgcacatcgtcatccgtatccacaaaaatcttgatatccatcaaatcgcgcagacgcttgtcctccaagaccaaaataccctcaacgataaagacatcttgaggttcctgacgataggtcttgctactccgtgtatgctctgtatagtcgtaggtcgggatgtccaccggacgccctgccaacaattccttaatctgctcgatcatcaagtctgtatcaaaggcaaaaggatggtcatagttggttttgacgg

SEQ ID NO: 77 - DNA, 5365 bp; double-stranded, linear
cgtgtggtcttaaaaatagaagacaaagaacaaactgttggaggctttgtccttgcaggctcagcccaagaaaaaaccaaaacagctcaagttgtggctactggacaaggtgttcgtaccttgaacggtgacttggttgctccaagtgttaaaactggagatcgtgtcttagttgaagcccacgcaggtcttgatgtcaaagatggcgatgaaaagtacatcatcgtaggcgactaacattttggcaatcattgaggaatagaaggagaaagtaagtatgtcaaaagaaattaaattttcatcagatgcccgttcagccatggttcgtggtgtcgatatccttgcagacactgttaaagtaaccttgggaccaaaaggtcgcaatgtcgttcttgaaaagtcattcggttcacccttgattaccaatgacggtgtgaccattgccaaagaaatcgaattggaagaccattttgaaaatatgggtgctaagttagtatcagaagtagcttctaaaaccaatgatatcgcaggtgacggaactacgactgcaacagtcttgacccaagctatcgtccgtgaaggaatcaaaaacgtcacagcaggtgcaaatccaatcggtattcgtcgtgggattgaaacagcagttgccgcagcagttgaagctttgaaaaacaacgccatccctgttgccaataaagaagctatcgctcaagttgcagccgtatcttctcgttctgaaaaagttggtgagtacatctctgaagcaatggaaaaagttggcaaagacggtgtcatcaccatcgaagagtcacgtggtatggaaacagagcttgaagtcgtagaaggaatgcagtttgaccgtggttacctttcacagtacatggtgacagatagcgaaaaaatggtggctgaccttgaaaatccgtacattttgattacagacaagaaaatttccaatatccaagaaatcttgccacttttggaaagcattctccaaagcaatcgtccactcttgattattgcggatgatgtggatggcgaggctcttccaactcttgttttgaacaagattcgtggaaccttcaacgtagtagcagtcaaggcacctggttttggtgaccgtcgcaaagccatgcttgaagatatcgccatcttaacaggcggaacagttatcacagaagaccttggtcttgagttgaaagatgcgacaattgaagctcttggtcaagcagcgagagtgaccgtggacaaagatagcacggttattgtagaaggtgcaggaaatcctgaagcgatttctcaccgtgttgcggttatcaagtctcaaatcgaaactacaacttctgaatttgaccgtgaaaaattgcaagaacgcttggccaaattgtcaggtggtgtagcggttattaaggttggagccgcaactgaaactgagttgaaagaaatgaaactccgcattgaagatgccctcaacgctactcgtgcagctgttgaagaaggtattgttgcaggtggtggaacagctcttgccaatgtgattccagctgttgctaccttggaattgacaggagatgaagcaacaggacgtaatattgttctccgtgctttggaagaacccgttcgtcaaattgctcacaatgcaggatttgaaggatctatcgttatcgatcgtttgaaaaatgctgagcttggtataggatttaacgcagcaactggcgagtgggttaacatgattgatcaaggtatcattgatccagttaaagtgagtcgttcagccctacaaaatgcagcatctgtagccagcttgattttgacaacagaagcagtcgtagccaataaaccagaaccagtagccccagctccagcaatggatccaagcatgatgggcgggatgatgtaagctttctatagaaaacaacttataaaaaacacaaaaggagggaatgactaacccttctttttataggctctttgtcaactgtagtgggttgaagtcagctaagctcgagaaaggacaaatttcgtcctttcttttttgatgttcaaagcgataaaaatccgttttttgaagttttcaaagtttcgaaaaccaaaggcattgcgcttgataagtttgatgagattattggtcgcttccggtttggcgttagaatagtgtagttgaagggcgttgataatcttttctttatctttgaggaaggttttaaagacagtctgaaaaataggatgaacttgcttaagattgtcctcaataagtccgaaaaatttctccggttccttattctgaaagtgaaacagcaagagttgatagagctgatagtgatgtttcaagtcttgtgaatagctcaaaagcttgtctaaaatctctttattggttaaatgcatacgaaaagtaggacgataaaatcgcttatcactcagtttacggctatcctgttgtatgagcttccagtagcgcttgatagccttgtattcatgggattttcgatccaattggttcataatttgaacacgcacacgactcatagcacggctaagatgttgtacaatgtgaaagcgatccaacacgattttagcattcgggagtgaaacagtctgggagactgtttcagcctgagcctagaaatttgaaagcgaagctgtttagccaagtcatagtaaggactaaacatatccatcgtaatgattttcacttgacaacgaacggctctatcgtagcgaagaaagtgatttcggatgacagcttgtgttctgccttcaagaacagtgataatattaagattatcaaaatcttgcgcaatgaaactcatctttcccttagtgaaggcatactcatcccaagacataatctttggaagccgagaaaaatcatgctcaaagtgaaagtcattgagcttgcgaatgacagttgaagttgaaatggccagctgatgggcaatatcagtcatagaaattttttcaattaacttttgagcaatcttttggttgatgatacgagggatttggtgatttttctttaccaggggagtctcagcaaccatcatttttgaacagtgatagcacttgaaacgacgctttctaaggagaattctagaaggcataccagtcgtttcaagataaggaattttagaaggtttttgaaagtcatatttcttcaattggtttccgcactcagggcaagatggggcgtcgtagtccagtttggcgatgatttccttgtgtgtatccttattgatgatgtctaaaatctggatattagggtctttaatatcgagcagttttgtgataaaatgtaattgttccatatgaatctttctaatgagttgttttgtcgcttttcattataggtcatatgggactttttttctacaacaaaataggctccataatatctataagggatttacccactacaaatattatagagccgaaaattcacatctaatatatgcagactactttgaaatgaaattaaaaaaattattaaaggatgacacaaaagtttttgaaaaatctacattcaaatttgtagaaggatataaaatatacctgacagaatctaaagaatctggaattaaacaaatggacaatgtcataaaatattttgagtttattgaatctaaaagtattgctttatattttcaaaaacgattaaatgagctgatagattaaatagcattttctctgttgagatattgtttttaaaatattgtactaaatgattgatgctatgtggaaatacaaaaaaatgtttttgatacgaagttgacctgtattttttatactaatcattttcgtattttttgtattaaacgatataagtttgttgtaaacttacaaggaataaagacattaaaaaataacagtatatctatttgttttatatattttacgaattctgcataaatctctttctagtaatgtgttgtaactctgctataatagatttattcctttttgtgtttacacaatttattttatactaccaaaaaaggtcaggattttgttcctgacctttgacaactttaccgattctttagttctacatagcgcttgtaccaaatgtttacataggcttctgagaaaggaccacgtccattgttaatccaatcaacaagaattttgacatgttcttttaaaatatagtccaagtcatcagaataattcattttgcgtttgtgacgctcgtactcttcaacgtccaagagacgtttttccccatctgtaaaaattttaacatccaaatcgtaatcaatatacttcagtgcttcttcatccagatagtaggggctagccatattgcaatagtaagaagttccattatcacgaatcatggcaatgatattaaaccaatatttcttgtgaaagtaaacaatagccggttctcgagtgacccaacgacgaccatcactttcggtaacaagtgtatgatcgttgacaccaataatggcgttttctgttgtttttagtaccatggtgtcccgccaagttcggtggagactcccatcatgcttataactttgaattgtaataaagtcgccttcttttggaagcttcataactaaccaactttctacaatttataagtttatcatttactattgtaccataaaattacccaaaatctgtgaatttcacttggaaatattaaagatattctctaagagcgcttgctatatccgaaaaatcgtagccctttcgtgctaaaacttgagttaaacgctgcttcagttcgtatccttcatactttcgggcatacttagtatattgcttatcaagttccttgaagatgagttcctgagtcgtttcttcatcaacttgactatccaattcgtcaaaggcaattttagcatcaaaataagagaagcccttgttagtcaagttctggataatcttatcttgcagggcacgagctggaagttttccctcatattttttcaatagtttattggctacacgttgagcaacttccgaaaaatcaaaatcattcaagatttcttctatagtagattttgaaattcctttttgtgctaatttctgagtcagtacataaggtcccttgtctcctgaaagttgattggcattgatgatagcataagcgtactggctatcattaatccacttctcttctttaagattagcaatgacttgagaaacgatgttttcattaatatcatattttttcagatattctctgacctctttttcagtacgtgctttaaaggataagtggtagagggccagattcttaccataagaaaattgagcaaagtcttgaatctctttcaattcctcttcgcttatcaccttatctctcgataacataaaacgaacaattgtgtcttcggtgatatagcatttgtcg

SEQ ID NO: 78 - DNA, 3636 bp; double-stranded, linear
tttccagaaagaagttgagtaaagtctttatcaaagagaatgacttccgtattggaactgacattaggttttatttctactttactagcgtccgccctagcattttctaaatctttaatctcttctgttgccctatttatagccagctgaataactgcttgaggattttcactcagtccatgaagcttatcgtccaccgaagtataaagactcgaatgcatgacttgtaaaataatcagagtcattgtagaaaaaatcagggtgaagacaccgaagttgcggataaaataactaaagtcatccgcataccatgtttttttaagtttactgaacatcttttaaaagatacccaacactacgcaaagtttgcaaattctctgcaaaagtggttccctttaatttcttacggacttttgaaacatagacttcgacaaccgaaatcgttgtatcactatcaaatccccatagacggtcaaaaatctgcgtcttaggcaaaatcacattttgattttgaaggaaataaactagtaaatcgaactctttccccagcaattcgacaggagtatcttcaactttaacggtattggttgataaattaaccacgatattcccataagtcaaggtgttttcattaaacttccctgaacgtttgagaagggcctgaatccgcattttaagttcttctaggtagaaaggtttggtcagataatcatccgctcccagttcaaatccatgtcccttgtcatccaaactttccttggcagtcataatcagaactggtgtcgtaattcccttttcacgcaattcttttaagacttggaaaccatttttttctggcaacatcaaatccagcaaaatcaagtcatagacaccactctcagcttcgtagagaccttcttctccatcaaatacctgcataacatccgcaaaatcgtctaaaaagtcaaatactgaatttgacagacctaggtcatcctcaaccaataagatttttatcatgagaaactcctccttattaaaactattataccaaatttgccttaaaaaaaactcaactctctgcattttacatgagatagctgagttttctttttattttaggcttatttatgcatttccgtattgaagaacaactgcttcgactgcagctttttcacggctaatcaagtcaacacgcgctgcaatttccttgattcccataccgatgttacggctaagagcaaggtcagaaagttgcggttcaaagaactccttgtattccgccaagcgttgctgagtcttaaatacatgagcaggaaggataacaaagctatcaaagctcatatctcctccaagggctgccttaatccaagcccagttttcacgcgcccaagaccaagctgttttctgagttgcttgatgagctaggaattggtaataccaagcagacaagtcctgtggtttgaccacaaatttgtccttccaagaagtaatcaggttttggatattatccgcatctgtactgtatgcaagagctgctgccaactggcgtttaaagacagcatctgttgcgtgagtataagtatcaagataaagtgctaacaagtctttagtctcatgatgtttcatctcattaatcagaacttgtgagcgaatagctgctgggagtcctgcaagattctccttgtgtgttgcgaagatttggctagcgacttgactagcttctgcatcatttgagcgaatcatcatcgaaacagccagctgacgaaccaattcatcctcatctgattctccgtctttagcttcaaaaccaagacggtcatagttatgacgagccaatttagcaaccagtcctttgaaggctgtttcagcatccgttccttcatcaataaagcgctcaagggctgaaatcacttgagaaacagctgaaaccaccagataagactcttccttagcaagtttatcaagaactggaagcaagtctgcataagaaatgtgccctgcctcagccaacaaacgacgttcttgaacaatttgcagtttgcttgtgttatcaagtgtctctagctcagcaagaacagctgctaacaagtctccttgatagtcggtaatatagtgggcagtattttcagtgttgagacgaagagctccttcattttcagcaagaagagctgcgtagccagggatttcgatactttcagtttcgagtgtatcaggcaagcctttccagttgctattgaggggcaccacccagagacggttcttgtcttcgttctcaccgatgaagaattgtttttgtgaaatcttcaagacatcattttcaactttaacagtaagaactgggtaaccaggctgttccaaccaagaatccatgaaggctgcgacatcacgtcctgacgcttgaccaagggcatcccaaaggtcactaccaatggtgttgctgtattggtgtttttcaaagtaggcgtgcaaacctttagcaaaatcagcatctcctagccaacggcgaagcatgtgcatgagacggcttcctttggcatagacgatagcgccgtcaaagagtgtattgatttcatctggatgtttaacttcgacgtggacagactgaacgccatcagtagcgtcacgttcaagagcaagaggtactccacctgtttggaaatcttcaaagatattccagcttggttcgatggtatccacacagacgtattccatcatattagcgaaactttcattgagccaaaggtcatcccaccatttcatagtcacgaggttcccaaaccattggtgagccaattcatgggccacaacaagggcaacttgttgacggctagcaaatgtagagttctcatcgacaaccaagtaaacttcacggtaggtcacaagaccccagttttccatagcaccagctgagaagtcaggaagggcgatgtggagagattgaggaattgggtacttaactccatagtaatcttcgtaaaactcgatagagcgaacagcgatatccagtgagaaatcaagatttgaaagtggatgtgctttggttgagtagacacctaccagggtaccatttttagttttagcggtcaccccttgcaaatcaccagcaacaaaggccaacaagtaagaagacatgcgaggtgttgtctcaaacttccagatacctgtttccttacggttttcaacatcgatttctggcatgtttgacaaggccaattcaccttctgcttggtcaaagcgaagagagaggtcaaaagttgctttggcttcaggctcatccacacatgggaaagcttcgcgcgcaaaatggctctcgaactgagtagacaagacctccttcttgactccatcaactgtataataagaagggtaaatccctgtcatgttgtctgtaattttaccagaaaaggcaagaaccaattcaacttgaccagcctcagccaattcgatatgaagggcttcattgtcatggtcaactgtaaatggacgagcttgacctgcaacttctacagaggtgatttccaaatctttttggtggagggagatgcggtcactctgtgcttgaccagtgatggtcactttcccagaaaaagtcttggtctcacgactcaaatctaaaaataaatcataatgttcaggaacaaattgcttaatggg

SEQ ID NO: 79 - DNA, 5066 bp; double-stranded, linear
atagcgtgtaataatcgattttagaggtaccataagccacctcctacaaatagaaaccgatataaatcaatgccttccacccttagacttccctagttcctgtctcaagcgaaacatttctttgaaacaggaataagttaaccaattcataccaatagctagcagaataaaaagaaaccaaatgccccataacttgatatctgtcacatttctcaagacggtattgaaaaacagaactgaaacaactgtccaagcaaggctaaaaagagaatagaaggggatgtaaaaccagtaaaaataataaaaaattggaaaaaacttactatttctgttggccttttcaatccagttatcaaaataaaagtacggtgctaaaagtaagaatttaaacaaatgttccatcaccgacatccccccttcttttgatagcgttttctattattttattatatcaaaaaaatccggaactgtcattccagattctacttttttatttgcgttttcttgcgatgagatgaatcggtgttccctcaaaaacaaaggccttgcggatttgattttccaagaaacgcaggtaagaaaagtgcatgagttcttcttcattgacaaagatgacaaaggttggtggtttggttgccacttgggtcgcatagaaaatcttgagacgttttcctttgtctgtcggtgttgggttgatggcaatggcatccatgatgacatcgttcaagacagctgatggaatacgtgtattttgactttcgctgatttgcttaatcatctcaggaagtttgtggagacgttgcttggttaaagctgatacaaagataatcggtgcgtaaggcaggtattggaactgctcacggatatcttcttcccagtttttcatagtgtggttatctttttcaagcgtatcccacttgttgaccacgataatcatccctttaccagcttcatgggcaaatcctgcgatacgcttgtcgtactcacgaatgccttcttccgcattgatgaccatcaagaccacatctgaacggtcaatagcacgcatggcacgcataacagagtatttctcagtattttcataaaccttaccagacttacgcataccagccgtatcaatcatggtaaactcttgaccatctgtatctgtaaagtgggtatcaatggcatcacgagttgttccagcaacaggactagcaataacacggtcttctcccaagatagcattgatcaagcttgattttccaacgttaggacgaccaatcaagctaaacttaatgacatctggattttcttcctcatattcatttggaagattttctacgatcgcatctagcacatcccctgtaccgattccatggacagatgagataggcaatggttcacccaaaccgagagcatagaaatcatatatatcatttctcatctcagggttgtccaccttgttgactgcgaggataactggtttgtgggtcttataaagcttacgagctacgtattcgtctgcatcagtaattccttccttaccagacacgacaaaaacgataacatctgcttcttccatggcaatttctgcctggtgcttgatttgttccatgaaaggagcatcgacatcatcaattcctcctgtatcaatcatgctaaaagaacgattgagccactcacccgttgcataaatacggtcacgtgtcactccttcgacatcttctacaatggagattcgctcaccagcgatccgattaaatagggttgatttcccaacattgggacgtcctacaatggcaatagttggtagggccataatttctcactttctacaataatttcttctgttcaagattttttctagttgagcttggttcagcttgaccaaactgttctgctaggcgctgactccagcttgtggtcgcacgcgccccagcatagtcagcctgaacacggtcataagcttggattgcctcagttgactgttcttggtattcttcctcaaagacaacattctctagtggcagtctcggtttcatatcatgatgttgatttggcacacccagtgccatcccaaagacagaataggtgtagtcaggtaggttaaagagctctgccacttcttcagacttgtatcgaaccaaaccgataatcacaccaccatagcccaagctttcagctgccaacaaggcgttttgtccagcaagagctgcatcgaccgaactaatcaagagaccttccacaccttggggttggaaggtgtcggtatgaagtcgggctcccttttctgctcggttcaaatctccgacaaagagaaggaaaacagcagactggcgaatggcttcttgaggtaccaattcatacaaggcatctttcttctcttgacttcgtaccacaatcacagagtaggattggaaattcttccaagatgatgccatctgggctgctgtcaaaatctcatttaagtctacttggggaatttcttgctctttaaacctgcgcactgaagtatgagccttcatcaatttaatggtttctgtcatcgacggtttactccttctaaacgagtctcctcagccaaataacggatgcgttccatgacccgtctggcttcccaggtttcgtcatttccatgtttcactttcgcaaaatgcttctccaaatcttcaaagttgaagttggatgtgaaaaaggtcggtaaattttcctgcatccgatattggagaatgacctgcaggatttcgtcacgcacccaaacggttgattgctcggcgccaatatcatctaaaatcaggacctcagacagcttaatctcatccaccaaggtcttaacattgccatcactgatagcatttttgacatcaatgacaaagctaggatagtggaggagagttgatgaaacaccacgtttttctgataaatcatgagctaaggccgccaccatgaaacttttacccacaccaaagtctccatataagtaaagaccttttcgaatagctggatattgctccacgaaggctagtagcttttcaaaaactggtaagcgccccaaatcatccaagtcaacttgagccaaactagctttcttgagactggctggtagattgattaacttgagacggttcttaatagccgcttctttttcagccgcgattagctcaggagtttcttcatatgaaacatctgcataaccatgattcttaaccaaaatcggcttgtagcctttggcaatataatccgtatccccacggagaaacttgtcacgctcggtgatgtactgattaaacttggagatactgcgatttaattcctttggagttaaggattcttgctggataaaggccgcaacatcagggtccttcatgattttctggaccaaatcttgataataaaaacggctgggttgacgtttgagtacgtctccgacactttccatctaatctcctcctttttctaatcgagctaatagttcttgcttcttacgttctagttccagacgagtttcctcgctggtttcattcttatattcaggattactccatttaggaacattggttttttctggggcagtctgattctgtttttgtgtttttgctttctgccctcgatcacgaattcgtaaaacggcctcttctgccgaatgaatcttttgataggcatagtcattggctaccttcatggcatatttctcattgatatttgccgaatccaccttattaaaggtcaataagagaataatattgatgacttcgtccagtaagcccaagccagccatctgttgcaagagttctctttctgtttgggtaatggttcccttgcgtgtttgcttgatttctgctaagaactgcagggcagttttacttttagcttctttgataatggtcgcttccttaagactaaagtcagaggaaactggtttttgagcaattttttcacgcatgcgtttggttgaaataacctgggaaacagctgttgacttggccaattgataggtttcaaaccaagtccatttcttctcctcggcaatagcaaagaggtttaagacatcggactgctcatccgcaaaacgaagtccatctcgagccatcagctggcgaaaatgttccaagtcaaaatcattggccactttcttcttgagaccaaggtcttcttgactgcctagttctgccaattctggaaagacttgattgagtgagacaggtatttcttcaccatcagcactttcaactttcaaatcctccacagctacatcgccaatctttttctctaagagtctgcgataaacaggatgccccaagaagtcttgactagatagaggagcatggagggctagctgataaacatcacccttttgatagagggtcaagagattaaaagcagataagattttcaatgattttatcagtctatccatcccaaagttgagatggttgagaatgcttgaaaaaagatattcctttctaccattatcccaaaaactgattgtataaagataaaggctcagtgcctcctgaccgataatcgggaggtagcactgtaccagagatgaggtatcttgcgacacccgattattctttagataagaaaaacggtcaattggcttcatttatctttcctttttctttttagaggactgggtgatttgttggagcaagctctctaactcactgacatccttaaaactacgatagacactagcaaaacgtacataggtaatctcgtccaattcagccaactcctccatgacgagtgaaccaatgtcctcactttgaatttcattttcatttcgaccacggagtttctgttcgatacgattgactaccatgttgatttcatcacttgacacaggacgtttctgggctgagcggataatcccattaaagattttatctctggagaattgttcccgtgtgccatcttttttaacaaccactaaggttctttcttctactcgttcgtaggttgtaaaacggtgttggcattcgtcgcactcacgtcttctacgaatggtgttcccttcttctgcttggcgactatcgataacacttgacttggtagccccacattttggacagggtacc

SEQ ID NO: 80 - DNA, 9607 bp; double-stranded, linear
cacttgaagtatttgaaacagctatggaaaacatcatgcctgtacttgaagtacgtgcacgtcgtgttggtggttctaactaccaagtcccagttgaagttcgtccagaacgtcgtacaacacttggacttcgttggttggtaacaatcgctcgtcttcgtggtgaacacacaatgcaagaccgtcttgcaaaagaaatcttggatgctgctaacaacactggtgcagcagttaagaaacgtgaagatactcaccgtatggctgaagctaaccctgcattcgcacacttccgttggtaagataggatgcgaaagcgttaagaaagtcccagagaaaatagggaatcgaagcaggttgcggttgcaaccaatgagattcatctttttctccagacttttagcttgagctcaactaaatcatgatgctaggaacggtaaggatgcaaggtaaaaataggaaactgacgcagtattcgacgaatacaaggagttttatctttttcacgcagcatcccgttccagctcacatcggctaactaactttagcccgggttcaaattagctaaatcgattagtattagctataactcagcttaccatctcgtaagttgaaaccaacaatagcatgaaaacattgagaacgggtaggtcctgcctatccgtttttattaaaatcgtgttataatagaatagaaatcaaaaataaataggagaaacaaacctcatggcacgcgaattttcacttgaaaaaactcgtaatatcggtatcatggctcacgtcgatgccggtaaaacaacaactactgagcgtattctttactacactggtaaaatccacaaaatcggtgaaactcacgaaggtgcgtcacaaatggactggatggagcaagagcaagaacgtggtatcacgatcacatctgctgcgacgacagctcaatggaacaaccaccgcgtaaacatcatcgacacaccaggacacgtggacttcacaatcgaagtacaacgttctcttcgtgtattggatggtgcggttaccgttcttgactcacaatcaggtgttgagcctcaaactgaaacagtttggcgtcaagcaactgagtacggagttccacgtatcgtatttgccaacaaaatggacaaaatcggtgctgacttcctttactctgtaagcacacttcacgatcgtcttcaagcaaatgcacacccaatccaattgccaatcggttctgaagatgacttccgtggtatcattgacttgatcaagatgaaagctgaaatctatactaacgaccttggtacggatatccttgaagaagacatcccagctgaataccttgaccaagctcaagaataccgtgaaaaattgattgaagcagttgctgaaactgacgaagaattgatgatgaaatacctcgaaggtgaagaaatcactaacgaagaattgaaagctggtatccgtaaagcgactatcaacgttgaattcttcccagtattgtgtggttcagccttcaaaaacaaaggtgttcaattgatgcttgatgcggttatcgactaccttccaagcccacttgacatcccagcaatcaaaggtattaacccagatacagacgctgaagaaattcgtccagcatctgacgaagagccatttgcagctcttgccttcaagatcatgactgacccattcgtaggtcgtttgacattcttccgtgtttactcaggtgttcttcaatcaggttcatacgtattgaatacttctaaaggtaaacgtgaacgtatcggacgtatccttcaaatgcacgctaacagccgtcaagaaatcgacactgtttactcaggtgatatcgctgctgccgttggtttgaaagatactacaactggtgactcattgacagatgaaaaagctaaaatcatccttgagtcaatcaacgttccagaaccagttatccaattgatggttgagccaaaatctaaagctgaccaagacaagatgggtatcgcccttcaaaaattggctgaagaagatccaacattccgcgttgaaacaaacgttgaaactggtgaaacagttatctcaggtatgggtgaacttcaccttgacgtccttgttgatcgtatgcgtcgtgagttcaaagttgaagcgaacgtaggtgctcctcaagtatcttaccgtgaaacattccgcgcttctactcaagcacgtggattcttcaaacgtcagtctggtggtaaaggtcaattcggtgatgtatggattgaatttactccaaacgaagaaggtaaaggattcgaattcgaaaacgcaatcgtcggtggtgtggttcctcgtgaatttatcccagcggttgaaaaaggtttggtagaatctatggctaacggtgttcttgcaggttacccaatggttgacgttaaagctaagctttatgatggttcatatcacgatgtcgactcatctgaaactgccttcaagattgcggcttcactttcccttaaagaagctgctaaatcagcacaaccagctatccttgaaccaatgatgcttgtaacaatcactgttccagaagaaaaccttggtgatgttatgggtcacgtaactgctcgtcgtggacgtgtagatggtatggaagcacacggtaacagccaaatcgttcgtgcttacgttccacttgctgaaatgttcggttacgcaacagttcttcgttctgcatctcaaggacgtggtacattcatgatggtatttgaccactacgaagatgtacctaagtcagtacaagaagaaattattaagaaaaataaaggtgaagactaatccgtcctcactctagaaggaagtcacttagtggcttccttttgtctttagaaaatacctctaaatatggtaaaatagtagaagaataatgtgaggaaaatgaatgtcaaatagttttgaaattttgatgaatcaattggggatgcctgctgaaatgagacaggctcctgctttagcacaggccaatattgagcgagttgtggttcataaaattagtaaggtatgggagtttcatttcgtattttctaatattttaccgattgaaatctttttagaattaaagaaaggtttgagcgaagaattttctaagacaggcaataaagctgtttttgaaattaaggctcggtctcaagaattttcaaatcagctcttgcagtcctactatagggaggctttctctgaaggtccatgtgctagtcaaggttttaagtccctttatcaaaatttgcaagttcgtgctgagggtaatcagctatttattgaaggatctgaagcgattgataaggaacattttaagaagaatcatcttcctaatttagccaaacaacttgaaaagtttggttttccaacttttaactgtcaagtcgagaagaatgatgtcctgacccaagagcaggaagaggcctttcatgctgaaaatgagcagattgttcaagctgccaatgaggaagcgctccgtgctatggaacaactggagcagatggcacctcctccagcggaagagaaaccagcctttgattttcaagcgaaaaaagctgcagctaaacccaagctggataaggcggagattactcctatgatcgaagtgacgacagaggaaaatcgtctggtatttgaaggggttgtttttgatgtggagcaaaaagtgactagaacaggtcgtgttttaatcaactttaaaatgacggactatacttcaagtttttctatgcaaaagtgggttaaaaacgaggaagaggcccagaagtttgacctcatcaagaagaattcttggctccgagttcgagggaatgtggagatgaataacttcacacgcgatttgactatgaacgtacaggatctgcaggaagttgttcactatgagcggaaggatttgatgccagaaggtgagcgtcgggttgagtttcatgctcatactaacatgtcgactatggatgctttgccagaggtcgaagagattgttgcaacagctgctaagtggggacacaaggcggttgctatcacggaccatgggaatgtccagtcctttccacatggctataaggcggctaagaaagcgggaatccagctgatctatgggatggaagccaatatcgtggaggaccgtgtccctatcgtctataacgaagtggagatggacttgtcagaagcaacctacgtggtctttgacgtggaaacgacgggactttcagctatctataatgacttgattcaggttgcggcttctaagatgtacaaggggaatgttattgctgaatttgatgaatttatcaatcctgggcatcccttgtcagcctttactacagagttaactggaattacagatgatcatgtcaaaaatgccaaaccactagaacaagttttgcaagaattccaagaattttgcaaggatacggtcctagttgcccacaatgctacctttgacgttggctttatgaatgctaattatgagcggcatgatcttccaaagattagtcagccagttattgatacgctggagtttgctagaaacctctatcctgagtataaacgccatggtttggggcctttgaccaagcgttttggtgtggccttggaacatcaccacatggccaactacgatgcggaagcgactggtcgtctgcttttcatctttatcaaagaggtagcagaaaaacatggtgtgaccgatttagctagactcaacattgatctaatcagtccagattcttacaaaaaagctcggatcaagcatgcgaccatctatgtcaagaatcaggtaggtctaaaaaatatctttaagctggtttccttgtctaataccaagtattttgaaggagtgccacggattccgagaacggttctagatgcccatcgagagggcttgattttaggttcagcctgttcagagggtgaagtttttgacgtggtcgtttctcaaggtgtggatgcggcggttgaggtggccaagtattatgattttatcgaggtcatgccaccggctatctatgcacccttgattgccaaagagcaggtcaaggatatggaggaactccagaccattatcaagagtttgatagaggttggagaccgccttggcaagcctgttctggctacgggaaatgttcactatatcgaaccggaagaagagatttatcgtgaaattatcgtccgtagtttgggacagggtgcgatgattaatcgaactatcggtcatggtgaacatgcccaaccagcaccacttccaaaggctcattttcgaacgactaatgagatgttggatgaatttgcctttttgggagaggaactggctcgtaaactggttattgaaaacaccaatgccttggcagaaatatttgaatccgttgaagtcgttaagggtgacttgtatacgcctttcatcgacaaggctgaagaaacagttgctgagttgacctataagaaagcttttgagatttatggaaatccgctgccagatattgttgatttgcggattgaaaaagaattaacatccatactggggaatggatttgctgtgatttatctggcatcgcagatgctggtgcaacgttctaatgaacggggttatttggttggttctcgtgggtctgtcggatctagtttcgttgcgaccatgattgggattacggaggtcaatcctctctctcctcactatgtctgtggtcagtgtcagtacagtgagtttatcacagatggttcgtacggttcaggatttgatatgccccataaggactgtccaaactgtggtcacaaactcagtaaaaacggacaggatattccgtttgagaccttccttggttttgatggggataaggttcctgatattgacttgaacttctcgggagaagatcagcctagcgcccacttggatgtgcgtgatatctttggtgaagaatatgccttccgtgcgggaacggttggtacggtagctgccaagactgcctatggatttgtcaaaggttacgagcgagattatggcaagttttatcgtgatgcagaagtagaacgcctcgctcaaggagcggcgggtgtcaagcggacaacaggccaacacccggggggaatcgttgttattccgaactacatggatgtctacgattttacgcctgtccagtatccagcagatgatgtcacggctgaatggcagaccactcactttaacttccacgatatcgatgagaacgtcctcaaactcgatgtactgggacatgatgatccgactatgattcgaaaacttcaggatttgtctggtattgaccctaataaaattcctatggatgacgaaggcgtgatggcactcttttctgggactgatgtgctaggggtaacacctgaacaaattggaacgcctacgggtatgttggggattccagagtttggaacaaatttcgtacgtggaatggtagacgaaacccatccgacaacctttgcggaattgcttcagctgtctggtctgtcccacggtactgatgtttggttggggaatgctcaggatctgattaagcaaggaatagcggacctatcgactgttatcggttgtcgggacgacatcatggtttacctcatgcatgcgggtctggaacctaagatggcctttaccattatggaacgggtacgtaagggtttgtggctaaagatttcagaagaggagagaaatggctatatcgaagcaatgaaggctaataaggtgccagagtggtatatcgaatcctgtgggaaaattaagtacatgttccctaaggcccatgcggcagcctacgttatgatggccttgcgtgtagcttacttcaaggttcaccatcctatttattactactgtgcttacttctccattcgtgctaaggcttttgatatcaagaccatgggtgcgggcttggaggtcatcaagcgcagaatggaagaaatctctgaaaaacggaagaacaatgaagcctctaatgtggaaatcgatctctatacaactcttgagattgtcaatgagatgtgggaacgaggtttcaagtttggtaaattagatctctactgtagtcaggcgacagagttcctcatcgacggggatacccttatcccaccatttgtagcaatggatggtctgggagagaacgttgccaagcaactggtgcgggcgcgtgaagagggagaattcctctctaaaacagaactacgcaagcgtggtggactctcatcaaccttggttgaaaagatggatgagatgggtattcttggaaatatgccagaggataaccagttgagtttgtttgatgagttgttttaaaaaattgcttaataatctattaaaagaggctaacgtatatccaatagatttacattagctttcttttttgttaaaatagtctatggaaagagggtgagagtatgtcaaagatgagtataagcatccgtctggatagtgaggttaaggagcaggcccaacaggtgtttagtaatctgggaatggatatgacaacagctattaatattttccttcgtcaggcaattcaatatcagggattaccttttgatgttagactagacgaaaatcggaagttgctccaagcgttaacggatttagaccaaaatcgtaatatgagccagtcttttgaatcagtctcagatttgatggaggacttacgtgcttaagattcgttatcataaacagtttaaaaaagattttaagttggctatgaagcgtggtttgaaggcagaattattagaagaagttttgaattttctggttcaagaaaaagaacatcctgccagaaatcgtgatcattcattgacggcatccaagcattttcaaggagttcgtgaatgccatacccagccagattggcttttggtttataaagtagacaagtcggaattgattttaaatttgctgaggacaggcagtcacagtgatttattttaatctattttaagggggttctcatgaaactaagaatatttgcggaagataagccggctaagaaggtatttgaatatcaattagaacttgctgatcgtacaattcttctatcgacagcactcttgtcaggtgctattgctttagcaggaatcttttctgctttgaaagaaaaataaaaatagaaaagagaaaacagaatggttttaccaaattttaaagaaaatctagaaaaatatgcgaaattgttggttgcgaacggaattaacgtgcaacctggtcacactttggctctctctattgatgtggagcaacgtgaattggcacatctaatcgtgaaagaagcttatgccttgggtgcgcatgaggtcatcgttcagtggacagatgatgtgattaaccgtgagaaattcctccatgccccgatggagcgtttggacaatgtgccagaatacaagattgctgagatgaactatctcttggagaataaggctagccgtcttggagttcgttcatctgatccaggtgccttgaacggagtggacgctgacaagctttcagcttctgctaaagctatgggacttgccatgaagcctatgcgtatcgcaactcaatctaacaaggttagctggactgtagcagctgcagcaggacttgagtgggctaagaaagtcttcccaaatgctgcgagcgacgaagaagcagttgatttcctttgggaccaaattttcaaaacttgccgtgtctacgaagcagatcctgttaaggcttgggaggaacatgcagccattctcaagagcaaggccgatatgcttaataaggagcaattttcagcccttcactacacagcgccaggaacagatttaacacttggtttgccaaagaaccacgtttgggaatcagctggtgctgtcaatgcacagggcgaagaattcttgccaaatatgccaacagaagaggtcttcacagcgcctgacttccgtcgtgcagatggttatgtcacttctacaaaaccgcttagctacaacggaaatatcattgaaggcattaaggtgacctttaaggatggacaaatcgtagatatcactgctgagaagggtgatcaggttatgaaagaccttgtctttgaaaatgcgggtgcgcgtgccttgggtgaatgtgccttggtaccagatccaagtccaatttctcagtcaggcattaccttctttaacacccttttcgatgaaaatgcgtcaaaccacttggctatcggtgcagcctatgcgactagcgttgttgatggagcggagatgagcgaagaggagcttgaagctgcagggcttaaccgttcagatgttcacgtagactttatgattggttctaaccaaatggatatcgatggtattcgtgaggatggaacgcgggtacctcttttccgtaatgggaattgggcaaattaaggagataatatgttaggaagtatgttcgttggtctcctagtgggatttttagcaggtgctatgaccaatcgtggagagcgaatgggatgttttggaaaaatgtttctcggttggatcggagcctttctaggtcacttgctctttggaacttgggggccagttttatcaggaacagctattatcccagcgattttaggagccatgattgttttagctattttttggagacgaggaa

SEQ ID NO: 81 - DNA, 14231 bp; double-stranded, linear
ctacaagataattccagctataacatccgctataatagtaagagcgagctctatgataaggctcattagtttcacctcctctcacgaacccataggaacgtaatcggtaaccgatgacaaaaatagtataccacaatacatttagatcatcaaggtcacttaattcttgaaatatcagatctaagagaaaaatctttaaaatcagaaaaacgcataatatcaggtgtgcaaaaacttgatactatgcgttttattgtgggaaggtttactccattttctcctgaaattgagtttttgtccagcctctgtttttagggttgctaagaaaataatgtcatgtggtgaatatttgtaaatcagtcagcagacagaacgatactcttcgaaaatctcttcacatcatgtcagcttcgtctttccgtatatatgtgactgacttcatcagttctatctacaacctcaaaacagtgtttcgagctgacttgatcaattttcaaatctgtactttgagcaagctgagactagcttcctatttgattttcattgaatatcagaaacccattctccatcaaataattcgactgcgtctaataatttttgatctggcacggtgtctgaaataaaggttgtgtatttggagaggggattaattttaaaaaatccagtcttgtaaaatttagaactatcaatcagtaagatggtttcatgggctttgtcaataatattcttttttgaaatagcttggctgagagaagcttcataaacatattggtcatcaatacctcttgctgaacaaaatgctaaatcgatattaaaatgatctaataaagaattttccttatcatagttgaccacggaacaggattgatgtttgacctcgccagatgtgataaagattttggagctatctttaacagtttcagatagggtttgtgcagtatgtaaaccatttgtaaaaataatcaaattatcaagttcagaaagatagggacagagttcgtagacagtagtactagaatctagatagatacacataccagaccgaataaagtctttagcgagactagcgattagtcttttttgcctagtactttctccttcacgtatttgatgagaaagttcaattgtgttcatagaggacagggtcacgtatccgtgctttcttttgataagaccttgattttctaagaaaattaaatcacgacgtaaggtacttgtgctggagaaagtgatttctgccagctcttttacggcaattctttttttctttttgataatttcaatcaattcaagtacacgttcatcttttatcataagctcctcctaatttatcatttcaactatattatagcacaaattggaggaatttgaattatttttatgaatattgggttaacatttgaacattattcaagtaagcgttcacatattgaaaaaataaaacgtggggattataataaagttaatcmaggacgaagagagaagaaaaatggaagcggttttagcaatagatttaggtgcgacttctggaagagcaatcgttggttacctttctgaaaataaactagtaatggaagaaataaatcgcttttctaatctacctattagagtaaaagggcatttatcttgggatattgactttctactagctaaaattcttgaaagtatccgcttggctaatactagttacaagattttatctatcggtattgacacatggggagttgattttggactgattgataatgaaggtaagctgttattacaacctgttcattatcgtgatgaaagaacaaagggagtgttaaaggaaatatctgaaatgactgaattagaaaaactgtattcagagacaggaaatcagattatggagataaataccttgtttcaactctttaaggcacgtcaagaatctcctgactctttctataagaccaataagattcttttaatgccagatttgtttaattatctcttgacaggtaagtttgctacagaaaaaagcattgcttcaacaactcaattatttgatcctaggagtcaaaattggaatcagaatatcttaaaactatttgaattggattcatctttacttcctgaaattgtttcagagggaaatgttcttggaaggataaaagaggagtatggtttaggcgatattcctgttgtgaatgtttgtagtcatgatacagcaagcgcgattgtctcagtacctaagacagaaggtagtttatttatttcatcaggtacttggtctttggttggagtggaacttacttcaccgattcttactaccgaatccttcagttatggatttacaaatgaagtcggtaaagatggagtgattacatttctgaagaattgtacagggttgtggatcatagaggaactaagacgttcatttgaacgaagagggaaagcctattcttttgatgatattaggacaatggtggagaaagaaaaagaaaatcttcctctgattgatactgaatcaactgaatttgcaacagaatctgatatgcacaagactttgacagaatatctagcttatcatcatgaaactagagagtggacagatggacaactatttaagattgtttatgaaagcctagctgaaacgtataggaaagcgatagagttactagaagaactaactcataaggtttataagaggatatatgtgattggaggaggtgctagagccagttactttaaccaaatgattgctgatagaactggtaaagaggttcttacaggtttgactgaggctacagctgtggggaatattgttgtgcagctcatagctatgggacaattaaaagggatggaagaggctcaccatgttattgaggagtttctacaattagagagttattactcccaaaagaattaaaaagattgagagtttgtaaatttgcctccctcccccttcttagcttttgtgcaggaaggggggataattggtgaattgaaaaatatttagtgttttgatatgaggaggacaaggatgtcagatgtaaaacaagaattaattaaatatggtaagaagctagtagaaacagatttgacgaaaggaacaggtgggaatctcagcgttttcgatcgtgaaaaacaattgatggcaattaccccgtcgggtattgatttctttgaaatcaaagaatccgatattgtagtgatggatattaatggaaatgttgtagagggagaacgcttgccatctagcgaatggtatatgcatttgattcaatatcaaactcgtgatgatatcgatgcaattatccatgctcatacaacttatgcaacagtattagcttgtctcagagaaccacttccagcgagtcattatatgattgcagtggcagggaaagatgttcgggtagctgagtatgcaacatatggcacgaaagaattggctgtgaatgcagctaaagcaatggaaggtcgtagagcagttttactagcgaatcatggaattttagcaggtgcacaaaatttattgaatgcatttaatattgttgaagaagttgaatattgtgcaaaaatttattgtttagctaagaattttggagagccagtagttcttcctgatgaggagatggaattgatggcagaaaaatttaaaacatacggtcagagaaaatagggaggatattaatgttaaaacatataccgaaaaatatttctccagatttattgaagactttaatggaaatgggacatggagatgaaatagtattagctgacgcgaattatccttctgcctcatgtgcaaataagctaattcgttgtgatggtgtaaatattccagaattattagattccattctgtatttaatgccattagatagttacgtcgatagttcaattcagtttatgaacgttgtttcgggtgatgatattcctaagatatggggtacctatagacagatgattgaaggtcatggtacagatcttaaaacgattacttatcttagaagagaagacttttatgaacgtagtaagaaagcttatgctattgttgctacaggagaaacttcactttatgctaatattatccttaagaaaggagtagttgttgaaagagaaaatgttcaatagaggaattttagttgccagtcatggtaattttgctagcggagctctcatgaccgcagaaatgtttgttggtgagacaacaaatgatagagttaggacattaggtttgatgcctggagagaatattgtagagtttgagcattattttaaaaatcaagtggatgaactgttagactcaaatcaagaggttatcgttttgactgacttgattggaggaagtcctaataatgtggctttgtcacggtttttaaatttggattcagttgatattgtaacagggtttaatatccctctcctagtggaattaatatcaagttatgattcaaaaatcaatttagaagaaattgttcacaatgctcaaaatagtttgtttaatgttaaacaacaacttaacgtagaggaggaagaagatttatgtctatagagtttgttcgtattgatgaccgtctggtacatggtcaagttgtcactacgtggctaaaaaagtatgatattgagcaagttatcattgttaatgatcgcatctcagaagataaaacacgacaatctattttaaagatttctgcaccggtaggtttaaaaattgttttctttagtgtaaaacggtttgtggaagttttaaactctgtgccaataaaaaagagaacaatgctgatatatacaaatccaaaagatgtgtatgattctattgaaggaaatttaaaattggagtacctcaatgtaggacagatgagtaaaacggaggaaaatgaaaaggtaacgggaggtgtagctctaggtgaagaagacaaatattattttaagaaaatagttgataagggaacgagagttgaaattcaaatggttcctaatgataaagttacaatgttggaaaaatttttataaaaataatttaaggaggtacagtatatgctattcacacaagcattactggtgacattagttgggattattgccactattgactataatggaccgttatttatgattcaccgtccgttagttacaagtgcaatggttggcttagtattaggagatttcacccaaggtgttcttattggttcagctcttgaattaacttggctcggtgtaacaggtattggaggttatactccaccagatactatttcaggtgcgattattggtactgcatttggtattttatctggtcaaggagaaactgctggtatcgctatagcagttccaattgcagttgctacccaacagttggatgttcttgcaaaaactttagatgtttattttgtgaaaaaagctgataatgatgctaaaaacggagattattcaaagatcggtttttatcattattcaagtttggttttaatcacgttatttaaaattgtaccaattttcctagctattatgcttggaggggaatatgtggcagacttgtttgctaaggttccaccaatcgttatgcagggacttaactctgcaggtgctttactaccttcaattggttttggtatgcttttaaatatgatgctcaagaaaaatatgtgggtattcttgttgattggattcatttgttctgtgtatggaggaatgtcaaccattgggatctcactagttggtattgcggtagcatacttctacgatatgattggaagcaaaccacaagaaacaacttcaagtagtgatgttgaggaggatcttgatctatgatgaataataaagtaactaaagttgaacttaaaaaagttttcaaacgaagttttatgtatggttcttcatggaactatgagagaatgcagaacctaggttttctatatacaattcttccagtattgaaaaaactatacccagacaaagattcagcttctcctgcaatgaaacgtcaccttgagtttttcaatactcatcaaacagcggcaccatttattcttggagttacttccgctatggaagaacaagaaggaaatgaaggtgcagcttcaattactggtattaaagttggcttgatggggccactggctggtctaggagatagtttgttctggctgacactagttcctatctgttttagtattggtgcgtcttattctaaagacggcggtgctttaggtatctttatcgccttaatattgtttaatattattaatattcctgttaaatatttcggtttgaaatatgggtatactaagggttctagtcttatccaagaaaataatacaaaaggaacattgaatcgcgttacgagtatggcgacagcattagggctagtactagtgggtggtttgattccatcaatggttggtattaattttggattagaatttaagcagggggaacttgttatttctgttcaagaaatgattacaaaattaattccaggatttatccctatggctttgactttattaatgtgtaaattaattagaaaaggaaagaatccggttgtactaatctttagtgttatggctattggagttattctagttgttttaggaattttgaagtagtagaaagtgtggaggtggtatttgggatatcacctccattttggaagagaggtaaagagtgaaattatggtataagaaagctgccgcaaattggaatgaagccttgccgattgggaacggtcatttaggtggtatgatttatggttcagctacaaaagaatgtattcaactaaacgatgagactatttggtatagaggaaagtcagatagaaataatccagactcactattgcatcttaaaaaaattcgggaatatcttttagatggagaaattcagaaagccgaagaattgataaagttaacagtgtttgctaccccaagagatcaaagccactatgaattacttggggaactttacattgagcatatagatattcagtcttgtgctctttcattgtatgaaagagagctagatttagatacagctatttctaatgttgtgtttgagcctaatagttgtaatttacaaataaaaagagaatattttacgagttttaataagaatattttatgttgccgtatagtgtcatcagttcaaaacacattaaatttaaacattaatttgggtagaaataaacggtttaatgacgaagtatctaaactggattcaagtacaattttaatgtcggcctctgctggaggtagaaaaggtgttcagtttaaagtagtatgtcattctaaggttacggatggtgaagtaagtgtattgggagagacaatagttattcggaatgctacagaggtatttctttatctcaaatcaatgacggattattggggaaatatagatatttcttctcttcagggagaatttagtagtattgattactttacagaaaaagatgaacatgtaaaaaaatatcaggagcaatttaatagagttgattttaaactagactatagtaaaggttgtcttagcattccaacgaatctacttcttgaaaacactaaaaagtatagtaactacttgactaacttgttatttcattatggaagatatctgttaatatcgtctagtcaaccgaatggtttacctgccaatcttcaaggaatatggtgtgatgaattaaatccaatttggggttctaaatatacgattaatattaatactcaaatgaattattggatggtaggtccatgtgatttaccagaagtagaatatccattatttgatatgctcgaaagaatgagagaaccgggaagactaaccgctaagaaaatgtatggagctagaggttttacagcacatcataatacggatggttttggcgatacggctccccaatctcatgccatgggggctgcaatttgggtattaactattccatggttatgtactcatatttgggaacactatttatatttccaagatgagcgtattcttacggaacattttgaaatgataaaagaagcatttcttttctttgaagattatttatttgaggtggatggctacttgatgacaggtccaagtgtctcaccggaaaataaatatcgcttaaaaaatggtattgaaggaaatgcttgtctatcatctacaattgataatcaaattctaagatatttttgtgattcatgcattggcattgcaaaacaattaggagacaattcggattttattagtcgtgtgaaggagttaaaaaagaaactacctaaaacaaaaataggtagtaatgggcaaatccaagaatggttagaagattatgaagaagtagagcctgggcatagacacatttcacctctatttgggctttatccttataatgagattgatattcataaaactccggaattagcagaagcagctaaaatcactatcaataggagattatcaaacgctaattttttatcttcacaggagagggagcaagcgattaataattggttagtaagtggtttgcatgctagtacacaaacaggttggagtgctgcatggctgattcatttttttgcgagactatatcaaggtgaacctgcttataaccagattaatggtttgttaaataatgcgactcttggcaatttatttcttgaccatccaccatttcaaattgatggtaatttaggtttggtgagtggaatttgtgaattattagtacagagccatcataattggttatcactaattccagctttaccttctgcttggtcagaaggagaagtgaaaggtttcagagtaagaggaggatataaggtatcgtttgcttggaaaaatggggatataacattcctaaaattggaaggaggaaacaaagatcaaaaagtaagagtaagaatatatggcaaaaatactgatgtacaaaatattgaattggtatttaattcagaaaaaattattgagttaaatttttaggtataagtcatgaataaagaaaaaataaaaagaaaattaatcacaatattgtttgtatgtattgggatgttatgttttggattgttagcaggagttaaggctgataatcgtgttcaaatgagaacgacgattaataatgaatcgccattgttgctttctccgttgtatggcaatgataatggtaacggattatggtgggggaacacattgaagggagcatgggaagctattcctgaagatgtaaagccatatgcagcgattgaacttcatcctgcaaaagtctgtaaaccaacaagttgtattccacgagatacgaaagaattgagagaatggtatgtcaagatgttggaggaagctcaaagtctaaacattccagttttcttggttattatgtcggctggagagcgtaatacagttcctccagagtggttagatgaacaattccaaaagtatagtgtgttaaaaggtgttttaaatattgagaattattggatttacaataaccagttagctccgcatagtgctaaatatttggaagtttgtgccaaatatggagcgcattttatctggcatgatcatgaaaaatggttctgggaaactattatgaatgatccgacattctttgaagcgagtcaaaaatatcataaaaatttggtgttggcaactaaaaatacgccaataagagatgatgcgggtacagattctatcgttagtggattttggttgagtggcttatgtgataactggggctcatcaacagatacatggaaatggtgggaaaaacattatacaaacacatttgaaactggaagagctagggatatgagatcctatgcatcggaaccagaatcaatgattgctatggaaatgatgaatgtatatactgggggaggcacagtttataatttcgaatgtgccgcgtatacatttatgacaaatgatgtaccaactccagcatttactaaaggtattattcctttctttagacatgctatacaaaatccagctccaagtaaggaagaagttgtaaatagaacaaaagctgtattttggaatggagaaggtaggattagttcattaaacggattttatcaaggactttattcgaatgatgaaacaatgcctttatataataatgggagatatcatattcttcctgtaatacatgagaaaattgataaggaaaagatttcatctatattccctaatgcaaaaattttgactaaaaatagtgaggaattgtctagtaaagtcaactatttaaactcgctttatccaaaactttatgaaggagatgggtatgctcagcgtgtaggtaattcctggtatatttataatagtaatgctaatatcaataaaaatcagcaagtaatgttgcctatgtatactaataatacaaagtcgttatcgttagatttgacgccacatacttacgctgttgttaaagaaaatccaaataatttacatattttattgaataattacaggacagataagacagctatgtgggcattatcaggaaattttgatgcatcaaaaagttggaagaaagaagaattagagttagcgaactggataagcaaaaattattccatcaatcctgtagataatgactttaggacaacaacacttacattaaaagggcatactggtcataaacctcagataaatataagtggcgataaaaatcattatacttatacagaaaattgggatgagaatacccatgtttataccattacggttaatcataatggaatggtagagatgtctataaatactgaggggacaggtccagtctctttcccaacaccagataaatttaatgatggtaatttgaatatagcatatgcaaaaccaacaacacaaagttctgtagattacaatggagaccctaatagagctgtggatggtaacagaaatggtaattttaactctggttcggtaacacacactagggcagataatccctcttggtgggaagtcgatttgaaaaaaatggataaagttgggcttgttaaaatttataatcgcacagatgctgagactcaacgtctatctaattttgatgtgattctatatgacaataatagaaacgaagttgctaagaaacatgttaataatttgtcgggtgaatctgttagtctagatttcaaagaaaaaggagcaaggtatattaaagttaaattactaacgagtggagtgcctttgagtttagcagaagtagaggtttttagagaatcagatggtaagcaatctgaagaggatatagataaaataacagaagataaagtagtctctacaaataaggtagctactcaaagttcaaccaattatgagggtgtagctgctttagcagttgatggtaataaagatggagattacggacatcattcggtgactcatactaaggcagattctaacgcttggtggcaggtcgatctgggagaagagtttacggtttctaaagttgatatttataatagaacagatgccgaacctcagcgtttatctaattttgatgttatttttctatcttcatcaggagaagaagtttttagaagacattttgataaagtagttgatggtttgttatctttaaaagtaccttctgtaggggctaagctagtcaaaatagaattaaaatcagcagctattccgttaagtttagcggaagttgaagtctatggttcaaagagaactccgaagaaactttctaatattgcattaacaaaagaaactcgacagagttcaacggattacaatggtttttctcgtctagcagttgatggaaataaaaacggagattatggtcatcattcagtgactcataccaaagaagattctccttcatggtgggagatagatttagcacaaaccgaagaattagaaaagttaattatttataatagaacagatgctgaaattcagagattatcaaattttgatattattatatatgattcaaatgattatgaagtttttacacaacatattgacagtttagaaagcaataatctatccatagacttaaaaggactgaagggaaaaaaggttagaatttctttgagaagcgcaggaattcctttaagtttagcagaggtagaggtttatacttataagtaattttaaaaattatcacccaggctaccgtaaatataatggagatggtagtatgaaagaaacagaaaaataagaggaaaatagtatgattcaacatccacgtattgggattcgtccgactattgatggtcgtcgtcaaggtgtacgcgaatcacttgaagtgcaaacaatgaacatggctaaaagtgtggcagatttgatttcaagcacattgaaatatccagatggggaacctgtggaatgcgtgatttctccatctactattggccgtgtaccagaggctgcagcttcccatgagttgtttaaaaaatcaaatgtttgcgcaacaattacagttacaccatgctggtgttatggtagtgaaactatggatatgtctccagatattcctcatgctatttggggatttaatgggacagaacgcccaggagctgtctatcttgcagctgtactagcttcacatgctcaaaaagggattccagcctttgggatttatggaagagatgttcaggaagctagtgacacagatattccagaagatgtcaaagaaaaacttttacgctatgcgcgtgcagctcttgcaactggcttgatgagagacactgcttacctatcaatgggtagtgtttcgatggggattggtggttctattgtaaatccggatttcttccaagaatacttaggaatgcgaaatgaatcggtagatatgacggagttcacgcgccgtatggaccgtggtatttacgaccctgaagagttcgaacgtgcgctcaaatgggtgaaagaaaacgtaaaagaaggattcgaccataaccgtgaagaccttgttttaagccgtgaagaaaaagatagacaatgggaatttgttattaagatgttcatgattggacgtgacttaatggttggtaacccaagacttgctgaacttggttttgaggaagaagcggttggtcaccatgctttagtagctggtttccaaggtcaacgtcagtggacagaccattttccaaatggggactttatggaaactttcctcaatactcagtttgactggaatggtattcgaaaaccatttgtatttgcgacagagaatgattcactaaatggtgtgtctatgctctttaattatctattaacaaatactccacaaatctttgctgatgtgcgtacttattggagcccagaggctgttaaacgtgtaacgggacatactttagagggtcgtgctgcagctggcttcttacatctaatcaactctggttcttgtacattggatggtacaggtcaagctactcgagatggcaaacctattatgaaaccattctgggagttggaagaaagtgaagtgcaggctatgcttgaaaatacagacttcccaccagcaaaccgcgaatacttccgtggaggaggattctcaactcgtttcttgacgaagggggatatgccagtaacaatggtacgtctcaatcttctaaaaggggttggtccagtgctacaaattgcagaaggttacacacttgaacttcctgaagatgttcaccatactttagataatcgtacagatccaggatggccaactacttggtttgctccacgtttgacaggaaaaggtgctttcaagtctgtctatgacgtcatgaataattggggagctaatcacggagccataacatatggacacattggagcagacttgattaccttggcttctatgttgagaattcctgtcaatatgcataatgtacctgaggaagatatctttagacctaaaaattggtccttatttggaacagaagatctagaatcagcagactatcgtgcatgtcagttgttggggccactacataaataaaacttgtttatataggaggtgaacttacgtccctcctatccttttaaaaagatttgttaaacaattcacaaataattgaaaacgaatacaaaaagtaatataatgatgttaaatagatagcgcggaggcgcaggaggaaaattatatggctatattttatgttccggcagtcaaccttattggaaaaggtgttgtaaatgaagtgggtccttatatcaaggaacttggctataaaaaggcacttttggtgacagataagtacatcgaaggcagtgatattttacctaagactttaaaaccactggatacagaaggaatcgaatat

SEQ ID NO: 82 - DNA, 16995 bp; double-stranded, linear
agttctcttaacttttttaggatggcattctccgctctcaggtactcattttctgctgaagacgttctaattctgtcctctcttcaggtctcgtttttggcttacgtcccattttaggtactctccctcttgttttctcaacaatagtatacccgtttttcctgtattgtgctagccagttaagaagtatcgtacgacttgggagaccgtattcaagagaaactctatctttagtccagccttcatgtcagactttattactcatttcttgttttaaatcaggagaatagtaacgattttttccttttttgacgaactctattccgtaacgatcaatcaatttaatcatgtacctaatattagaattgcttatcccaaatttatttgaaagcttctctaagctatatccttgttttctaagttcatagatctgaactttatcatcataagttagtttcataataaaaacaccccaaaagttagattttttctgtctaacttttggggtgtagttcatgtacacctgatatgatgcgttttataatttttaagcctttttgcccagcctcgtcaaaagtaatgttttgacacaaaatctgtgacaaaactttagttttaaaggtttttaactttgtatatactagttttaagaaaaggaggatgatctaatggaagaaaaagtatcattgaaagtcagggttcaaaaactagggacatcgctttcaaatatggttatgcccaatattggagcatttattgcttggggagtattgactgccctctttatcgctgatggctatctgccaaatgaacagttagctactgttgttggtcctatgttaacgtatttattgccaatcctgattggttacacaggtggatatatgatccatggccaacgtggtgccgttgtaggagctattgctactgttggtgcaatcacaggttctagtgttcctatgtttatcggagctatggtaatgggcccactgggaggatggactatcaagaaatttgatgagaagttccaggaaaaaattcgtcccggatttgaaatgttagttaataacttctcagctggtctcgttggttttgcattattgcttttggctttctacgcaatcggtccagtcgtatcgactcttactggagctgttgggaatggtgttgaggctattgtcaatgctcgcctccttcctatggctaatattatcatcgaaccggctaaagtccttttcctcaataatgccctcaatcatggcatttttactcctctgggagtagaacaggtagctcaagctggtaagtcaattctcttcctattggaagctaatcctggaccaggtctgggaattctattagcttatgctgtattcggtaaaggttctgctaaatcttcttcttggggggcaatggttattcatttcttcggagggattcatgaaatttactttccttatgttatgatgaagcctactctatttttagctgctatggcaggaggtatctctggaacttttacttttcaactcttagacgctggtcttaaatctccagcttcaccaggttctattattgcgattatagctacggcgccaaaaggtgtttggccccatctaaatgttcttttaggtgttttagtggcagcagttgtttctttccttgtagcagcccttattcttcatgcagacaagtcaactgaggattcgctcgaagctgctcaggcggctacccaagcagctaaggctcagtctaaaggtcagttagtatcaacttctgttgatgcagttgtttcgacagactcagtggaaaaaatcattttcgcctgcgatgctggtatgggaagctctgctatgggagctagtattcttcgagataaggttaaaaaagcaggtctagagattccagtatctaatcaggcaatctcaaatttgcttgatacaccaaaaacattaattgttactcaggaagaactgacaccaagagctaaagacaagagtccaagtgctattcatgtttctgttgataatttcttagcgtcctctcgttatgatgaaattgtagcttcattaacaggagcttctccaatagcagaaattgaaggagatataccaacttcagcaccagtagatagtcaggaaagtgaccttaaccatattgatgctgtagtagttgcttatggtaaagcacagggaactgcaactatgggctgtgaaacgattcgggctatttttagaaacaagaatattcgtattccagtttctactgccaaaatttcagaattaggtgaatttaattctaaaaacataatgattgtaacaactatttctttacaggcagaagtgcagcaagcagcaccgaattctcaatttcttattgtggatagtttagtaacaacaccagaatatgacaaaatggctgctagaatgtacaaatagaactagaggtttctaaattacgaatgctattaaccaaacgagaagaacaattattgaaggctttcctacatgtagggaagctttcaatgcaagatatgactgaaatcttacaggtttcatctagaacaatttatcgaactttatcagatttgacagatagcatggagcaatatggaatcgaaataacgaagcatgggaaatactatattttgactggagagttggatgatttgccgacagaacttgaagtgttagttgagtatagtccccaagaaagacaagagttgattacctatcgccttctgactgagagtggttttgtcaccaatgaagcattgcaagagtgcacgaaagtcagtaatgtaactattattcaggatatttcagatattgataagcgtcttttagactttgatctgaaaattgaacgacaaaaaggttatcggatttctggtgattcagttggtaagagaagatttttggctattttactgacaaactgtatctcagtagcagatttttcaaccggtaattttgggagctttgatattttagaagcagatagaactgggctggccagtcagattgttaataagcaactgtcaggttttccagatatggatgctaggatgaagatgttttttgcgatcttgttatctcttataggtcaggagcaaaacattgaaaattcacctaatactagtaagcaggctttggaaatttctcaaaaaatttttcaagcttactctaagcagactgcacaattttatagtattcaggaaattatctattttgcgagcatcttggatgaattaatcattaaacgtcaggacaatccgctctttacggagaaatttgatggtgaatttttctacaatatttcaaatctgattgatacggtttccatgtataccaagattgacttttttaaggacaaggttttattcaattttcttttccatcatattcggctcagtttaggcgtccctatcctttttcagggtgaaaatttgccagaatctatccagattttagttgaaaggaataaatttctttatacagtcatcagtcttttagtgaatgatatttttccgaaatatcttcatacagagtatgagtatggcatgattgccctacattttatctctagcttaggccgtagtccagagatttatccagtccgtgttttgcttttaacggatgaacgtcgggtcactagagatttattagtcagtaaaattaagagtgttgctccttttgtagagttgatagatattcaatctctagtagattaccacagtattgatctcagtcagtatgattatattttatctaccaagccgctgactaatcaggaaatcgatgtaatttctagttttccaaccgtcaaagaattgcttgaattacaggaacgacttcagtatgtacaggcacatcgtacaattgtcgcgcgtgatgctatcgctccagagaaaagttatgacttgcaagattatttaatatctagtagtcagcttttgagtcaattcgagttggttcaattggagaataatcaatcatttgagcacacggtagaacaaatcatccaatatcagaagaatgtgagtgacagagcttacctaacaagaaaattgttatctcacttccagaatagtcctatggctattcctaatactggtctggtgcttttacatagtcagtctagcaaagtaacaacaaatagttttactatgtttgaactcaaactacctatctccgcattgtcaatgaaacgagaggaagaagaggtcaaaaggtgtctgctaatgctaatgtctaaagaagctagcgaggaagctagagatttaatgacagctattagtcagtcgattattgaaaatcatctttatacagagatttacaagacgggaaatcaatccattatttatcagatgctaaatactatttttaacgaaaaaattaagaaattggagaactaatatgaaacttgaaaaacatttgattaagcttaataaacaattttctaacaaggaggaagctatttgttattgtgggcaagttctttatgagggtggatatgttaatgaagactatattgaagccatgattgagcgagataaagagctatctgtttacatgggtaactttatcgccataccgcatggaacagatgcagcaaaaaatgatgtcctcaagtctggtattacagtcgttcaagtccctagaggggttgattttgggaatgtatctaaccctcaagtggcaacggttctttttggtattgctggtattggtaatgaacacttagaaattattcagaaaatttctatcttctgtgcagatgtagataatgttcttaaactagcagatgctcagtcaaaagaggaagtattgcgcttatttgatgctgttgaataattgaatttagtcatttgtcatctagtatatatgtccctcaaataggaaaaggagaaattgaatgaaacattctgttcattttggtgccggtaatatcggtcgtggttttataggtgaaattctatttaaaaatggtttccatattgattttgtggatgtcaataatcagataattcatgctctgaatgaaaagggcaagtatgaaattgaaattgcacagaaaggacagtctcgtatagaagtaactaatgtggctggcattaatagcaaagaacatcctgagcaagtcattgaagcgattcaaaagacggatattattactactgcaatcggacctaatatactcccttttatcgccgaacttctagccaaaggaatcgaagctcgccgagttgcaggaaatacacaggcattggatgttatggcctgtgaaaatatgattggcgggtctcaatttctttatcaagaagtcaagaaatatttaagtccggaaggtttgacatttgctgataactacataggttttccaaatgctgcagtagacaggattgttccagcacaaagtcacgaagattccctttttgttgtggtcgagccctttaatgaatgggtcgtggaaaccaagcgtcttaaaaatccagatttacgtctaaaagatgtgcattatgaagaagatttagaaccctttattgagcgaaaacttttttcagtcaattctggacatgcaacttcagcttacattggtgcgcattatggtgccaagacaattttggaagctcttcaaaatcctaatattaaatctcggattgaatctgtattagctgaaattcggagtctcttgattgccaaatggaactttgataaaaaagaattggagaattatcacaaagtcattatagaacgacttgaaaaccctttcatagtggacgaggttagtcgcgtagctcgtactccaatccgaaaattaggctataatgaacgattcatccggccgatacgtgaattgaaagaactcagtttgtcatataaaaacctacttaaaacagttggctatgtctttgactatcgcgatgtaaatgatgaagaaagtattcgattaggtgaattgttggctaaacaatcagtcaaagatgttgttatacaagttacaggtttagacgaccaagaattgattgagcaaattgtagagtatatttaatctttttcgaaaatctcttcaaatcaggttagcatcgctttgtcttaggcatatgttgttctatctacaacctcaaagcagtgctttgagctgactccgtcagtcttatctgcaatctcaaaacactgtttgagttatctgcggtaatctttctagcttgtctttgatttttgttgttatttataaggtaaaagaagctggacaaaaagtcttcaaaatcgggaaaaggcagcctatcgggtgttcaaaaatcttgataggatgtcctttattatggaaagccttattggattttctcctcagattgagtttttgatcagctttatgagataggtcttgctagagatgtagcccatcatgttatttttatggacagtgggaaaattgttgaaaaaaataatgcccatcaattctttagtcgtccaagagaagaacgaaccaagcaattttggaacgaattctttcgaatgcgatctatatagtaaaatgaaacaagaacaggacaaatcgatcaggacagtcaaatcgatttctaaaaatgttttagaagtagaggtgtactattctagtttcaatctactatataactgaaaaattagataaattagttttggaaaatgactaaccaaaagatatccaaagtagtctaaaattgtctatactttatgagtgttttagttaggaaaaaggcttgttgtctataattgtctgcattagtctagattttatttatagaaaatgttataatagactgtatttaaaaaattttaaggagaaatgacagaatgtctgtatcatttgaaaacaaagaaacaaaccgtggtgtcttgactttcactatctctcaagaccaaatcaaaccagaattggaccgtgtcttcaagtcagtgaagaaatctcttaatgttccaggtttccgtaaaggtcaccttccacgccctatcttcgaccaaaaatttggtgaagaagctctttatcaagatgcaatgaacgcacttttgccaaacgcttatgaagcagctgtaaaagaagctggtcttgaagtggttgcccaaccaaaaattgacgtaacttcaatggaaaaaggtcaagactgggttatcactgctgaagtcgttacaaaacctgaagtaaaattgggtgactacaaaaaccttgaagtatcagttgatgtagaaaaagaagtaactgacgctgatgtcgaagagcgtatcgaacgcgaacgcaacaacctggctgaattggttatcaaggaagctgctgctgaaaacggcgacactgttgtgatcgacttcgttggttctatcgacggtgttgaatttgacggtggaaaaggtgaaaacttctcacttggacttggttcaggtcaattcatccctggtttcgaagaccaattggtaggtcactcagctggcgaaaccgttgatgttatcgtaacattcccagaagactaccaagcagaagaccttgcaggtaaagaagctaaattcgtgacaactatccacgaagtaaaagctaaagaagttccggctcttgacgatgaacttgcaaaagacattgatgaagaagttgaaacacttgctgacttgaaagaaaaatacagcaaagaattggctgctgctaaagaagaagcttacaaagatgcagttgaaggtgcagcaattgatacagctgtagaaaatgctgaaatcgtagaacttccagaagaaatgatccatgaagaagttcaccgttcagtaaatgaattccttgggaatttgcaacgtcaagggatcaaccctgacatgtacttccaaatcactggaactactcaagaagaccttcacaaccaataccaagcagaagctgagtcacgtactaagactaaccttgttatcgaagcagttgccaaagctgaaggatttgatgcttcagaagaagaaatccaaaaagaagttgagcaattggcagcagactacaacatggaagttgcacaagttcaaaacttgctttcagctgacatgttgaaacatgatatcactatcaaaaaagctgttgaattgatcacaagcacagcaacagtaaaataatcttaataaacagaaaacccacctgaattggtgggttttctgatgcactattttccaaaaatctctttgaggtctgtgtctgtaatcccaatcatggctgggatgcggtcccagttttcttcggttaggatgtaggattgttcagaggcacttgatgtgactgtttcagagacagcttgttgcttttcttcaacattctccagtagatcactgaagcgttcaatcagataggtttttcgggcagttccgatgtgttgggtagcatagtcgaaggcttgtaattcgcctagtaagatgagtttgcttttggcacgtgtaatggctgtgtagatgagatttcgctccagcatacgtcggctagcactagtaatcggtaggatgacaactgggaactcacttccctgagacttatgaatactcatggcataggccaagcgaatcttgtaccattcgttacgggggtaagagacttcattaccatcaaaatcaatgacaatctcgtcttgtttcgattcggtgtatttaccaggaatcaggtctgtgatagctcctaaatccccattaaagacattgatttcagcatcgttaaccaaatgaatgaccctgtctctcttacgatagtgacactgaggagcttcaaaactgagttgatctttttgtgggggattgagcaggtcttgcatgagctgattgatagcatcaatccctgccgtccctcggtacataggagccagaacttggatatcacgggcgggaataccatttctgagggcggcacctaagattttttcaatggtggcaggaatatggccactagcaatttcaaagtaggaacggtcagcttttttttgggtgaaatcagctggcaagatgccctgtcgaatctgactagctagggtgacgatggttgattctttgctttgtcgataaattttttccaagcgagtctgaggaatcaaaggaatatgaagtagatccgctagaacctgtccaggactgacagaaggtagctgatcactgtcacctacgatgaggatcttactgttagaagagatattggagaagagttgattggccagccaagtatctaccatagagaattcatccacgatgataaagtcagcatctaggtaatcttccagatgactggtatcatcgtcacctgtcattcccaagtggcgatgtatggtcgcgctaggcaaacctgtcaattcattcatgcgacgagcagctcgaccagttggagcagcaagaagaatgggcagattgcttttcttcctgaagtcaagtccttctaaaagggcataaacagcaatgattccattgataacagttgtcttaccagtaccaggcccacctgtcaggataaagaccttattctggatagcatcacagatagcctgtttttgaatgttatcatactcaattcccagttcttgctcgacagtagtgatatgtttttgaatggtttctaaatcatgactcttctgttttcctttttcaaggatacgaaccaagtgactgcggatgccttcctcagcgaaaaagaggctgttgtcaaagatcttggtatcaatctgctgaaccttgtcttcttcgatcaggtaggagagctcttgggcaacttggctggggtctagttccacgggacgggaagactcaaggagagtaagggtttgttccagcaaatcccgtgcttcaacataggtgtcccctgtttccatacaggcctgaaaaagactgtgaactagaccggcgcggaagcgttcaggagcctgactttcgatgcctagttcctcagctagttggtcagcaatggtaaagcccaaacccttgatatcctcaaccagctggtagggataattttcaaccacatcaagggtttcttccttgtaaaagtcttgaatctgaaaggctagtttgttgggaatgccgtagttggctagtttggccaaaatcatctccgttccgtagttgagacggagagtggagacgaaagcctcgcgatttttggcagagagtcctgcgatgccttctaacttttctgggtgttgcaaaatttcgtcaatggtattttcgccataggtatccacgattttctgagctgtcttgagaccaatccccttgaaatggctacttgaaaagtacttgaccaagcccttactagttggttttgcgcgatcataacgactgatttgcagttgttctccatacttggagtgctggacaatttgcccccaaaaagtatagtcttcgccctcaattacatcagccatggttcctgtgacaatgatttcaaaatcatcaaaatcctctgcgtccgtatcgtcgatttctaggaggaggatgcgataaaaattgctgggattttcaaaaataatccgttcaatagttcctgaaaaataaacttccataaaattcctttgcatgaataggtgagagttgggattgtttttattttatactcttcgaaaatatcttcaaaccacgtcagcttccatctgcaacctcaaaacagtattttgagctgacttcgtcagttctatccacaacctcaaaacactgttttaagcagcctacggctagcttcctagtttgttctttgattttcattgagtatttgtaaataaacaatcacttctcacgatagaagaagaggctgagattggtgattctctgcctcttaggtttcttaaaatgttccgatacgggtgattggccataagcggaatttagcttcccctgtgatatcttttgctttgaaggtacctacgtggcggctgtcgctcgaaaccaagcggtcatctccgaggagaaggtattctccttctggaacagtaaagctaaagttggtgttgtagttgacatcaactgtgaaggcttgagctttttgagcgatacttctaaagaaagttcctttatttccttcaaagcccttgcctgagtaagtgctttggagtttgtcatccttgaagcgtttgatatagtctgctagataaggctcgtccgtttctttgtcattgatgtagagtttatcattttcgtaacgaatggtgtcgccaggcattccaatcacgcgcttgacgatgtccttattgccatcttcctcatgggccaccacgatatcaaaacggtcaataggaaggtgttttacaacgaagagaatttcgccatccgctagggtcggatccatggaatgtccttctacgcgaacattgctccaaaaaaagatacgacttaaagctagtaatgacagaattaggaggaacaatccccactcttttaagaaatttttaaatgaattcataacttacctttctaagcgttttttcgctttttcagtgtttttaaagtgcaatttggcgcagaagctgagtccctgcataccataggcttgcaaaatctggctagccaccttgtcagaagccgttccagctccacttgggagctgataacccagttctcgtcccaaattttcaagattttccagaaagagatcacgcgcaatgacagaagaaactgcgacagacaagtatttgccctcagccttttcttctaagctgataggattgctgaaacgattggcctcttgtgccaagtacttgtcataatttttagcactggtaaaggcatcaatcacaattttctcaggctgaacacctttttgaaggaggagatagatagcctgattatggagggcaaccttaaccgaaacagcgttgtagcggtctccgatgacctcgttgtacttgctgggtgagagaaggagtgcctggtgctgaattttttccttgagaataggagtaatctgacggatcttttggtcggtcagagtcttagaatcccccacaccgagttttcgtaaaaagtcgtgctggtcaggtgtgacaaaggcagccacaactgcaagcccaccaaagtaggaaccatttcccacctcatctgtcccaattaaaggaagattttgtccgctggtttgctctacagcttgatagccaaagaaactggcgtatttttcagccccttcaccctgaagcaagatttttccagaagtatagatagaaaccgttgcttgaggtagtttcaaaaagtagcggatatagggattcttgctaggagccagactggtttgatagtgttcaagaaaagcctgaatatccttttcgcttggtgtgagtgtgatacttgccatagtttctattgtaccacaaaagcagtaaaatttgtaaaaactgacaaaattagcgaattttggtataatatcgtgaggtgaattttatggcaaatctaaatcgattcaaatttacattcgggaaaaaatcgttaaccttgacaagcgaacatgacaacctttttatggaggaaatcgctaaggttgcgacagaaaaataccaagcaattaaagaacaaatgcctagcgcagatgatgaaacaatcgctcttttgttggcagtcaactgtttatcaactcagctcagccgtgagattgaatttgacgataaggagcaagagctagaagaactccgtcacaagcttgtgacttgtaagcaagaacagagcaagattgaggattccttatgatttcattccttcttctattggtcttggtttggggattttatatcggctatcggagaggcctgctcttacaggtttattacctgatttcagccatggcatcggcttttatggctggccagttttataaggggcttggagagcaattccatttattgctcccttatgcaaattcgcaggaaggtcaggggactttctttttcccatcggatcaactctttcagctggataaggtcttttatgcaggtatcggctacttgcttgtatttgggattgtctatagcattggtcgtttacttggtcttctcttacacttgattcctagcaaaaaactgggtggtaagttgttccaagtttcagcaggtatcttgtccatgttggtgaccttatttgtcttgcaaatggccttgacaatcttggcgaccatccccatggcagttatacaaaatcctcttgaaaagagtatcgtcgcaaaacacatcatccagagcataccggtaacaaccagttggctcaaacaaatctgggtgacaaatttaatcggataaaaagggcaggagttttcctagccctttgtttacagatttgactcgaatctatcagaatgtaaaaagctaccacacctagacattcaaagacaaggaaataaagatgaataagaaaatattagaaacattagagttcgataaggtcaaggccttgtttgagcctcatttgttgaccgagcagggcttggagcaattgagacaactggctccgactgccaaagcagataaaatcaaacaggcttttgctgagatgaaggaaatgcaggctcttttcgtcgagcaaccgcattttactattctctcaactaaggaaattgcaggagtctgcaagaggttggagatgggagcggatctcaatatcgaggagttcctactcttgaaacgcgtgcttcttgccagccgagaacttcaaaatttttacaccaatctggaaaatgtcagcttggaagaattagccctttggtttgagaaattacatgattttccgcaattacaaggaaatcttcaggcctttaatgatgcgggtttcattgaaaattttgccagtgaagaattggcgcgaatccgtcgaaaaatacatgatagcgagagtcaggtacgcgatgttttacaagacttgctcaagcaaaaagcgcagctgttgacggaaggaattgttgctagcagaaatggccgtcaggttttaccagtcaaaaacacctaccgcaataagattgcaggtgtcgttcatgatatttctgctagtggaaacaccgtctatatcgaaccccgtgaggtagtcaaactgagcgaagaaattgctagtctgcgagcagatgagcgctatgaaatgcttcgcattctccaagaaatttctgagcgtgtccgccctcatgcggctgagattgctaatgacgcttggattatcggtcatctggacttgattcgtgccaaggttcgatttatccaagaaagacaagcagtcgtgcctcagctgtcagaaaatcaagagattcaactgctccatgtctgccatcctttggtcaaaaatgccgtcgcaaatgatgtctattttggtcaagatttaacagctattgtcattacaggtcccaatacaggtgggaagaccatcatgctcaaaactctgggcttgacacaggtcatggcccagtcaggattgccgattttagcagacaagggaagtcgtgttggtatttttgaagaaatctttgctgatattggagatgagcagtctattgagcagagcttgtctaccttctctagtcatatgaccaatatcgtggatattcttggcaaggtcaaccaacattcactcttacttttggatgagttgggggctggtactgatccccaagagggagcagcccttgccatggctattctggaggaccttcgcctgcgtcaaatcaagaccatggcgacgacccactatccagaactcaaggcctacggtattgagacagcctttgtgcaaaatgccagtatggagtttgatactgcaactcttcgcccgacctatcgctttatgcagggtgttcctggccgaagtaatgcctttgaaattgccaaacgtctaggcctatctgaagttatcgtaggagatgccagtcagcagatcgatcaggacaatgacgtcaatcgtatcattgagcaattagaagagcagacgctggaaagccgcaaacgtttggacaatatccgtgaggtggagcaagaaaatctcaagatgaaccgtgcgctaaaaaaactctacaacgagcttaatcgtgaaaaggaaaccgagcttaacaaggcgcgtgaacaggctgctgagattgtggatatggccctaagtgaaagtgaccagattctcaaaaatctccacagtaaatcccaactcaagccccacgaaatcattgaagccaaggccaagttgaaaaaattggctcctgaaaaagtggacttgtctaaaaataaggtccttcaaaaggccaagaaaaaacgagctccaaaggtgggagatgatatcgtggttctcagttatggtcagcgtggtaccttgaccagtcaactcaaggacggtcgctgggaagcccaagttggcttgattaagatgaccttggaagagaaagagtttgatcttgttcaagcccagcaagaaaaaccagtcaagaagaaacaggtcaatgttgtgaaacgaacttctgggcgaggacctcaagctagactggatcttcgaggcaagcgctatgaagaagccatgaatgagctagataccttcatcgaccaagccttgcttaacaatatggctcaagttgatatcatccatggtatcggaacaggagtcatccgtgaaggagttaccaaatacttgcaaagaaacaaacatgtcaagagtttcggctatgccccacaaaatgctggaggcagtggtgcgactattgtcacttttaaaggatagcagtattctggactttataaagtaaaaactgttgaactaatttttactaataaacacattgacaaaagccaacattttttgtaaaattagaatcaattaaataccaacaccgaatgaagtttaatagaagtggggaatcgtttgattttccatgactgtaaatggacggaactctggagagaccgtaaaggcaccgaagggcaaggcaggcaactgctcaaactctcaggtaaaaggacagagctaggatagaccgctttttagcatttatctaagcattccagagtacatgtatcttgcatgtgctctttcttttggggttgaaacgataggagaaggaaatgttagaattgcttaaatcaatcgatgcttttgcttggggaccgcccctcttgattttattggtcggaacagggatttacctaactattcggctaggactcttgcaggttttgcgtctacccaaggcctttcagcttatttttatccaggataagggacatggtgatgtatccagttttgcagctctgtgtacagccttggcatcaactgttggaacaggaaatatcataggagttgcgacggctatcaaggttggtggaccaggagctctattttggatgtggatggcggctttctttggaatggctaccaagtatgcggaaggactcttggccatcaaataccgcaccaaggacgaccatggtgcagtagcgggaggtcccatgcattatatccttctagggatgggagaaaagtggcgaccacttgctgttttgtttgcagtagcaggagtattggttgctctcttgggaatcggaaccttcacccaagtcaactcgattgcagaatctatccaaaatacaacgacgatttcgccagccatcacagctctcgtcttgtctgtctttgtagcgattgcagtctttggtggactcaagtctatttctaaggtttcaactactgttgttccttttatggccatcatttatatcttaggaactcttacagttattttctttaatatcggaaaaatccctggcacaatcgctttagtctttacctcagcttttagtccccttgctgcggtaggtggatttgctggtgctagcgttcggatggctattcaaaatggtgtggcgcgtggtgtgttctcaaacgaatctggtctgggttctgctcctattgcagctgcagctgccaagacaaatgaaccagtagagcaaggtttgatttccatgacaggaacctttattgataccctcatcatttgtactctaactggtttgaccatcttggtaactgg

SEQ ID NO: 83 - DNA, 28473 bp; double-stranded, linear
ccggggcttttgtagtataatagagatacgttttgaaagtaggaggtatctatggacttaactaagcgctttaataaacagttagataaaattcaagtttcgttgattcgtcagtttgaccaggctatttcggagattcctggggtcttgcgtttgaccttgggggaacctgattttacaacgccagaccatgtcaaggaggcgggcaagcgagcgattgatcagaaccaatcctactatacagggatgagtggtctgctgactctacgtcaggcagccagtgactttgttaaggaaaagtaccaactggactatgctcctgaaaatgaaatcttggttacaattggggcgacagaggctttatctgcgactttgacggctattttggaagagggagacaaggtacttttgccagctcctgcttatccaggctatgaaccgattgttaacttagttggggcagaaattgttgagattgatacgactgaaaatggttttgtcttgactcctgagatgttggagaaggccattttggagcagggtgataagctcaaggcggttattctcaactatccagccaatccgacaggaattacctacagtcgagagcagttagaggccttggcagctgttttacgcaagtacgaaatttttgttgtctgtgatgaggtttactcagaattgacctacacaggcgaagccatgtgtctctaggaacgatgttgagagaccaggctattattatcaatggtttgtctaaatcgcatgccatgacaggttggcgtttggggctgattttcgctcctgcgaccttcacagcccagttaatcaagagtcaccagtacttggtcactgccgcaaataccatggcgcaacatgctgcggtagaagccttgacggctggtaaaaacgatgcggacccatgaagaaggaatatatccaacgtcgggactatatcatcgaaaaaatgactgctcttggttttgagattatcaaaccagacggtgccttctatatttttgctaaaattccagcgggctacaatcaagactcctttgcttttctgaaggattttgctcagaagaaggccgttgcctttatccctggtgcagcctttggacgttacggggaaggctacgtccgcctatcttatgcagccagcatggagactatcaaagaagccatgaaacgacttgaggagtacatgagagaagcatgattcagtctatcacgagtcaaggcttggtgctttacaatcgcaattttcgtgaggatgacaagctcgtcaaaatttttacagagcaggttggcaaacgcatgttttttgtcaaacacgctggtcagtctaagctggcgcctgttattcagcccttggtgctggcacgatttctcttgcgaatcaatgatgacggactcagttacatcgaagactatcatgaggtcatgacttttcccaagattaatagtgacctctttgtcatggcctatgcgacctatgtggcagctcttgcagatgctagtttgcaggacaatcagcaggatgctcccttgtttgcttttttgcaaaagactttggagttgatggaagcaggcttggattatcaggttttgaccaatatttttgaaattcaaattttgactcgatttggaatcagcctcaattttaatgagtgtgtcttctgccatcgggttggtcaggcttttgacttttctttcaaatatggagcctgcctctgtccagagcattatcatgaggataagagacgttgtcatctcaatcccaatatcccctatctgctcaatcaatttcaagctattgattttgagactttggagaccatttcgctcaagcctggaatcaagcaagagctacgccaatttatggatcaattatatgaagagtacgttgggattcacctaaaatcaaagaaatttattgattccctagcagactggggacaattactaaaagaggaaaagaaatgaaaaaaatcgcagtagatgccatggggggcgattacgcacctcaggccattgttgagggtgtcaatcaagccctatctgacttttcagatatcgaggttcaactttacggagatgaagctaaaatcaagcaatatctgacagcgacagagcgcgtcagcattatccatacggatgagaagattgattcggatgatgaacctacgagagctattcggaataagaaaaatgccagtatggtattggcagccaaggctgtcaaagatggtgaagcagacgctgtcctttcggctgggaatacaggtgccttgttggcagcaggattcttcatcgtgggtcgtatcaagaatatcgaccgtcctggactcatgtctaccttgcctaccgttgatggaaaaggttttgacatgctagaccttggtgccaatgcagaaaatacagcccagcacctccatcaatatgcggttctaggttccttctatgctaaaaatgtccgtggcattgcgcaaccacgcgttggtttgctcaacaacggaacagagagtagcaagggcgacccgcttcgtaaggaaacttatgaattactggcggctgatgaaagtttgaactttatcggaaacgtggaagcgcgtgatttgatgaatggcgttgcagatgttgttgtggcagatggtttcacgggaaacgctgtgctcaaatccatcgaagggacagctatgggaatcatgggcttgctcaagacagctattacaggtggtggtcttcgagcgaaactaggtgccctccttctcaaggacagcctcagtggtttgaaaaaacagctcaattattcagatgttggtggagcggtcttgtttggtgttaaggcacctgttgtcaagactcatggctcaagcgatgccaaggctgtttatagtacgattcgtcagatccgtaccatgctagaaacagacgtggttgcccagactgcgcgtgaattttcaggagaataaaagagatgacagaaaaagaaatttttgaccgtattgtgaccattatccaagagcgacagggagaggactttgtcgtgacagaatccttgagtctgaaagacgatttggatgcggattctgttgacttgatggagtttatcttgactctggaagatgaatttagtatcgaaatcagcgatgaagaaattgaccaactccaaaacgtaggagatgtggttaaaatcattcaaggaaaatagcaatcggagttccaagtcaacggaagtagatggtttttagaaatgagaaatatcggacaagctggtaaaatcttggctgacagtggttatcaagggctcatgaagatatatcctcaagcacaaactccacgtaaatccagcaaactcaagccgctaacagttgaagataaagcctgtaatcatgcgctatctaaggagataagcaaggttgagaatatctttgccaaagtaaaaacgtttaaaatgttttcaacaacctatcgaaatcatcgtaaacgcttcggattacgaatgaatttgattgctggtattatcaatcatgaactaggattctagttttgcaggaagtctaatagtaaaaaagtgattagaaaacatcttttttaaaaatagagatgattttgaaacaaaaaagctaattcaagacgtttcgatgccaattcaagatttggatgaaaaaaattaatagatactgttatactaaacttgtcaagtttgtaacaagacaaatattaaaaataaaaaagaggtattcgttatgaatacaaaaacgatgtcacaatttgaaattatggatactgagatgcttgcttgcgttgaaggtggcggatgcaattggggagattttgccaaagcaggtgttggaggaggagcagcacgaggtcttcagctaggaattaaaacaagaacatggcaaggtgcagcaactggtgctgtgggaggagctatacttggaggtgtggcctatgcagcgacatgttggtggtaattatggattttaaaagttttattattggtttagtagttggtatatttggtccttatatggatgatttaattagaaaaaaatttttaaagtcttcggagaagaaaacagaaaaatctgttaaaaaataatcaaaactataaatgatgaatctgaatcaaaattattttgcgcatgtaaagaggagtcttatagtaacgagtcaaaaaaggagtaactatgaatcgtaatttagaacggtgttatctattctgactaggaatagatcataccagaggtagcttagaaatagcagagacattagaaattgaagtaataaataggatgtcgtaagtgttactatcaatgatttatttgtttcaagcttgcctagggtgacagtaaaaaatcaatttcctttcaatagcatatttttagtgggcaggactcttgttctgcctatttttttatccaaaaagtgcagttgggagggagataggctcatttgggaaggaagtccagtttttgtttagtgattggggtaagatagttgttatcagatgagttaatactcttcgaaaatcaaattcaaaccacgtcaacgtcgccttgccgtatatatgtgactgacttcgtcagtcctatctacaacctcaaaacagtgttttgagcagcctacggctagtttcctagtttgctctttgattttcattgagtattagggaaaaggagatgaatatgaaatttgggaaacgtcattatcgtccgcaggtggatcagatggactgcggtgtagcttcattagccatggtttttggctactatggtagttattattttttggctcacttgcgagaattggctaagacgaccatggatgggacgacggctttgggcttggtcaaggtggcagaggagattggttttgagacgcgagccattaaggcagatatgacgctttttgacttgccggatttaacttttccttttgttgcccatgtgcttaaggaagggaaattgctccactactatgtggtgactgggcaggataaggatagcattcatattgccgatccagatcccggggtgaagttgactaaactgccacgtgagcgttttgaggaagaatggacaggagtgactctttttatggcacctagtccagactataagcctcataaggaacaaaaaaatggtctgctctcttttatccctatattagtgaagcagcgtggcttgattgccaatatcgttttggcaacactcttggtaaccgtgattaacattgtgggttcttattatctgcagtctatcattgatacctatgtgccagatcagatgcgttcgacactagggattatttctattgggctagtcatcgtctacatcttccagcaaatcttgtcttacgctcaggagtatctcttgcttgttttggggcaacgcttgtcgattgacgtgattttgtcctatatcaagcatgtttttcacctccctatgtccttctttgcgacacgcaggacaggggagatcgtgtctcgttttacagatgctaacagtatcatcgatgcgctggcttcgaccatcctttcgattttcctagatgtgtcaacggttgtcattatttcccttgttctattttcacaaaataccaatctctttttcatgactttattggcgcttcctatctacacagtgattatctttgcctttatgaagccgtttgaaaagatgaatcgggataccatggaagccaatgcggttctgtcttcttctatcattgaggacatcaacggtattgagactatcaagtccttgaccagtgaaagtcagcgttaccaaaaaattgacaaggaatttgtggattatctgaagaaatcctttacctatagtcgagcagagagtcagcaaaaggctctgaaaaaggttgcccatctcttgcttaatgtcggcattctctggatgggggctgttctggtcatggatggcaagatgagtttggggcagttgattacctataataccttgctggtttactttactaatcctttggaaaatatcatcaatctgcaaaccaagcttcagacagcgcaggttgccaataaccgtctaaatgaagtgtatctagtagcttctgagtttgaggagaagaaaacagttgaggatttgagcttgatgaagggagatatgaccttcaagcaggttcattacaagtatggctatggtcgagatgtcttatcggatatcaatttaaccgttccccaagggtctaaggtggcttttgtggggatttcagggtcaggtaagacgactttggccaagatgatggttaatttttacgacccaagtcaaggggagattagtctgggtagtgtcaatctcaatcagattgataaaaaagccctgcgccagtacatcaactatctgtctcaacagccctatgtctttaacggaacgattttggagaatcttcttttgggagccaaggaggggacgacacaggaagatatcttacgggcggtcgaattggcagagattcgagaggatatcgagcgcatgccactgaattaccagacagaattgacttcggatggggcagggatttcaggtggtcaacgtcagagaatcgctttggcgcgtgctctcttgacagatgcgccggtcttgattttggatgaggcgactagcagtttggatattttgacagagaagcggattgtcgataatctcattgctttggacaagaccttgattttcattgctcaccgcttgactattgctgagcggacagagaaggtagttgtcttggatcagggcaagattgtcgaagaaggaaagcatgctgatttgcttgcacagggtggcttttacgcccatttggtcaatagctagaaagaggagaggatgaaaccagaatttttagaaagtgcggagttttataatcgtcgttaccataatttttccagtagtgtgattgtacccatggcccttctgcttgtgtttttacttggctttgcaactgttgcagagaaggagatgagtttgtccactagagctactgtcgaacctagtcgtatccttgcaaatatccagtcaactagcaacaatcgtattcttgtcaatcatttggaagaaaataagctggttaagaagggggatcttttggttcaataccaagaaggggcagagggtgtccaagcggagtcctatgccagtcagttggacatgctaaaggatcaaaaaaagcaattggagtatctgcaaaagagcctgcaagaaggggagaaccactttccagaggaggataagtttggctaccaagccacctttcgcgactacatcagtcaagcaggcagtcttagggctagtacatcgcaacaaaatgagaccatcgcgtcccagaatgcagcagctagccaaacccaagccgaaatcggcaacctcatcagtcaaacagaggctaaaattcgcgattaccagacagctaagtcagctattgaaacaggtgcttccttggccggtcagaatctagcctactctctttaccagtcctacaagtctcagggcgaggaaaatccccaaactaaggttcaggcagttgcacaggttgaagcacagatttctcagttagaatctagtcttgctacttaccgtgtccagtatgcaggttcaggtacccagcaagcctatgcgtcagggttaagcagtcaattggaatcccttaaatcccaacacttggcaaaggttggtcaggaattgacccttctagcccagaaaattttggaggcagagtcaggtaagaaggtacagggaaatcttttagacaaggggaaagttacggcgagtgaggatggggtgcttcatcttaatcctgagaccagtgattctagcatggttgcagaaggtgccctactagcccaactttatccatctttggaaagagaagggaaagccaaactcacagcttatctaagttcaaaatatgtagcaagaatcaaggtcggtgattctgttcgctatactacgactcatgatgccgggaatcaacttttcctagattctactattacaagtattgatgcgacagctactaagactgagaaagggaatttctttaaaatcgaggcggagactaatctaacttcggagcaggctgaaaaacttaggtacggggtggaaggccgcttgcagatgattacgggcaagaaaagttacctacgttattatttggatcaatttttgaacaaagagtaatgttcgtgtttttagagttaaataatttttaaactgtgagaaagattcttcttgcagttttttctttacaatttttgaaaaacatctactatttattcggttaaattcttgtgttttttggttttttgtggtaaaatgtgctcaagtaatacgaaaggcgaactttaaaatgtcaaaacaattgatctattcgggaaaagctaaagatatctatacaactgaggatgaaaatcttattatttcaacttacaaggaccaggcgactgctttcaacggtgtcaagaaggagcagattgcaggtaagggagtcttgaataatcagatctcatcttttatttttgagaaattaaatgtggctggtgtggcgactcactttgtggagaaactttcagacacggaacaactcaataaaaaggttaagattattcctttggaagtcgtgctccgcaactatactgctggttccttttcaaaacgttttggtgtggatgagggaatcgccttggagactccgattgtcgaattttactacaaaaatgatgatttggatgatccatttatcaatgatgagcatgtgaaattcctacagattgcgggtgaccagcagattgcctacttgaaggaagaaacgcgtcgtatcaatgaactattgaaagtctggtttgctgagattgggcttaaattgattgactttaagctagagttcggttttgacaaggatggcaagattatcttggcagacgaattttcaccagataactgccgcttgtgggacgctgatggcaaccacatggataaggatgttttccgtagaggattgggagaactaaccgacgtttatgagattgtttgggaaaagttgcaggaattgaaataatctgtttgcaacggaaaaccttcgtctctcaactaaaaggactcaggctgaaaaggtcccccagaccttttcactctgtagagaactaggtgaactaacagatgtttacgaaattgtctgggaaaagttgcagggtttaaaataacaacctcaaggctgtttgggaatattgcaagagctgaaataaaggaataagaattgatggataaacgtatttttgttgaaaaaaaggctgattttcaggtcaagtcagagagtttggttagagagctccagcacaacttgggactgtcaagcttgaaaagtattcgtattgtgcaagtatatgatgtatttgacttggctgaggacttgtttgcacctgcagagaagcacattttctctgagcaggtaaccgaccatgttttagatgaagtatctgtgcaggcggatcttgctaactatgctttctttgccattgaaagtctgccagggcagtttgaccagcgtgcagcttcgtcacaggaagccttgcttttgttgggaagttcgagtgacgtgacagtcaacacagcccaactttacttggtgaataaagatattgatgcgactgagttggaagctgtcaaaaactacctgctcaatccagttgattctcgtttcaaggatatcacgacagggattgccaagcaggagttttcagagtcagacaagaccattcccaaattgactttctttgaaagctatgcagcagaagactttgctcgctacaaggccgaacaagggatggccatggaagtggatgatttgctctttatccaagactactttaagtcaatcgggcgcgtgccaactgagactgaactcaaggttttggacacttactggtctgaccactgccgtcatacgacttttgagacagagttgaaacacatcgacttttcagcttctaaatttcaaaagcaattgcagtcaacctatgacaagtatattgccatgcgcgaggaattaggtcggtctgaaaaaccacaaaccttgatggatatggcgactattttcggtcgttatgagcgtgctaatggacgattggatgatatggaagtctctgacgaaatcaatgcctgctcagttgaaattgaagtggacgttgatggtgtcaaggaaccttggctcctcatgtttaaaaacgaaacccacaaccatccaacagaaattgagccatttggtggagcggctacctgtattggtggagctattcgtgatccgttgtcaggccgttcctatgtttaccaagccatgcgtatttcaggtgctggtgatattacagcaccgatttcggaaactcgcgctgggaaattgccacaacaagtcatttctaaaacagcagctcatggttattcttcatatggtaaccagattgggcttgcaacaacctacgttcgtgaatacttccacccaggctttgtagctaaacgtatggaacttggtgccgttgttggtgcgactcccaagggcaatgttgtccgtgaaaaacctgaagcaggtgatgtgatcatccttctcggaggcaaaacaggtcgtgatggtgtcggtggtgcgacgggctcttctaaggttcaaacagttgagtctgtagagactgctggtgctgaggttcaaaaaggaaatgccatcgaagaacgcaagattcagcgcctcttccgtaatggcaatgtcactcgtctgatcaagaagtccaatgactttggggcaggcggtgtctgtgtggctatcggtgaattggcagacggtcttgaaatcgacctcaacaaggtgcctcttaaataccagggcttgaatggtacagaaattgccatctctgaatcacaagaacggatggcggtcgtggttcgtcctgaagatgtggatgccttcgttgccgaatgtaacaaagaaaatattgatgctgttgtggtggcgacagtaactgaaaaaccaaatcttgtcatgcactggaatggtgagacaatcgttgacttggagcgtcgtttccttgacaccaatggtgtgcgcgtggttgtcgatgccaaagttgtggacaaggatgtcaaactcccagaagagcgtcaaacatctgctgaaacactggaatcagatacccttacggttctatctgacctcaaccatgcaagtcaaaaaggattacagactatctttgactgctctgttggacgctcaacggttaatcacccacttggtggtcgttaccaactcacaccaactgaggcatctgtgcagaaattgccagttcaacacggtgtgactcatactgcgtcggtcattgctcaaggtttcaacccatatgtagctgaatggtctccataccacggtgctgcttatgcggttatcgaagcaactgctcgtttggtggctgctggtgccaactggttcaaggctcgtttctcttaccaagagtatttcgagcgtatggataaacaagcagagcgtttcggtcagccagtagctgctcttctaggttctattgaagcacaaattcagcttggcttgccatctatcggtggtaaggactccatgtctggtacctttgaagaattgaccgttccgccaaccttggctgcctttggggtgacgacggcagatagccgtaaggtgctctctccagaatttaaagctgttggggaaaatatctactacatcccaggtcaagccctctctgcagagattgattttgacttgattaagaaaaattttgctcagtttgaagccatccaagctgaccataaagtgacatctgcatcagctgtcaaatacggtggtgtagttgaaagtttggctcttgctacctttggaaactatattggtgcagaggtgaccttgcctgaacttgaaacagctttgacagctcaattaggcggctttgtcttcacatctcctgaagaaattgctggagtagagaaggttggacaaacgaaagcagactttacactgactgtcaacggtgtgaagctagatggacacaagcttgacagtgcatttcaagggacattggaagaagtttacccaacagaatttacccaagcgaaagaactagaagaagtaccagctgtggcatcagatgttgtgattaaagccaaagaaaaggttgaaaaacctgtggtttacatcccagtctttccaggaaccaactcagaatatgattcagctaaggccttcgaaaaagaaggtgcagaggtcaatttggtgccattcgtgaccttgaatgaagaagctattgtcaagtcagttgaaactatggttgacaatatcgacaagactaatattctcttctttgctggtggattctcggctgcggatgaaccagatggttcagctaagtttatcgtcaatatcctgcttaatgaaaaagtgcgtgtggctattgatagctttatcgcccgtggtggtttgattatcggtatttgtaatggattccaagccttagtcaaatcgggtctcctaccctacggaaactttgaagctgctaacagtactagcccaaccctcttctacaatgatgccaaccaacacgtggccaagatggtggaaactcgcattgccaataccaactcaccatggttggttggtgtgcaagtgggcgatatccacgctattcctgtttcgcacggtgaagggaagtttgtcgtgacggctgaggaatttgcagagctccgtgacaatggacaaattttcagccaatacgttgactttaacggtaaaccaagtatggattctaagtacaatccgaatggttctgtccatgccatcgaaggaattaccagcaagaatggtcaaatcatcggtaagatgggccactcagaacgttatgaggatggtcttttccaaaatatcccaggcaataaagaccaacacctgttcgcatcagcggttaaacatttcactggaaaataagacttacagattttctaatagatagtatcagtaatgtaaaagtcatgtaaatctagctcttgatgattacaaatgaaaattaggtataaaaaatgacatacgaagtaaaatctcttaatgaagaatgtggtgttttcggtatttggggacatccagatgctgctaagttgacctattttggactccacagtcttcaacaccgtggtcaggagggggcaggaatcctctccaatgatcaaggacaactgaagcgccatcgtgacatggggcttttatcagaagttttcagaaatccagctaatttggataaattgacaggagctggtgcgattgggcatgtgcgttatgcgactgctggcgaagcttctgtagataacatccagcccttcctcttccgttttcacgatatgcagtttggtttggctcataatggaaatctgaccaatgcagcctctctcaagaaagaactggaacaaagaggagcaattttcagcgcgacttcggactctgaaatcttggctcacctcattcgtcgcagtcataatcctagcctgatgggcaaaatcaaggaagcgctcagccttgtcaaaggtggttttgcctatatcttgctgtttgaggacaagttgattgcggctcttgacccaaatggattccgaccgctttcgattggtaaaatggctaatggagcagttgttgtatcttctgaaacctgtgcttttgaggtcattggtgccgagtggattcgtgatttgaagccaggtgagattgtgatcattgatgacgagggcattcagtatgacagctatacagatgatacccagttggcggtttgttctatggagtatatctactttgctcgccctgattctaatatccacggtgtcaatgtccatacggcacgtaagagaatgggagcgcaattggcgcgagaatttaagcatgaggcagatattgtagttggtgtgcccaattcttccctaagcgcggctatgggatttgcggaagaatcaggcttaccaaatgaaatgggtctgatcaaaaaccaatacacccagcgaacttttatccaaccgactcaagaattgcgggagcaaggagtgcggatgaaactgtctgctgtttcgggtgttgtcaaaggcaaacgtgtggtcatggtggatgattccattgtacgtggaacaacctctcgtcgtatcgttcagctcttgaaagaagcgggtgcgactgaggttcacgttgccattggaagtcctgcactagcgtatccatgtttctacgggattgatatccagacccgtcaggagctgattgcagccaatcatacggtcgaagaaactcgccaaatcattggtgcggacagtctgacttatctttcaattgatggcttgattgagtcgattggtatcgaaacagatgcgccgaacggtggtctctgtgtcgcttactttgacggtgactacccaacgcctctttatgactacgaagaagactatcgtagaagtttggaagaaaagaccagtttttacaagtaggcgacagattctccattaaagaaaaggaaaaaataaatgacaaataaaaatgcatatgcctcacgtctcactactgactaaaggcttaagcatttagtcagtagacgctttgtcctataggatcaaagctagagccctgactagtatttttagataaaaagatggtttatctaaaaatacgtcgcagtctttctcaaaaaaagaaaaggaaaaataaaatggcaaataaaaatgcgtacgctcaatctggtgtggatgttgaagcgggttatgaagttgttgaacggattaaaaagcacgtggcccgtacggagcgtgcaggtgtcatgggagctcttggtggctttggtggtatgtttgacctttccaagactggggttaaagaacccgtcttgatttcagggactgacggtgtcggaaccaagctcatgttggctatcaagtacgacaagcacgataccatcgggcaggactgtgtggccatgtgtgtcaacgacatcattgctgcaggtgcggaacccctctattttctcgactacgtagcgacagggaagaatgaaccagctaagctagaacaagtggttgctggtgtggcagaaggttgtgtgcaggctggtgctgccctcatcggtggggaaacggctgaaatgccgggcatgtacggcgaagacgactatgacttggctggttttgcggtcggtgtggctgaaaaatctcaaatcattgacggttcaaaggtggtagagggagatgttcttctcggacttgcttcaagtgggattcactcaaatggttactctttggttcgtcgtgtctttgcggattacacaggtgaggaagtcctaccagaattggaaggcaagaaacttaaggaagttctacttgagccgactcgtatctatgtcaaggctgtcttgccgctcatcaaagaagagttggtcaacggcattgcccacatcacaggtggtggctttatcgaaaatgtccctcgtatgtttgcagatgacctagctgctgaaattgatgaaagtaaagttccagtgcttccaattttcaaaacccttgaaaaatacggtcagattaaacacgaagaaatgtttgaaatcttcaatatgggtgtgggacttatgttggcggtcagccctgaaaatgtagagcgtgtaaaagaattgttggatgaagcagtctatgaaattggtcgcatcgtcaagaaagaaaacgaaagtgtcattatcaaatgaaaaaaatagcggtttttgcctctggtaatggctcaaattttcaggtgattgccgaagaatttccagtggagtttgtcttttcagaccatcgtgatgcctatgtgcttgagcgtgcaaagcagctcggcgttctgtcctatgcttttgaactcaaggagtttgagagcaaggcagactacgaagcagcccttgtcgaactcttggaagaacaccagattgacttggtttgcctagcaggctacatgaaaatcgttggaccaaccttattgtcggcttatgaaggtcggattgtcaacattcatccagcctacttgccagaatttccaggagctcatgggattgaggatgcttggaatgctggcgtgggtcagtctggtgtgaccattcactgggtggattcgggtgtggatacaggccaggtcatcaaacaggttcgtgtgccacgactagctgatgataccattgacagatttgaagctcgcatccatgaagcagagtacaggctgtatccggaagtagtgaaggctctatttacagattgactttttgatgattcatatgatatctttgattttaaattggagtcagtgtttgttgaagacggcttcaaacggaggtatttgtaatgttagaatctaaaaaaacaactcgatatgtattttatgtctatctgatgttattaacttggggaatcttatttaagtttgaaacaaatcctgaatttatagcatttttcttagctccaaggtatatcaattggattccattttcagaaccactaatagtcgatggaaaaattgtttttgctgaaatgttatttaatctgattttctttattccattaggtgtttgtttccctttgataaaaactaatttatctagtttaagaatagtcgggacaggtttcttgattagtttattgtttgagtgcttacagtatattttagcaataggtataacagatataacggatttgactttaaatacgctaggtgtctgtgtaggcttactgatttatcaaatttttataagagtgttcaaatcacagactagaaaatggatcaatatcttaggtatgcttagccttggttttgcttatcttgttttactgttactgcatttacttagtgtttaactaatgattaaaaaggagaatataatgactaaacgcgtcttaatcagcgtctcagacaaagcgggcattgttgaatttgcccaagaactcaaaaaacttggttgggagattatctcaacaggtggaactaaggttgcccttgataatgctggggtggataccattgctatcgatgatgtgactggtttcccagaaatgatggacggtcgtgtgaagaccctccacccaaatatccacggagggcttctcgctcgtcgtgacttggatagccacttggaagcggctaaggacaacaagattgagctcattgaccttgtggtggtcaacctttacccatttaaggaaactatccttaaaccagatgtgacttatgctgatgcagttgaaaatatcgatattggtgggccatctatgcttcgttcagcagcgaaaaatcatgccagtgttacagttgtggtagatcctgctgactacgctgtggttttggatgaattggcagcaaacggcgaaacctcttatgaaactcgccaacgtttagcagccaaagtatttcgtcacacagcggcttatgacgccttgattgcagaatacttcacagctcaagtgggtgaaagcaagcctgaaaaactcactttgacttatgacctcaagcaaccaatgcgttacggtgagaatcctcaacaagacgcggacttttaccagaaagctttgcctacagactactccattgcttcagccaaacagctcaacgggaaagaattgtcatttaataatatccgtgatgcagatgctgctatccgtatcatccgtgacttcaaagatagtccaaccgttgtggctctcaaacacatgaatccatgtggaattggtcaagctgatgacatcgagactgcttgggactacgcttatgagtctgacccagtgtctatctttggtgggattgtcgtcctcaaccgtgaggtggatgctgcgacagctgagaagatgcacggcgttttcctcgaaatcatcattgcaccaagctatacggatgaagcgctagccattttgatcaataaaaagaaaaacttgcgtatccttgccttgccatttaatgctcaagaggctagcgaagtggaagcagaatacacaggtgtagtcggtggacttctcgtgcaaaatcaagacgtggtcaaggaaagcccagctgactggcaagtggtgactaaacgtcagccaactgagacagaagcgactgctcttgagttcgcttggaaggctatcaagtacgtcaaatcaaatggtattatcgtgaccaacgaccacatgacacttggtgttggtccaggtcaaaccaaccgtgtggcttctgttcgccttgccattgaccaagccaaagatcgtctggacggggcggtccttgcttcagatgccttcttcccatttgcggataacgtggaagaaatcgccaaagcaggaattaaggccatcatccagcccggtggctctgtccgtgaccaagaatccatcgaagcagcggataaatacggcttgactatggtctttacaggtgtgagacattttagacattaagaagataaaagggaagaaaacagtttctttccttttttggcttaaaatactaactgaaacaagattaaaacgaacttttttgatataatgttggtaaataattcgcaaaagaggttgaggaatgaaactgcttgttgtcggttctggtggtcgtgagcatgcgattgctaaaaagttacttgaatcaaaagacgtggaaaaagtctttgtagctcctgggaatgatgggatgactctggatggtttggaattggtaaatatctctatttccgaacattataaattgattgacttcgcaaagaccaatgatgttgcttggacctttatcggtccagatgatgcccttgctgctggtatcgtggatgattttaaccaagctggacttaaggcctttggtccgactagggctgcagcggagctggagtggtccaaggatttcgccaaggaaatcatggtcaaatacggcgttccgacagcaacatatggcacattttcagatttcgaggaagccaaagcctatatcgaaaagcatggtgcgcctatcgtagtcaaggcggatggcttggcacttgggaagggtgtcgtcgttgctgagacggttgagcaagcggtcgaagccgctcatgagatgcttttggacaataaatttggtgactcaggtgcgcgcgtggttattgaggaattccttgaaggagaggaattttcactctttgcctttgtcaatggtgataagttctacatcatgccaacggctcaggaccacaaacgtgcctatgatggcgacaaagggcctaacacgggtggtatgggtgcctatgcgccagtcccacacttaccacagagtgtagttgatacagcggttgacaccattgtcaagccagttctagaaggggtgattaaagaaggtcgcccttatctgggagttctttacgcagggcttatcctgacagctgatggaccgaaagtcattgagttcaacgctcggttcggagatccagaaactcagattatcttgcctcgcttgacctctgactttgctcaaaatatcacagatatcctggatagcaaggagccaaatatcatgtggacggacaagggtgtgactctgggtgtggttgtcgcatccaagggctacccgctagactatgaaaggggcgttgagttgccagccaagacagaaggcgatgtcatcacctactatgcaggggctaagtttgcggaaaatagcagagcactgctctcaaacggcggacgagtttatatgctcgttaccacagcagataccgtcaaagaagcccaagccagcatataccaagaactataccaacaaaaaatagaaggactcttctaccgaacagatatcggaagcaaggcaattaagtaaagatataagaataacgcgccgtagtcgccaaacacgataatggtcgtcgtggtgaaaagaccagaacagtgaatgttctggtcagggggaaacttggagaccttaggctcaaagtttaggaatgaaaccgaaggtttgcttccgcctccatcacctaagaccattatcaaaaagaaaaataaaaattcacaaaatacgttaatgatcgtatggtttgcgagcgttagcgagctaatatagaacaatcaccgccgttgtgaaagaacgattggatgataatccaatcgttcagggaaattggaagaccttgggtttccaatttaggcatgagacacctttggtggctgctgccgtccctcacaagctaaggtgattgttgaaaaagaggaaaaaggagaagaaatgaaaccagtaatttccatcatcatgggctcaaaatccgactgggcaaccatgcaaaaaacagcagaagtcctagaccgcttcggtgtagcctacgaaaagaaagttgtttccgcacaccgtacaccagacctcatgttcaaacatgcagaagaagcccgtagtcgtggcatcaagatcatcatcgcaggtgctggtggcgcagcgcatttgccaggcatggtagctgccaaaacaacccttccagtcattggtgtgccagtcaagtctcgtgctcttagtggagtggattcactctattctatcgttcagatgccgggtggggtgcctgttgcgaccatggctatcggtgaagctggagcgactaacgcagctctctttgccctccgtctcctctctgtagaagataagtccattgcggatgcacttgccaactttgctgaagaacaaggaaaaatcgcagaggagtcgtcaaatgagctcatctaaaacaatcggaattatcggtggcggtcaactgggtcagatgatggccatttctgctatctacatgggccacaaggttatcgcgctggatcctgcggcggattgcccggtctctcgtgtggcggaaatcattgtggcaccttataacgatgtagacgccctccgtcagttggcagaccgttgcgatgtcctcacttatgagtttgaaaatgtcgacgctgacggtttggatgccgttatcaaggatggacaactccctcaaggaacagatctgctccgcatttcgcaaaatcgtatttttgaaaaggactttttgtcaaacaaggctcaagtcactgtggcaccctacaaggtcgtgacttctagcctagacttggcagatatcgacttgtcgaaaaactatgtcctcaagactgcgactggtggctacgatggtcatggacaaaaggttattcgttcagaagcagacttggaagcagcctatgcgctagcagactcagcagactgcgtcttggaagaatttgtcaactttgaccttgagatttctgtcatcgtgtcaggaaatggcaaggaggtgacgtttttcccagttcaggaaaatatccaccgcaacaatatcctgtctaagaccatcgtaccagcccgcatttctgaaagtctagtagacaaggctaaagctatggcagtgcgaatcgcagaacaactcaacttgtctggaactctctgtgtggaaatgtttgcgacagctgatgacatcattgtcaatgaaatcgccccacgaccacataactctgggcactattctattgaagcctgtgatttctctcagtttgacacccatattctgggtgttctcggagcaccattaccagtcatcaaactccatgcgccagccgttatgcttaatgtcctcggtcagcatgtcgaggctgctgaaaaatatgtcacagaaaatccaagcgcccacctccacatgtatggtaaaatagaagcaaagcataatcgtaagatgggacatgtgactttgtttagtgatgtgccggatagtgtggaagagtttggggaagggattgatttttaggacaagtctatgatacaaattatcgttaatacatttattgaaaagtataagactggagcagttgttgaagtgttgtatgccagtgctgaccaagataaggtacaagctaaatatgaagaactagctgcacaataccccgaaaattatttagctatctataatgtaccgctggatacggatttgaatacactagatcattacccgtctgtgtttattggaaaagaggagtttgagtagaaatcttggtttacctagatagcttattcccaacagcttaagaagaaaggaaaaattaacacatgatcaaccgttactctcgccctgagatggcgaatatttggagtgaagaaaataaataccgtgcttggcttgaggtggaaatcctctctgacgaggcatgggctgagttgggggaaatccctaaggaagatgtggctttgattcgcaagaaggcggactttgacatcgaccgtattttggaaattgagcaggagacgcgccacgatgtggtggctttcacgcgtgcggtttctgagactcttggtgaagagcgcaagtgggttcactatgggttaacttctactgacgtggtggatactgcttatggttacctctacaagcaggccaacgacatcatccgtcgtgaccttgaaaacttcactaatatcatcgctgacaaggccaaggagcacaagttcaccatcatgatggggcgtactcatggtgtgcacgctgagccgacaacctttggtcttaaattagcaacttggtacagcgaaatgaaacgcaatatcgagcgcttcgagcatgcggctgctggtgtagaagctggtaagatttctggtgcggttgggaactttgccaatatcccaccatttgtagaggagtatgtctgcgataaacttggcatccgtgcccaagaaatctctacacaagtccttcctcgtgaccttcacgctgagtactttgcggttcttgccagcattgcgacttcaatcgaacgtatggcgactgagattcgtggtctacaaaaatctgagcaacgcgaagtagaagagttctttgctaaagggcaaaaagggtcttcagcaatgcctcacaaacgcaacccaatcggttctgaaaatatgactggtctggcgcgtgtcattcgtggtcacatgattacggcttatgaaaacgtcgctctctggcatgaacgcgatatttctcactcatcagctgagcgtatcatcacaccagatacgaccattttgattgactacatgctcaaccgttttggaaatatcgtcaagaacttgacagtcttcccagaaaatatgatccgaaacatgaactcgacttttggtcttatctttagccaacgggctatgttgacattgattgaaaaaggcatgacccgtgagcaagcctatgacttggtgcaacaaaaacagcctactcttgggacaaccaagtagactttaaaccacttcttgaggcagattcagaagtaacatcacgtctcacacaagaagaaatcgatgaaatcttcaacccagtttattacaccaaacgagtggatgatatctttgaacgtcttggactaggtgattaattaaaaaataaacagcgagcttcaatctcgctgtttattttttatcgaaaagacttagtcttcttttcttttagtgagtccataggctgctagtgtggacatgagtcctgcgactactagtcctgcagaatcgtgagttcctgtttcaggaagttttttctctgttaccacaggagctggatcttgaggaagaactttgctttcctcagcaggagcagttgatggagctggttggcttgggatttctagttttggtttttcttcagcaatagcggcttgtccgttttcatcgcctacatgtgttaccatagttccgacttcgactatttgagtaacggcttcctgtgctacgacactatttacaagtgttttcacttccttaccatcggcagaagtgctcacagagtagaagttgctacgatgtccattgacgcccttagtaatgacttgtgtttttcctttgagtaagagtggattttcacaagtcactgtggtaaatggaatttcttcttcttggatatccagtctaggttttacctcagtagttggtgcaagaccactttcatcacccttgtgagttacaggagcgccaacttcaaccacttggtttataacttctttggttacctggctatcaaggactgtttctgttgtttttccattttcagtgagtacagagatgtaatgagttcgttcacctttgactcctgctgtgataatattttcctgaccggctgggaggttaggattttctttcttgataacttcaaatggaatttcttcagttcttgtgatgagttctggtctggtttcaacattggcagccacttcattttcatctaggcttcctgaatgagttacagctggtttgaggccttgaagagcggcttttaggttggctacaagcgtgtcaagctcagcttgtttattacggttgaggttgtaatttagagctgttttagctgcgtcaagggcctcaagactttctttactatatccttctaagtttgtaggaattttagctaattcttcgcggagagcattataattagcacgaaagtagtctttgttgtggtctgcaaaggcagtcatgagttcaaagatttcctcttccttgtattcagcgcttggtctatctgcccagattgaaagcatacttccgactgttggaagatctacttcaggatatttggtagaagctagttgattgaatggtgtttttccagtattctcaatagctttcttgaggaaaccaccaccatcttctggtttttgaccaagaatgtagtaccagtcaccgttggtattcaagaatttatagcctttgcttgctaggtattgaggtgatgcgaggttatatccccaccagcctttagaccagtaagaaatcaagacatctttgtcaaactgaacatcgtccttgtcttcatagtagaagccatcgttgaaggccattggttgaagccctctttctttggccatagctgcgagggtgttggcatattcggcaaatttgccatagagttgataccacttgaggtagtaccagccttgggcactagtcgcatcgttggcgtattcgtcagtaccaaagttgaaaatctttgttttacctgcaaagaagtccatgtatttaccgatgagggcttttacaaagttcatcgcttcttcgtttttcaagtccatagttgtttttgaaactttatcaaagtgggcttgaggatttttaatacctaatttttccatggcaaccagcatagcatccatgtgacctggactgttaatagctgggatgagaccgatgtccttagatttagcgtattcaattagctctgttacttctgcctgtgttagtgcagtaccgtttggatcgtcgtagtaagctttagttccttcgataatagcttttttaacgtcatcactagcataggtttttccgttggcagtaatggtcatatcatcgagtagaaagcgaagtccgtcatttcctagaaggagatggacatcagaatatccgagctcactggccttgtctacgatgcgtttgagctggttcagagtaaagtatttgcgtccagcatcgattgagattaccttgtttttggcaagtttttcaacctcacgtttagcttcttcttctttttgagcttcaggcgtgagggtcaagttgttgacagtttcttgaagtttagcaatggcttgatcaatcgtatcttgttgggcacggctaaggttgctatcgagagagcgaatagctttttcagcttcttttacggccgtgacgctttctgcagtataacggttcaggtcttttggtacctcgttaagtgcttgctctgcagattcataatcagctgcgaagtattcagcgttggcatttgcaaaatgacgcatgagtttgaagaggcgtgatggtgaataacgtgcagatggagtgtcagcccaagcagctaccataccaccgatgattgggatatcagctccttctgtttttggtacagaagtgattggtgtgtttttaataccattgagcccctgatcgagattgtaccagccttggccatcagcgtttcgtccaagaacgtagtaccaagcatcattggtattaaggatttggtgacctttttcagctagtagtttagaagaagcgacatcgtagcctccccaaccaccagtccacatagaaacgatgatgtctttgtcaaaactaccaaagcttgtgtcgctattgtagtagataccgtcgttaaaagccattggtttgagaccgtgcgattttacaatacgagcgaggtcattggcgtaggcaataaatttttcatagccttttacagggtagccttcgtttggatagtatttatcagcttgaagcacactccaacctttagcatctgtcgcatcattggcatattcatcaagtccgatgttgaagatttcagtctttttcgcgaaataagcagcatacttgtcgataagggcttttgtaaaagcgacagcttgttcgttgtcaagatcgacagtacgggctgatttcttcccaaaatagctaaagttagggttttggattcccaattctttcatggcattgagaatcgcatccatgtgtccaggactatttactgtcggaatgagaccgatacctttatctttggcatagttaatcagatctgtcatttgactttctgttaagtgattgccgtttggatcgttgtaataatcatttgtacctttttcaatggcgcgtttgacatcgtcactggcataggtcttgccgttagctgtgatgctcatatcgtccaacatgaaacggagtccatcatttccgactaataggtgtaaatcagtgtagccataatgtttcgctttatcgatgatttccttgagctgttctggtgagaaatatttacgtccagcatcaatagaaacaattttctttttcgctagtttttcatttacagttgcagcacgttcctttcctgcctctgttgccggtttgtcagcctctgctttcgcttcatcttttttagctggtttatccttgtcagtcttgtctgtatttgactctttagaatcaacctctttcgcttcttcctttttagggctagcttcttctgcctttttattagcagtttctttttcagcagaagttggagttaccacttctgctttatcactaggagttgaactaacttcctcttgtggtttttcttctgtttttggaagactagctaccttatcagtagctggagtttctgtttctacagtttttggagcttctggttgaagcactgctttaggtgtttcctcagtccgattttcggatgattgaggggaatcagaaaccgtatggatggtcggttggttttctgtagtagtaggagtaactccatcggctgcaacagtctgtgcttggaaggcaaatccaattagaacagaagctgctcctacagcgtatttacgaatagaaaaacgctgttgtttttcatgtttcattgcaaaacctcctgattgcattgttatattgatagcgattatataaatcaacgcctttattttatttcttatattaatttcttatattaacgagagtcaagaggagatgacaaaaaactataataagtataaaaaaatataaaatttaaacttaagatttcagattggtcggaaaaaatacgtatatatatctagtataatttttggttctatttctataaaatattccacaaattatagaattttccaaaaataggtaagcgctacctttttggtgtagtataataagcatagaaaaagcccaagcgattagctcaggttttcttcttagtgatcacggtcacatgagataaatttaatcttgtagtaatcagatcgtttgtaagtttcactgtattctaaaacttggccagttgattcgagtttggtgattttagtttgtaggacagtagggaattgttcatcgactccgaggactgaagctgcatgttctggagttggaaagactatttcgttgatttcttcaaagtgttcatcattcatgtgaatgtggtagtctaacttgaaacgattatagatagaactatagtattcaaggtttggataatttgcgttgatatattgttctgggatgtaggatgtatggtagatataaacgacaccgtttgattcgcggatacgttcaatcttgtagtagaattgatcgccgcgtagacccaatttttccaagtaaacaagcttgtttccgcgttcaattgaaagaacagttaccttatcatctttagcattgaagagttcaatatctgaaaactctacaagcttgtgtttgcgtgcacgtgaaacgaaggttccttttccttgttggcggacaatatagccatctttggcaaggtcgtttaaggcgcgaacaactgtgatagagctgacatcgtacattgaaatgagttctgcttcagtgtaaaatttatctccactgctaaactgcccagagatgattttattttttaattcgtcttttatgtattgatgg

SEQ ID NO: 84 - DNA, 6749 bp; double-stranded, linear
cctgatgggtggtatgcgaggatacagttctgaaaatcgccgttacttaattaatggacgcgaagtcacacctgaggaatttgctcactatcgtgcgactggtcaattaccaggaaatgcagaaactgatgtgcaaatgccacaacaggcatcaggtatgaaacaaggcggtgtccttgcaaaactaggtcgaaacttaacagcagaagcgcgtgagggcaagttggatcctgttatcggacgaaacaaggaaattcaagaaacatctgaaatcctctcacgccgcaccaagaacaatcctgttttggtcggagatgcaggtgttggtaagacagcagttgtcgaaggtctagcgcaagccattgtgaacggagatgttcctgctgctatcaagaacaaggaaattatttctattgatatctcaggtcttgaggctggtactcaataccgtggtagctttgaagaaaatgtccaaaacttagtcaatgaagtgaaagaagcagggaatattatcctcttctttgatgaaattcaccaaattcttggtgctggtagcactggtggagacagtggttctaaaggacttgcggatattctcaagccagctctctctcgtggagaattgacagtgattggggcaacaactcaagacgaataccgtaacaccatcttgaagaatgctgctcttgctcgtcgtttcaacgaagtgaaggtcaatgctccttcggcagagaatacttttaaaattcttcaaggaattcgtgacctctatcaacaacaccacaatgtcatcttgccagacgaagtcttgaaagcagcggtggattattctgttcaatacattcctcaacgtagcttgccagataaggctattgaccttgtcgatgtaacggctgctcacttggcggctcaacatccagtaacagatgtgcatgctgttgaacgagaaatcgaaacggaaaaagacaagcaagaaaaagcagttgaagcagaagattttgaagcagctctaaactataaaacacgcattgcagaattggaaaggaaaatcgaaaaccacacagaagatatgaaagtgactgcaagtgtcaacgatgtggctgaatctgtggaacgaatgacaggtatcccagtatcgcaaatggaagcttcagatatcgaacgtttgaaagatatggctcatcgcttgcaagacaaggtgattggtcaagataaggccgtagaagttgtagctcgtgctatccgtcgtaaccgtgctggttttgatgaaggaaatcgcccaatcggcaacttcctctttgtagggtctactggggttggtaagacggagcttgctaagcaattggcactcgatatgtttggaacccaggatgcgattatccgtttagatatgtctgaatacagtgaccgcacagctgtttctaagctaattggtacaacagcaggctatgtgggttatgatgacaatagcaataccttaacagaacgtgttcgtcgcaatccatactctatcattctcttggatgaaattgaaaaggctgaccctcaagttattacccttctcctccaagttctagatgatggtcgtttgacagatggtcaaggaaatacagtaaacttcaagaacactgtcattattgcgacctcaaatgctggatttggctatgaagccaacttgacagaagatgcggataaaccagaattgatggaccgtttgaaacccttcttccgtccagaattcctcaaccgctttaatgcagtcatcgagttctcacacttgactaaggaagacctttctaagattgtagatttgatgttggctgaagttaaccaaaccttggctaagaaagacattgacttggtagtcagtcaagcggctaaagattatatcacagaagaaggttacgacgaagtcatgggggttcgtcctctccgtcgcgtggttgaacaagaaattcgtgataaggtgacagacttccacttggatcatttagatgctaaacatctggaagcagatatggaagatggcgttttggttattcgtgagaaagtctaagacagaattttgaggataaaaaagaaggagccagctgaaaaaaactggttcctttttaggtacgacaggcatgtcgtatagtagaagtgtattattctagtttcaatatactatagtagctcagaagtcggtacttaaacgtgctatatcaaaaccagtcctggaaaaacgtggactggtttcgtgtttggattattaccttgaacgacatgcgttaaaagttagttgaaccgccgtatgccgaatggtacgtacggtggtgtgagaggggctagagattatcccctactcgattttaaatcacatgacgttcaaaggcatcatctgaaatcccttgttccaagatgagttttgcccattctttagcagagaagaggctgtggtccttgtagtttccgcaagattcgatggttgtccctgggacatcttcccaagtagtagtttcagcgatttccttgagcgaatccttgataacagctgcgattttagcactggtgtgacgtccccacataatcatgtggaagcctgtgcggcaaccaaatggtgaacagtcaatcatgccgtcaatgcgggtacggatgagtttggctaagaggtgctcgatagtgtgaaggccggcagtagggatagagtcttcgtttggttgcaccaagcgaatatcataattggagatgatgtctccttttggtcctgtttcttccccaatcaagcgaacatagggtgctttgacaatggtgtggtcaagttcaaaactttcgacaataacttcttttgacatggtaaatcctttcagttttcttctctcattatatcataaaggttgctcctgagacagagagaaaacctctccgaggctggagaggttgaaatctttacttacgatataagcggtcgtattggtagtatgggtcaaaggttacgttgatacccagtttacgaaggacattcttgtcttcatcagtcaagatgatggttgagtgggcttcgcttcctttgaggttgccgagttcttccatagcgcgggcagcatcaggattttctgtagctgtgatagcaagtgcaatcaggatttcatttgaatgaaggcgtggattgcggctaccgagatgatcgattttaagaccttggattggcttaacaacttcaggctcgattagttttacttctttagcgatgtcagctgattttttgatggcgttgatcaaggcagcggctgtaggaccaaagagttctgagttcttaccagtgatgatttccccatttggcaattcaaaggctagggctggtccaccagtttcttctgctttttggcgcgcaacgacagcaaccttacggtctgcaggtgtgataccgaggtcgttcatgagcaactcaattttcttgacggcagcttcgccaactttttcagctttgaagtcaagaactgtttgatagtaacggcggatgatttcttgtttagaagcttcgacagcggcctcgtcatctgtaatagcgaaaccaaccatgttgacacccatatctgtcggtgaagcgtatggtgattttccgagaatacgttccaacatgcgtttgagcactgggaagatttcgatatcacggttgtagttgacagtggtttctccataggtttgaagatggaaggggtcaatcatgttgacatcatcaaggtcagctgtggcagcttcataagccaagttaactggatgatgaaggggaagattccaaacagggaaggtttcaaatttagcgtagccagatttgatgccattgatttggtcgtggtacatattggacatacacgttgccaattttccagaaccaggtccaggagcggttacgacaatcaagttgcgactggttttgatgtagtcgtttttgcccatgccttctggggaaatgatgtgatccatatccgtcggatatcctttgattggataatgaagataagaatcaattccgtttttctcaagttgattgcggaaggcatctgcagcgggttggccagcgtattgtgtaatgacaacggaaccaacaaaaatccctaattcattgaatttatcaatcaaacgaagaacttcttggtcataagaaatgcctaagtcgccacgtgctttggaatgttcaatgttgctagcattaatggcaatcacaacctcaacctgctctttcaattcttgcaagagcttgattttgttgtcaggttcataaccaggaaggacacgagcagcgtggaaatcttctaacattttaccgccaaactctaagtagagcttgccgtcaaattggttaatgcgctccaaaatatggtcgcgttgtaaattcaaatattgttcagaactaaaagcttgttttttcatttttttacctctggactctattataataaaaaattggaagttaggaaactacggagctaaaaaagaaattaaaaagattaagcaaacgcttgcacaaaattttaaaaagtgctatcatagactatagattatgaaaataatgaggtaaacagatgcaagaaaaatggtggcacaatgccgtagtctatcaagtctatccaaagagttttatggatagtaatggagatggagttggtgatttgccaggtattaccagtaagttggactatctagctaagctaggaatcacagcaatttggctttctcccgtttatgacagccctatggatgataatggctatgatattgctgattatcaagcgattgcggctatttttggaaccatggaggacatggatcagctgattgcagaagctaagaagcgtgacattcgtatcatcatggacttggtggtcaatcatacctcagatgaacatgcttggtttgtcgaagcctgtgaaaatactgacagccctgagcgagactactatatctggcgcgatgaacccaatgacctagattctatctttagtgggtctgcttgggaatacgatgaaaagtcaggtcaatactatctccactttttcagcaagaaacagccggatctcaactgggaaaatgaaaaacttcgccagaaaatttatgagatgatgaacttctggattgataaaggtattggtggtttccgtatggatgttattgacatgattggcaaaattcctgacgagaaggtagtcaataatggtcctatgctccatccctatctcaaggaaatgaatcaggcgacctttggagataaggatctcttgacagtaggggagacttggggagcaactccagagattgccaagttctactctgatccaaaggggcaagaattgtctatggtcttccagtttgaacatatcggtcttcagtatcaggaaggtcagcctaaatggcactatcaaaaagagctgaatatcgctaagttaaaagaaatcttcaacaaatggcagacagagttaggagttgaggacggctggaattccctcttctggaacaaccatgacctccctcgtattgtctcaatctggggaaatgaccaagaataccgcgaaaaatctgccaaagcctttgcaatcttacttcatctcatgagaggaactccttatatctaccaaggtgaggagattgggatgaccaactatccgtttgaaacactggatcaagtagaagatattgaatctctcaactatgcgcgtgaggctcttgaaaaaggtgttccgattgaagaaatcatggacagtatccgtgttattggacgtgacaatgcccgtacccctatgcaatgggacgagagcaaaaacgctggtttctcaacaggtcaaccttggttggcggttaatccaaattacgagatgatcaatgtccaagaagcgctggcaaatccagattctattttctatacctatcagaaactggtccaaattcgcaaggagaatagctggctagttcgagctgactttgaattgcttgatacggctgataaggtctttgcttatatacgtaaggatggcgaccgtcgcttcctagttgtggctaacttgtccaatgaagagcaagacttgacagtagaaggaaaagtcaaatctgtcttgattgaaaacactgcggctaaagaagtacttgaaaaacaggtcttggctccatgggatgctttctgtgtggaattactataaatattttttgcagaaaaatttaaaattgaaatcgtataaaaacaagggaggactgtataaaagacagaaatcctttgttttttataaccaaagtttataaactttcattcttgaaattcaattaactttacaaattcccactattaaggagaaagaagatgaacataaagaagcgtgtccttagtgcaggcctgacttttgcatctgctttgcttttacccaaatcattcatacctctctcaactagatgtaacttacaaaacccctgacctcatgagccactttcttcctcctcatgaggtcagttttactttctgctgttccagtatcgtttttcctcgctagatttcctcaaaagggcagactcctcccttggtgcgtcacacgattttttcatctcgactgttctttaatgcatcattaacgacgcttttcttctaggtggttcataaggaacaggaagattcaggttgacttttctaatcctagaataaagtgctgaaaacaattcggaataggcatagagactagacaatttgaggagctgcttgcgtcctgttcgaacacattttccgg

SEQ ID NO: 85 - DNA, 1842 bp; double-stranded, linear
tctacccatggactttgaggcattcattgttccatcttctagtggcgaatcttttgatacaaacgattcaattcacttggatagtgaaactctcccgcaaacatttttctggttaactcaatccagctgatatttctttcagccaaaataatggacaagttctcccaaaatcgttcagccatattgcttctcctttagttagataaataatgtgtttgcgccatgtaaatcaattgtttcgtatctcttggcaatagagctctagcctcttccaaattcagacttggataaactcgcttatttgaaaccgcaagaggaagtctgatggttagttcaggattttttaaaattatctcaacgaaatccgttaatcttagattgtcacggttcttaaatcgtaataaattgggagataaaaactcaaaacaatctgaagaatagctcatcatctcaattaatttgtcctttgtcatttcagaaactgaatgacaagatacctctatgccatagttttggaagaaatctaaaagaagttgatttctttgtctatttttacttagatagagatcaatcatgggagacctcccaaagattcggttccatttgatattctgacacgattaaggaatctaataaattaaggaatctaataaatttgcgaagttaatcggtttcttgtcttcatcataagcttttacagttacttgggttgtaagtattccctcttttccctcggctcgatagccttgtccatataaaacaaaaacgagattttgatgatcatctacaaaggcatcaaccccattctttatgtcttgactttcaaggaattccataacgttttgaagataggattcgtaaaatagtgggtagttatgttttttatggtaatcatctaaaaatgtcacttcaaactcacatggagagtaattttgactttgaacagcctaaaagtgccatcaaatttgaattggaataaatcaaataaatagccccatcctcatcaatccaacctttgctcaaagacaactccaaccgatcttttaaaactgagtaaaccaccttaacctccagtttcatattcttataccgttcactctcaaataaaagtttggggagcttataataacgctctgatgtctgatattgattagcggtaatacgcttcattattgtccctccaagactaaaattccaacatttccaaattcatcaaatcggattaaacctacttgttccatttcatcaactaactgagttgcttttacccaaatcattcatacctctctcaactagatgtaacttacaaaacccctgacctcatgagccactttcttcctcctcatgaggtcagttttactttctgctgttccagtatcgtttttcctcgctagatttcctcaaaagggcagactcctcccttggtgcgtcacacgattttttcatctcgactgttctttaatgcatcattaacgacgcttttcttctaggtggttcataaggaacaggaagattcaggttgacttttctaatcctagaataaagtgctgaaaacaattcggaataggcatagagactagacaatttgaggagctgcttgcgtcctgttcgaacacattttcccaccacgtgaagaaaaagatggcggaagcgtttgattgttaaagtttggaagtcacctccagctagatgtttgagaaaaagatagagattgtaggcgatacagctcatcatcatacgaacttcgtttttgattaaggttgaactatccgttttatcgccaaaaaatccctccttcatctccttgatgaaattctcggcttgaccacgtccacgataaag

SEQ ID NO: 86 - DNA, 19390 bp; double-stranded, linear
tcatctttatctcctcgaaattttctaatatagccattataacagaattttgtgaaaattcctattatagtaaatcactatttcagtataaaaagaaaaaacgaatcagacgattcgctcttcttaaaatctgaaaatagctttccagaaaggattagccgattttttgcagattgagcactgcatcgtgactcatcaagacttgaccatactcttgtaagactgagcgactgatatcactatcgtctgcaaactcgcgcatacgggccaacagccaagctggatatgggcttggatgattttcaatatccactaaaatggtcaaataatagcgctcgttcattttgtagagttcagaagtttccatttcaaaagtcactgtcttggcaaaagctaccaagtcagccaacttagcaaaagaaaggatgtagtagatgtaaggttctttcttactctcagcttcttgttcagcctgctcttgctcttcttccttgacttcaacttgctcaagagattgaatggcttcgatatcatccttggttttgtctgcgatgcttttttccagggttttgataaattcatctggagacatttgagccaattcttccatatctggcaaatccgataagtcttcaaaatctagattttggtcaatctttgacttggtcacaaagacatctaccttatcaggttttggagtcacacggaagctcaacatgcctgtatccagaaagctatcaggcatctctagctcatccaagatagcataaaagaactcttctgttttttcttgaggaacgagaaagtcagcaatctccattccacgatccatcaaatcctctaaagatatcgtgatttttaaagttgtatcactaatttgtttcattttcattgctagtaacctcatactttcagttctatctattatactagatttttacgattttatcaaaagaaggctcctctatacggatagattttccctagggtctttctataggagactccaaaagaaaatttctgcagacagatagaaaaagccttcaaaatcggctaagagccgactttgaagaccttatacatcagaatacttataatttaaaggttgctacaccgaggatagaacgatttaagtttctgagaatttgaagactttgctcaaatttcttataacgagtcactccgtactcttcaacaagaaggactgtatctctttccaaaagagatgatacatcctgtaaatctacaaaatgcattccttttaaagcttcttgactctgtttcaatttatctaagatagctttatttgagctaacgatggtcaattcctgtccagtatttttgtatgacaaaacatctgctaggttagcaattgttgtaatctctgttacaaaatcaatttgatactgagaaaaatcacctactctattgattgttggattaaagagataaactaacacatttcccatcacaaccaaaatcacacaaaccactccaataacaactaaacgaagaatcagatttttcacatttaagccaagcgctgtttcaccatttgcgttcaattctttagagttgatggtttccagtttttcaattttcacatttgcataggcatgtttaaatttctcaatcaacccatcaatttttttctctaacaagttattggcatctttacttgatgtcaaaattttcacaccaacccctgcatcgtcaatcatatagtagacggtcaattttttccaccaatagtcattcgttgaatttttcaaggttgtttctgtcgtgtctaattcactggcaatttttttcaactcactgggttctacatcattgaaaagataagctccattcaaattaccatcaatcaatttcccataaaaatcactataaccaccaatttgatgattcaaaatcgttttgtccgactcttttggaggagtgattttatagataagataagttgaataacttgttgtatctttgacagtgtttttattcctaactgctttaattgtaaatggtacagcaatgagagcaaataaagcgatgagagctaaaatatttgcttttcgctttttataaagatttgcaaacaaatcagctactgaataatgttcaaacatgatttttttctcctttgtttagtagatactagttttcctttgtaagcatttttgctacaaatataatcacaagaacaattccccagaattgcattgtaaataaattgaagaaactttctgaaaagctgcttcttggcataaagaatagattattcaagatgagtagggataaagcaaataggattgtccttgagcgataggctacttgcagcatggctataaataatacgccgagtaagaaactaagcagaaagactccaatcataccatagtcggtatacaactccatgatataactacttccgataccatgccctttcaagtattccttgttcaagacaagataggatagattgtgggcataactattactatcaatagctagttccacactattggttgtatgttcaaaggcttttcctccgaaaatggctcccaaactcccccttgcaaaataatcaagaacaggaccaaaagtaaaattacggaaatctcggtaagggaggctactgttaaatagaaaacctcgagccagaacaccaaaactagtcccttgtttatagataaagtcaagtaagatatcccagaaacctgtatgggaaacttggacattatcccgtacataattgagtactcccatcgctaacatgagaataggagaacctacaaaaatcgctaacttttctttaaacccaatccattttcctttttcagtttgctcccgcataaagtaataaacaaaagcaaatmaaatacttaaaataaagggatttcgtgtcccaattgccaaatgaatagtattagctgcaataaaggagacaagcactgctgtggcctgcaatttctttggcttggttgccagatacatacacattgcatagaccgtaaaggtagacaaaatgtaggtaaaataaggcagtttactttcaaaatttgcatagtaggcatagtaggaagtctgcaaacgatacaagagccgttcaaataaccgaatgaaatagaaaggataagttagaagaaaaactcctagtgatacaaagcgtaaccgcttgatataaacctcttttagagaatttcctatatttgctacttttattttcttcctagctatgaagtaacgagccagaatgcctcctgtggtcaagcccagaatcgaaatcatgacaactataaaggcaaaacgataggctattggatgataggtatccaaagcaccatccctaaaataatcaatggtcggtcttgataccagaaatacaaaaatggttaaatagaaaataaaatggattaagtaatacttgatatcattccaacaagcaattaagctactaaccaacaagaacaataaagtagaaagtaagctaacattattattattaaacagatacacaattccacttactagcgtcaaggcataactgactatggtcaaactaaataataatcgtttcccatcaatcacttggtcacccccgttctaatgtaattttttagatttttcaatatttttcagtaataagaatcgatataaggaaatatttatgaatagggccaaagcactaattcttctccccttacggaaaattggattcctagaaatagcaaaggcatggccttttaaaaaacgatgaatctgagaataggcttcaaactgtttatactgatcatctagcaacatcttatccagaataaagaagtgggcataggccaatctgaaaaaagcgacctctttcaagtcaggatagtttttcacaacttcattataaaacttttggtagatatcaatataggctaaatccttctctgcatagggtttggtcgtaatactatcccctctatggaaatagtaataatagggtttagtattaaccacatacttcttggccaacttgattaaatcaaaatggtaataggcatcttcgtaaatcaaccccttaggaaaggatagggcagttgcaatctgtctcttgattagcttattgcaaatcgtcccaggtattttttcacctatgaggtattcctttagaaatgtttgagaatcacagacaaaatagtcatcctgattggctgactgtgggctttcatcattagcatagacattcatgacaccacagctcgaaacatccgcatcttcttgaactaattgctcatataagctctgaatcatttctggatggatataatcatctgagtcaataaaaatcagataatccccgtgagcctgcttcatcccatcatttcgtgcttgcgacaatccttcgttctttttatgaagcactgacaccctgtcatcttgttcagcgattgaatcacacaagcgaccactttcatctgttgcaccatcatcaacaagaataatttccagattttgataggtctgcttctgaatggaagctatcgatttttctaggtactgcgccacattatagactggcacaatcacactaattaatgcagtttccatgctactcctctaatagtttttctacttgttcgatttgttttgtaattgtaaattgttgaatgaattggctagcctcatcgacatcaaagtttgaggcagaagtcatgtaattagtaatcgcctgagctgcctcttgattgctctcaatgatttgtccaaatcgtccttcttgggataattcctcagcccctccaacgtccgtagagataaaagggagtcccagactcaaggcctccacatacactccaggaaaaccttcttgtttagacatagacaaaagaactttcgtctgagatagatactgataaggatttttttgataaccaaggaaatgtacatagtcctcaatcccatactctttgactcgttttttcagttcctcttccatatcaccagccccgataaaatagagatgatagttttttccctcttggtgtaataatcgtatcacttccactacacggtcagaacccttattttcctcaatccgtccgatagtacagatactttgaggagcaatctcgatatcgatcttctcttgagatttttctagaatagtctgaaaatcatatccattgtagattgtctgtaatttagaagtataatctggataaacttccttgatagaattgctggtcttttttgaaatccctacaattgtattcgcagcatccaactggcttctatgtgattctcttttagagctatccttaagaagttcttcaatacttccatgaatccaagatatcttcttgacttctcttcttttagagaacaacagtggtggattcataatggtaaaagaaacttcaacatcataatcatcttttacaagcaaacgacgagtcagtcttggaaaataaattctcattctccacaaaaaagctcgtaaccatctggtttggcgataatcttgaagggattttaaaatgcgtacatgctttggaacagattcatatcccttgtcaaagtgctccatttcaagaatatcaatatcatacttttctggatccagatttgaaacaatggttgatagaatcttctctgcaccacctccaagagaaaaagaccacataaaaaataagatttttttcttagccaccatattctcccttgtattctgtataagacttatccatatcagcgatgacagcatcatgatgcggtacctgcttgtctgctggtggaggcgtcatataatccccaaaagcagttctgagatagacatcatagccgattggaataggcatctctgttccttcaaatggcaagaaaagattgtcttcaaaagatgtgattgggtacttgtttctcatgtagccaggacctgagcataattctgtaatgccatcacaatcagccaaatcatacttagtcatttctttctcagcttttttccagatgcgataacggagagattttggagtcaaacccagtaaaatgcgacttccccatttcatgagatcaccatgcttttctggaatagtttgcgcacaaaagagtgaataaatcaaggcccaacgaacctgttttttccgctcagctggatttttcggataataatccaaaggcaaaacatccaaggccagaccatgtggcaaatccaaatcctgctgataaggcttgatacaggtggttttcttgtcacgaatggtaataaaaagattacgatcaacaaaatccttgtgactctttgacaagaaataacgttcatctgcataacgaggccataattctgctaatttctcataatctttacgaggcataaaaaagtctaggtcgtcgtcccaaggaataaatcccttgtttcgaagggcaccaatagcgcctccgccacagagataacagagcaaatcatgttctttacaaaaggccacaaaatattcagccatctccagactacgagcctgaattgcttttaaatcagtcatattgttcattattctttctatcgtatcgtttcattataccacaaacaaggggtgaaaatctattgcagactgtaaaaaatcaaagcctgactgctatccaaatagctatcaaactttgatttttctgtcttatactcttcgaaaatctcttcaaaccacgtcagcttcaccttgccgtaggtataggtaactgacttcgtcagtcttatctacaacctcaaaactgtgtttttagcagcctgcggctagcttcctagtttgcactttgattttcattgagtattatcttatcttaagcccatttgagcgagcttggtttgatatttgttttgatcaaccagcaggcccaagcccccataaacatcataggcatctacccagtcacccagttctggaatcgtcaatttttcaataccattttttgctccatccaaaacagataaaccgtttgttaggaggaaagtatagggtacgttggttgaggtcatagcaaaaacctttccaagagcttcagaaccagtgaaaagtttagtgggatctttaatttgctctaaaattgctgttaaaacttgttgctgtctttttgtacggccgtaatctgcctcatcatcatcacggaaacgagcataattgagcagggtcgagccattcatctgctgttttccgactttaatggtttgggttggagactcagtctcggtagcgtataaatcatctccgactgtagcttctgttaggggacgcccattcaatgttgaaaattgagcatcaatcgtcaccccatcagggaaaagcgtgtcaatcgctgtggcaaaggcctggaaatcaaccaaggcgtagtacttaatgtccaagtcaaaattatctttcaagacttggcgaaccatttctgcccctttttgcccctcttgttctcctaactcgtaggctacgtttaacttgttatctgtctgttttctaccattaatcacttgactataaccatctatatagaccaaattatcacgcatgaaactgactagcttcattttcttatctgagcccccgacatttaataccataatagagtcagttcgtgtctcaacactgttctggccgattcgaccatcagtacccatgattaaaatattaactccatctctagtgtcctgaccattaaagacttctacttgagctgcccgggcatcagcagttttctttgcgctagcatcttggtaaccacgcaaaaacatgaataccatggccaaagccacacagaccaaaagtgaaaaaatcaccataaaaattcgtttaagacggagcttccgtcttttcttttttggagggaaagagagtgcttgtgatttggattgtgagcgactccggttcgcatagcttggtaagtcaacctgctcttctctttcttgttccaagctagagctactatttcccctagcaagagttagcttttcttgcaaataggcaaactcatttttttctctctcattgagatagtgaatattttttagcaaataatcataacgcaactgctcatgatgacttaagggattttctttactcatcttctctcctttccatggtctgatattggataaataggataggcacccagaattttatactggattccaatcgcttctaattctttttgggcaaagtggaccaagtccttatcggtataatccacatcgataatgaaaaagtattcacccagtgctgtcttgagtggacaactttcaatttttgtcaagtcaattcctcgccaagcaaaggtcgacagggccttataaagtgcacctggaaggttgtcaggtaatgtcaaggccaaactcatcttttcagtttgtgcttgcaagggaatactaggcttttcagctcctagaacccagaaacgtgtgaaattggcttccatttcctgaatatcctcggcaatcagttccaatccatattcttcagcagaacttctaggtgcaactgctgcaaagggctggtctggatgttcggaaataaaacgggccgcataagctgtactagctgttacctcgatttgagcctctggatattgttcatcgatgaatttctttccttgagccaaggcctgtggatgtgaaaaaatcttttcaatcttagtatggcctggaaccaccatcaactgctgatgaataggctgaacgatttctgctactgcttggatgtgagcctgatgaaaaagatagtccaaggtttcatgaacactaccctcaatagaattttcaactggcaccacagaatagttcactaatccttgctcataagccttgatgacatctgtaatgttggcaaaagcctgcaattcctcatgaggaaaagctgtctgcacaacgtggtgtgaaaatgatcccttgggacctagataagcaattttcatcttagttcctctataatttcctctgggcttagcttggtcacatccaaaacccgactagccacttcctcataccaagcctgtctttcttggaaaatagctactagttcttccttgctattatttagaaaaagcggtcgctgattgtccttatcagctgcgatacgttggtagagggtttcaaaatctgctctcaggtagatgttatctgtattagtcttgagtaagtcacgatttctctgagaaataaccactcctcctccagttgacacgacttggtctgtttgtagtaaatcagctaggacttctgattctacctgacgaaaggctgtttctcccttttcagcgaaaaaattcgcaatggacatacctaggcgattctcaatcagagcatccatatcaaggtaattagggtccaagcctcttgcaatagtcgattttccagcccccataaaccctaataacaccttagccatgaatcaagctctccaaatcatcaaagaaactaggatagctggtattgatggcttctgcacggtcaagctccacctctccatctgcaaccaagagggctgcgatagctgtcatcatgccgatacggtggtcaccaaacgtattgactctagcaccgtgaagagctgattttcctttgataatcatcccatctgccgtaggagtaatatctgctcccatactatttaaggcgtctgccacaacctgaatacggtctgtttccttgaccttgagctcctcagcatccttgataactgttacaccttgggcttgggtcgcaagcagggcaataatgggcaattcatcaatcaatcgtggaatcaaagcgccaccaatctctgttcctttcaagtcagaagactcaacaatcaaggtagcagatttagcgactggatcgatttcagttatttccaattttccacccatggcacgaatgacatcaataataccggtgcgagtttcgttgatccccacattctgcagcactagacgagaatttggagcaatcaaacctgcgactaaccaaaaggctgcactggaaatatctcctggtacgaccaccttctgtcctgtcaatttttgtggcccctggactgtgattttcttaccatccacacttaaatgaccaccaaattgtttcaacatatcttcagtatgattacgggtgtactctttttcgataataactgactcccccttagcttgtaaggctgcaaacatcaaggctgacttgacttgggcagaggcaattggcaactcataatgaataggtcttaggtttttcgtcccttttaagcgaaggggaggcaagtctcgttcagtttgccctgaaatgctgacgcccatttttttcagtggaagggtcacacggtccataggacgtttggaaagactatcatctccaaacatctctacttcgaaatctgcaccagcaaggacacctgaaatcaggcgaatcgaggtgccagaatttcccatattaagggcattttgtggcgcttttaagccagccatgcctacaccttgaatggtaataaccccatctttatcctcaatttcaacaccaaggtcacgaaaaacctgcatggtcgaaagaacgtcttcacctcgcagaatatcataaaccttggtctcaccctcagccaaacttccaaagataatggaacggtggctgatagacttgtcacctgggacgcggatactaccatgtaaatggcgaatgtttgtttttagtttcatactggacctcatacttgcaatacttttacctattttatcataaaaagccagaaattccttaaaaattcctgactttaggatcgttcttttcttatttcagcaattctgaaactggttcaaaaacaattttttcaatatcagaaaggtaaatggccaattgttgttgcttggtaaagaattctgacaagaggctatttccttgaatctgtttaccaaagccttccatcttagcttggaaggacgcatctggcatttgacctgtctgtgctagtttttgaatttcctcttgaaaggcaagataatctgtaaagattttgcttgcctcagcatctgctgcaatcgcatctttagctgctttaacagccttgtattctggtaatccgcgtagaccgcgactgagttcgtttgcactatcgtaaatatttgacatgttcttctccttatttgatgacgactgtatagtcagtattttctgttatgagatgctcagctctttccaagtcttgagcatttttaaatgaaatttgtaggattccgtgaatatcctcacgattttcctcgttgatgtggatattaaccaaggaagttccacgtagcagttccaaaatccgcaggatgacatcttcttcatcaggaacgtcaacatagaggtcgtaagagctatccacaccaccacgcttatggatttccatggtctggcgttgttcacgcgcttggttaaaaaagttccaaatttgctcttcatctcccttactaatggcctgaccaatcgcttccaaacgttccttgaaatcctcaattctatccagaatgatctcgctattggacaagagaatggaggtccacattcctggctcgctttccgcaattcgggtcatatctcgaaaaccacctgccgcaaagcgccttgccatctcatgctcttgagcatagaccgcagtctgctccatgagactagaagccaaaatatgaggaaaatggctaatctgagaagtgacacgatcatgctccttggcatcaatctcgataaaacgagcatgaagacctgaaagcagatccttcatttccttaagcgtgtcctgacttgtcaggcttgaaggtgtaaagatataataggcattttcaaaaagattgacatctgccgaagcagcccctgtcttgtgactaccagccatgggatgggccccgacaaagcgaacagacttgccagccaaatactgctccgccgcatccacaatggttgacttggtcgaaccagcatctgaaataataacgccttctcgcaaatccaaattggccaactccttaatgaaagcaatagtttgtttgattggcaagctgaggataatgacatctgccaaaggagcaaaactagcaaaatcatccgttgcacggtcaatcataccttctttcaaggcgatatctctcgaagcttgactacgattataacctaaaatttcataatctggatgatcgcgtttgataccaagtgccatagaggctccaatcaacccaagacctgcgatatagattgtttttgccataggaactccttaatagttctttgtatagtctcggtgtttggctaccgcttcttttagttcctcaagattatctgatgagaatttttcgaggatttcttgcgccagaaccgttgctacaactgcttccatgaccattcctgcagctggaagagcagtcggatcacttctctccacggttgccttgtaaggttcgtgggtttcgatatccacactcataagaggtttataaagagtaggaatgggtttcatgaccccacgaacaacgatgggttgcccattagtcataccaccttcaaaaccacctagattattggtacggcgagtataaccgtcttctttagaccagagaatttcatccataacttggctgcctttacgataaccagcctcaaagccaagaccaaattccacccctttaaaggcattgatagagacaacagcttgagccaatcttgcatccaattttctatcccattggacataggaaccaagaccaactggaacgcctccgacgactgtctccacaaccccaccgatggtatcaccatcacgtttgatttggtcaatatagtccttgatttcctgttctcgttcttggttgacaatagaaacttcagactgggcagctctttgcttaatttcagcgactgtcagattttcaggaacatcgatttccttgccaccaaagaccacgacatggttggcaatctccatatccagctcagccaagaggcgtttggctactgcaccaactgccacccgcatggtggtttcacgagctgatgaacgctccaaagaatttcgcaaatcatcaaaacggtacttaatccccccaaccaaatcggcatgacctgggcgaggatgagtaattttccgcttgcttttaaggcggtcttcaatgtcctccgcagacatgatgtccagccatttctggtggtccttattgatgacatccatagtaataggcgcccctgtcgtcttcccgtggcgaacgcccgaagtaaagacaacctggtcattctcaatcttcatacgaccaccacgaccgtagccaccctgacggcgtctaaggtcctcattgatatcctcagctgtcaatggaagtccagctggaattccctcaataatagctgttagacgggggccgtgtgattctcctgcagttaaatatctcatacactctccttattttaccaagtagtctttcatctcttccagagaaactgggtgaatggtcgctgaaccaagctctggcaccaagaccaatttcaaggtgttaccacgcgctttcttgtcatgagtaagagcctgataaagcttgccaacttcccaattttcatagtcaacaggcaaaccgaatttctgacacatctctgtgatagattgggtaatgccagctggcatgaggcctttttcctcagcaaccttggaaatctgtaccattcccatggcaacagcctctccatgcatgaccttgccataaccggcagtcgcttcgatggcatggccaatagtgtggccaaaattgaggtaaagacgaataccattgtccaactcatcttcaaccaccatcttgcgcttcacctgacaagaatgttcaatcaaggtctctgcatgttccaaaatactctcaacagaaccattcagtcccgtcaagagagcccacagttctggatcctcaatcaagccatacttgataacttcacccatcccttcaatcaactctctttttccgagggtttcaagaacaagtggatcaatcagaaccccatctggttgggcaaaggtccccaccatatttttagcaaatggtgtattaacgcctgtctttccaccgatagaagaatcaacctgagctgtcaaactagtcggaatctgaacaaagtgaataccccgcatataggtagaggctacaaatccagccaggtccccaacaacgccaccaccaagagcaacgattccatcgctacgagtcagaccttgcttgactagaaattcatagactttctgaacagtagttaaattctttctttcttcaccttctaagaaatcaaaaacagctacctgaaaaccagcatcttctaggctgagcttgaccttctctgcatagagagaggctacatggttatctgtcacaatgactaccttttgcggttgccagagttctcgcaaccactgaccagcctgggccatacaacctttttcaatctgaatatcataaggatggtgaggaatatcgattctgattttcataggagagtctccctttctttattggtatttttctgttaaagactgccaaatctcttctgtcggcatttccttgcctgtccacagttgaaaagcttctgcagcttgatagagtaacattcccagaccattgactgctggattgccctgacttctagcccatttcaaaaacggtgtttcaaagggttggtatatgatatctgcaactaaaagagtttctggtaagactatgttttcaggaacaggagaggattggccatccatgcccacactggtggcattaactagcaaatccgactcggcaatccttgcttgcagttcagaaacatattctaaagcacacaaatccactttaaaacctgtctgctcctgtaacttgtctaggtaaggtcttgttttttccatagaaacggaacgaacaaagaccgaaatctgactgacgccatccaaaatagcctgtgccaagattgatttagccgcaccacctgcacccagcagggtcatctttttacctgaaattgtaaaagaaggcaagcacttaaaaaatcccttgccatctgtattatatccaattaaattgccattctcattgacaaccgtattaaccgcaccaatcaagcgcgcttcatcgctcagcttatccaaataaggaatcacctgctccttatagggcatggacagattgatgccaaacatctggtagcgacgaatattggccactgtttctaccaagtcactcgcttcaatctcccaagccacataagcaccgttggtagctgtcgcctcaaaggctctattgtggatgaagggagaaatagaatgcttaataggattggcaacaactgcagctaaacgtgtatagccatcaagcttcatccaaaatctccctgatttttttcatgctagctagagaaatctgcccaggggcactaacctcatccagactggcaaaagaccaactcgaaccagtcacatccgcagtgatacgagagaccttgcccaccttacccatagaaatggtcacatattcctgttcaggattgagggttttaaagcctcgtgtatagttcatcaagtctaagacatcctgctccgtgtgagccatcaccgcaaccttaacaagttttggatttaggatcgtcaactctgacaagatttccatcatgttctcaggtgtttcttggaaattatggtaactcaaaacaagatttgggaagtccagcatttcctcaaaaacatccttgtagctatagtactcaaaatcaatatagtctggttgatagagttgcgcaacttccttgattagatggatatactcttctggagaaaggtcgatttctccaccttcggagcgagttcgtagcgtgaaaaccaactcacggcctgcgaatttttcaaaaatggctggagctacctgcaaaatcgcttctttaggcagatagtcggcacgccattcaatgatgtcggcatccaggtacctcgtggcatccagagcctgagcctcctctaaacttcttggcattactgaaacgattaatttcatttactaaccttcatactaatcaccttgaggtaattactactttcatcttttttattataggcaaaatctgctggaagaccatatttgtttaaaatctggtaacttcttcctgcaaaacctttatcaatttgttctgtaaatttctgacgggaaacattggcagcattggtactggcaatgataatccctcccggatttaaaatctcaagactctgggaaatcaacttgtgataatccttggccacagagaaagtttgttttttattccgagcaaagctaggcggatctaggacaatcacatcgtaggtcaagtctttgcgtttggcatatttgaaatactcaaagacatccatgactataaaacgatgctcgtctgtgctgagcccatttgcctgaaaatgcgcttgagacaattctcgtgaacgtttggctagatcaacagaagttgtatggctagctcctcccatggccgcagctactgaaaaagccgctgtgtaggaaaacatattgagtaaggatttacccatagccaagccgtcaactaaactaccgcgaacctcatgctggtctaggaaaattcctgtcatcaagccatcattcataaagacttgatacaggacaccattttctaaaacattgaaaaagtcaggtgcttcttgaccataaacatgggcagattcatagtccaaacccttaaagcggattttctcataagctcctaaaacctcagggaaaacctgtctaaaggcttctgatatagtctgacgaatctgataaacataagagttataccaagaaaagacggcgtagtcgccataaaggtccactgtcagacccccaaagccatctccctcttgattaaagagacgaaaggcagttgtcaaatcatcttgatagtaggcgtttctcttttctttggcttttctaaacaacgtttcaaagaaagcttgattgaaggccaccttgtctttgctgataaaccagcccaagcccttgttttgctgagaaaggtaggcagtcccaagaaagtttccttcctgaccctgcacctctacttcctgatccttaagattgacattctcaagatcactggcttctagtaaaactagccccttagcaagcttcttttcaacccttttgctgactcttattctattcataactaccattatatcaaacttttagacaattctcaaaaaagaaactacccttgcttttttactcttcttttaaaaaatggtatactagacttcctgcaaaactaggaagtaaatgtgtaagaatcacagtaaaaaatgctcttccgtcttggaggagcatttctttttatcaacgaaaatcaaatagcaaactatgaaactagcctcaggttaactgtgagattataggtagagaggttgtatcagcaatatgtgtctgtcaaatttagtgacaaaggtagtagaagaaagataaagaaataaatcagcttcagtaggtatctggaaaatttgattttatagagaagccttttgttacaaactcaatatactatcaataaataatattatagaagcaacaataattataatttcacctatctgcatcattctatttcgaactctaaatatatgttctatcaaaaatacttggaacacacacattataggaattaacgtttttgaaattgaaaaatatccaaataaataaactataaacaacaaaaatagaactatgttatatttcttattcaaaacattcctccctatatatttttgattaccaatcttaatcatttacaactacattctaacaaactataaaagcgtttgtcgaattgaatttatcaagcaagcgaccaaccagttcatcttttttctatttctgccaatatgcgtgacaggtaataatgatagccaaaaatagcaagagcaagcaagacgataagagctcctactcccaagctgatggcaaggataggggagagagactgaaccaagaatatgctcccaattacaagggccatcaggattgcactataaataaacaataaaactatggcgactatgccatttgaacgattcaccaggtccgtaatgctactccaattggttgacagatttttaacgtccttaaagtaatggtggcaagaaaggatgacactggcaatgatccagactacaagaaggtaaatcatcgaaatgatgggcaagcctagatatagagaaagaccaagcaaagtcagaactggtaaaaaggactggacagcatatataatccaaaatttcactttcacataacgagcaaagtcaaagggtaaactcttaagaaaatcaacattttccctctccaaggacaaggcaattgaatgcaggctggtgatattgttattgacaactgctataaagagagctataaaaaacaagggtaaccagtatggaggatgaatgtctggaactatctgagaatctcggattttggaaatcagaccgatcatcatgagataaggaaggaaagcacttgtaaaaagcactgtaatcacgccagtcccctgtcccaagagggtgaggtggtagcgtaaaaccatgcgaaaaaatccctttttagtggttgaaattctctccttgctgcgacgttcttttttgaccttctcctcactattaagcaggatcacgtcataaaaacgaggaaggaccttctttttggtcagataaagcaggaagagagttagtcctatccaagcgagcagacccactaaggcttctgtcgaaaaaggctccactgctattttgtaaaagatatgaagaggataaaggagaaatggaatgtctctaactttgtcaacaatacttccaaaagtcgactgaagaaagaagataaatattaaaggtatgagaactcctatcccaatcatcacattcgaaaaaatagactgatactttctgaagaccctagtttgagccaagaaatgcactgccactaccatcactagagccacagagacaaataataaggtcaaggacagtagcatcaaaggcaaacccagccatagagaaggagctagcctaatgtagaggaccagaaaataagctaggattggtacaattccagttagagctggcaaaaggacagacagtcctttagcaattataatctctgattctttaaaggcatagggcctatacgataccaaatccttactctcataaaagacattgtaaaaggccgttaaagaagttgaaaaggcaatcactagtaaaatagcaatcatcgagctaaaataaataggtatttcctcaaaaggaaaatgaatggctatattactaaaacagatgatcatcaagagactggaaaaaatgtaagaacttaagactctagcggaaacatttactttttt

SEQ ID NO: 87 - DNA, 18436 bp; double-stranded, linear
ccgagcgtcgttacagactttatcaagattggacgcaagaagaaattcaacatataaaggaaaatatggcacaatctccatggcatactcattaccatgttgagccaaaaacaggacttctcaacgacccaaatggcttttcttactttgatggcaagtggatcctcttttaccagaattttccttttggtgcagcccacggtttaaaatcttgggcacagctagaaagtgatgatttgattcactttaaagaaactggaatcaaagttttaccagatactccattagatagccacggtgcctactctggttctgccatgcaatttggcgataacttattcctattttatacaggaaatgttcgcgataaaaactggatccgtcacccataccagatcggtgctttgatggacaaggagggtaagattacaaagattgacaagatcttgattgaccagccagcagactctactgaccacttccgcgatccacaaatttttaactttcagggtcaatattatgccattgtcggcggacaagacttggagaaaaaaggtttcgttcgtctctacaaggctgtcaataacgactacacaaactggcaagcagttggcgaccttgactttgctaacgaccgtactgcctacatgatggaatgtcctaatttggtctttgtagaggaacaacctgtccttctctactgtccacaaggattggataagaaagttctagactacgataatatctttccaaatatgtataagatcggggcttcctttgaccctaaaaatgccaaaatggtagatgtgtctcaacttcaaaacatggattacggtttcgaagcctatgcaactcaagccttcaacgctcctgatgggcgtgctctagcagttagctggcttggtttgccagatgtttcttacccatctgaccgttttgaccaccaaggaaccttctctttggtcaaggaactcactatcaaagacgacaagctctaccagtatccagtcgctgctattaaggaccttcgtgcttctgaagaagccttctcaaaccgttcccaaaccaagaacacttacgaacttgaactcaacttggaagctaatagccagagcgagattgtcttacttgctgataaagaaggtaagggactttcaatcaactttgaccttgtaaacggtcaagtaacagtggatcgtagccaggctggagaacagtatgcccaagaatttgggacaactcgttcttgccctatcgagaatcaggctactactgctacaatcttcatcgataactctgtctttgaaattttcatcaataaaggagaaaaagtattttctggtcgtgtcttcccacatgcggaccaaaatggtatcctgattaaatctggaaacccaactggaacttactatgaattagattatggtcgcaaaactaactgatgtcgccaaacttgcaggcgtcagtcctactaccgtttctcgggttatcaataaaaaagggtatctatctgagaaaaccatccaaaaagtcaatgaagccatgcgagaattgggctataaacccaacaacctggctcgtagtctgcaaggaaaatcagctaagttaatcggcttgattttccccaatatttccaatgttttctatgcagaattgattgataaattggaacaccaactcttcaaaaatggttacaagaccatcatctgcaacagtgaacatgattctgagaaggaacgcgaatacatcgaaatgttggaagccaatcaggtggacggcatcatttctggtagtcacaacctaggaatcgaagactacaatcgtgtgacagcgccgattatttcctttgaccgaaacctatcgccagacatccctgtcgtctcctctgacaactatgctggtggggttcttgctgcccaaaccttggtcaagacaggtgcccagtctatcatcatgattacagggaatgacaattctaattcgccaaccggactgcgccacgctggttttgcatccgtactcccaaaagctcctattatcaatgtttccagtgacttttctcccgtcagaaaagaaatggaaatcaagaatatcttgacccgggaaaaaccagatgccatttttgcttcggatgatttgacagctattctggtcattaaaatcgctcaagaattgggcatttctgtcccaaaagagctcaaggtcatcggctatgatgggacctactttatcgaaaattactaccctcaattggctactatcaagcaacctttggaagagattgcttgtctcactattgatcttctcttgcaaaagattgaaggcaaggaagtcgccacaactggttacttcttaccagttacgctattaccaggaaaaagtatttaaacacaagaaaactcagaccgattcgtctgagtttttatgatcttaaattttcgagatagcgctgggctgtctctaggttaaaggttttatctgagatgaggcgctctactaggggagcaacttcagattcactagccccagctaggagagctagggatttggcctgtagtttcatgtggccttgctggatgcccgtacttaccaaggctttgagggctgcaaaattttgagcaagaccgatggacacgataatctgggctaattctctggcagaaggatttcctagtagatcatgactgagaactacacgtgggttgaggccgatagagccacccttagtcgctacaggcatgggcagggtcatctcaccgaccaattcttctctttcaaggtccagcgtccagcagctaagaccttgatagcgtccatctcgactggcaaaggcatgggccccagcttcgatggcacgccagtcattaccagtggcaatcaaaatcgcatcaataccattaaaaattcctttattatgagtagcagctcggtaaggatcagcctgcgcaaactgactagccaacgcaattttctccgcaatctctcgtccttgatccttttggcggctcaagtagcgaaaggcgatgcgacagcttgcagtcaccagagaatcggtcgcgtagttggacaggattcccatgagactctgtccctgactgagttcttctaagactggtttcaaggcttccagcatggtgttgagcatattggcacccatggcttcctgggtatcgacatgaatataaacaacgagaaagtctggttcgccttttatctgctcgacatgcagatcacgcgccccacctccacgtttaacgatagaaggataggcttgattggcaagctccaagagctccgctttcttgctggcaatcttctcttgcgctagtttaggattagcaacttgataaagggctacctgcccaatcatctgtcgctgatggacttgtgcagtaaaaccacctgcacgcttgatgattttgctggcatagctggccgccgcaaccacagagggttcttctgtcacatagggaacggtgtattcctgaccgttgacaagtacctccggaaccagtgaataaggcagagaaaaagttcccactacattctcactcagctggtctgccacagtcacgctcatctgttcatccttctccagactagcttgtctctcaggactaaggagcgcctgagcttttaacagctcgaggcgctcttggtatgattttttagaaaatccattccaacttatcttcattatttttcaaccttgctataacggcgttggtggtcgagaatttcaaccaaggcaaaatcttgattttcatagccagcaaactgggcagagttagtttcatccaagtttacttcctcaaaaaagaccttttcatagtctgcaacggatagggcagttcgttggttgagcttgttcaaacggtctttatccaaataagcttcatatccttcaaccaattcaccactgaagaactcagccacagctccacttccgtaactataaagggcgattttatccccagctttcaagctatctgtattttccaagagagacaaaagtccaaggaaaagtgaacctgtgtagatattccccaccttttgactgtagagaatagactggtcaaaatgcttttgtaagaggtcttttttctcttgaggcaggctcttatccatgatttttttcaagccttttagcgctaatttaggataaggcaagtggaaacaaacagccgcaaaatcatccaaagtaagctggtagcgtttttgatattcaagccaagtcgttttcaaactatccaagtattgttgggtagaatagacaccatttacataaggagttgtcgagtaatttggtcgccagaaatccatgatgtcacgggtctgagctacattgtcattattaaaggccatcatgcgtggattttgtgtaatcaacatagctacacttccagcaccttgagttggttctcctggagtttcaataccgtatttggcaatatcactggcaatgaccaagaccttggactccggagaattttccacatgcaatttggcataatggagggcagcagtcgctccgtagcaggcttctttaatctcgaaactacgagcaaagggctggatgcccagcaagccatgcacaaagacggccgcagccttactctggtcaattcctgactcggtcgccacaatgaccatgtcaacttcttgtctttcttgctcagttaaaatagagtcactagcactggccgccaaggtcacgatatcctcagttaggggcgcaatactcaattccttgagtaagagtcctttacttaatttttcagggtcaattcccctcgcttctgctaagtcttgtaatttcaagacatattgactggtcgcaaaaccaatcttatcaataccgattgtcatatttacctctgttttatcattcatgtaaaaaatcgttctatactattttatcacaaatggcagtaaaagagagaaaaaagacttgattcaccaaatcaagcctcttattggtcatcattttaaagaatgattagttgctagagagttcaccgatataagtagctttataagctccattcacagttatcagctcctggaggatcaaatttcctgagtaagtccttcccatctcatctacaaatttttgataaaactgactggtcggaatttctctgacatccttatcaaatgtcttatcaagtgttttactaaccttctcagcaatcaattgatgctcttgccatccactttgaaactctgagcccgaactagaaaccatgactgggataaacaacaaggtcagtagatttacagacaataaggaaagtagtagacttcctgcaaaactagaatcctagttcatgattgataataccagcaatcaaattcattcgtaatccgaagcgtttacgatgatttcgataggttgttgaaaacattttaaacgtttttactttggcaaagatgttctcaaccttgcttctctccttagatagcgcatggttacaggctttatcttcagctgttagcggcttgagtttgctggatttacgtggagtttgtgcttgaggatatatcttcatgagcccttgataatcactgtcagccaagattttaccagcttgtccgatatttctgcaactcattttgaacaacttcatatcatgactatagttcacagcgatatccaaagaaacaattctcccttgacttgtgacaatcgcttgagccttcatagcgtgaaatttctttttaccagaatcattcgctaattgttttttagggcgattgatttttacttccgtcacatcaatcattatcgtgtcctcaaagctgagaggagttcttgaaatcgtaacaccactttgaacaagagttacttcaacccattggctccgacggattaagttgctttcgtggataccaaaatcagccgcaatttcttcataagtgcggtattctcgcacatatagaaagcgttatcaatttatttatctcatttttcagaaaattcttttatttctgtaaagtctacgatactcgatgtgtttttatataatgatagagtctgagaatcactgttccgctagccattccaatagagattaccaaagccaacatgacaaccaaggtcgcacttgccagtgctttattatagtcccctgtcacaaaaaaggcagttgttcggtaggagagataacctggaaccagcggtgccaaaatggccaagataaagaccacagcaggtgtcttataaagaatacttaaaatctggctgacacaagaaccaataatggctgcaatgaaggtagctacaatgacattggtcggttccttgagcaagagatagattagccagacagtcatgcccaaaatccctccaggtaagagcatagaccgttgcacattgagtacgattaaaaaagtgataatggcaagaaaacttgctactgcttgtaataaaaaggttgttagtgtcatattagttcatcaataccaaggcgacagaagttcctgcccctaaagcgagggtaatgagcagggattcaaacatcttactcataccagagtttatgtggttggtcataatatcacggaccgcattggtcaaggcaatacctggtacaaacggcatgaccgcaccagctataatcaaatctgccgttgaaggaaaacctgtgtagcgagcccaaaactgggcaattatcccaaagacaaaggctccagcaaaggctgtcacaaagggaattcggataaatttttccacatagagggaaaaggcaaaaccaaataaggtcgccactcctgccccaagtgcgtcgtagatatttccgctaaacataactgaaaagaaaggagcactaaaggtcgcagccagagttacctgcaacttagtatagggaaggggtttggcttgcaaggccgtcaattgcttaaaggctgtttctaagtcaatctgccccccaactagctgacgagaaatctggttcacatcgcagactttttcgatgttataagaagaggaggtcacgcgcttcatgcgcaaatattggtattttcaatagagaaaaagatagcggcaggcatggcaaggacattgcaatccacaatcccctgcgaatgcgcgattcgaatcatggtatcttctacacgatggatttctgagccacttttaaggagaatagtccccgctagcataatcacatcaatgacggcatttaattcttttgattcttccatgctttcctccttttatcaactccctctattctatcacaaatccggactcaaaaaaaatctttgccatgaaatcatgacaaagattgattactcattttgattatccatctgcttttaaggagtagctgaagttgttttaggtttgtagattgaaatcttgactctagtcttattgaggtctaccttttcacctgctctaggactttgttcaacaaccatgccttctgcactacctgcaggcgctgtcgtcacttctacaacttctatattagcttccttaatcccaacaatttgaatcaaattgttcttagtaaactccaagctagaaccaatgtaactcggcatggcaacacttgtaacttttttagctactgtcaagacaatttgagtaggtttactcacatcataagtcgttccggcacctggactttgtttcataatcgttcctggttcgctttcgctggactcttcttcctctatcttaatcaaattctcaggaaccttcttctgcttgagttctgagattacttctgtagagttccgtccaatatagttccctaattgaatcgtcgtagcttttttagctactgtcaaaacaatttgagttgccttgctcaagtcataggtcgtaccttctggtagactttgcttcaggaccgttccagcctcactctcattcgactcttcttcctcaattttaatcaaattatctggaacttttttctcttttaattccgcaatgacatcagaggatttccgaccgacataattactaatttggaaagattgcttgcctgatgagacaaccaaattgattttcgttccttcttttcgaccagttccagcgccaggatctgtacggataatccgcccttcttccaccttttcactagcctctgtcttctcctcaccaatctcaaaattggcttttttgagcgttgccttggcctctgcaactgtctgacctgccacatctggaatggcaatggttgcaggagttctggatagtatccaaataagagaagctgccaccaatacaaggctggccaacaaaatcaggtaacgcatcttaaatctatgttttttcggtgcttgtggttggtaagtttcctctgtcacagcctggcttgggtttttgattgatttgtgttctgtttgcgcttgaaccttaggaatagatgtcaaggtactctgagaaaccttcggcaaggtcttggtatctgccttgctcgtttcatcaaagattaacttactttcatttctacgattgtaggacaagctactagacaagtccacatacatctctgaaaccgagcggtagcgattggtcaactttttagcagttgccttgataataacattttctaaagcctgaggtacagatggattttctgcaataacggacggcaggggtttctggaaatgctggagggcaatggtcaccgcgctatccccgtcataagggatatggcctgtcagcatctcatagaaaataatccccatggcatagatatcactctgcacagtcgccttcgaaccacgcgcctgctctggtgacaagtaatgaactgagcccaacatcgagttagtctgggtcagacttgtctctgcaaaggctacagcaatcccaaagtctgtgaccttggcagtcccatctggtgtcaagaggatattttgaggtttcaagtccctgtgaacaattcctcgagtatgggccaagcgcatagccaagagaatttgtcccatgatacggactgcttcttcattagaaagaggataatgttccttgatatagcgtttgaggtccagtccagccacatactccatagctaggtactgttgaccgtcttcctcgccaatatctgttatccgaacgatatgaggatggtctagatctgccatagctctcgcttcacgctgaaaacgagctacagctatcgggtccgtctggtagttggtcctcagaaccttcactgccacttcttccccatctaagattaagtctttggctaggtagacatccgccatacctcctcgaccaatctgtttgacaatccgatagcgtccggcaaaaatcttgccgatttggatcattctgcatcctcctcgttcatagaaacaagggcaaccgtaatgttgtctaaacctcctgcattgttagcaaaacgaacaagtgtctccgttttatctgctaaaggaatatcactggttacaatatcacgaatctcactgcctgaaatcatgttggtcaagccgtcactattgagcaagagatagtcacctgactcaaggataactgtcccaaaatcaggctgaatttcatctttttgcccaatagactgggtgataatatttttttgcggatgagcttctgcctcttctggtgtcaattgaccagccttgagcaattcattaaccaaggaatgatcgctcgtcaactgatggtattcttctccacgaatcaagccgatacgcgaatcaccaatatgagcatagatagcctgattatcaataatagcaaggacttccaaagtagttcccatgcctctgtaagcttcatcctgaccaagctggtgaatcttttgattttcaatttctaggtaatgggcgaaccattcacgcacttcattgactgtatcgatctgggtatcaacccaagctacacccaggtctgtgaccgccatttcactagcgatattccctgcgcgatgacctcccatcccatcagctaaaataatcatggtacgtccagctctattgacatagtggttgacatagtcttggttatttgttcgtttctgaccaacatctgttaataatgaaatttccatgtgtcagttccttcctaatccgatatcttgcgaaattgactgatgaagaatccatcacttccatacaattcaggtgtaatgaggatacagccgtctttcatgatatccttacattcatgttctagttttacctgctcgaactcgggatgactctctaaaaaggccttaacgacttgaaaattctcctctgagacgatagtgcaggtgctataagttattataccacctttgcctagtatttgacaaacactacctaatatttctaactgaatttcctgcaaggacgcgaaatctgccgtttctttattgtatttgatatctggttttcggcgcaaaagaccgattcctgaacaaggagcatccaccaaaatcttatcaaaggaatcctggtcaaaaaactcatgcacctttctggcatccaatttttgagtttgaacccgatcttcaactcccagacgttgggcattttcttgaattaaatccaacttgtggtcgtacaagtccagagcagtaacctgacctgtcgtaagataagaggctatatgggctgttttcccacctggagccgcacaggcatcaagcactcgctcatcaccttgtaaatcaagcgtcggagcaaccagctgactggactcatcttggatggtaatggctccatccgcaaacaaattatgccctgcaaaatgcccctgctccttaaccagaccagtggttgctaaaagggaattattcgcctccaacaaggcttggatttcctcttttcgacttaggtctgttacacgaatactggctttgtttcgcactaacaggctttcaaagatggcttttgctctctcctctccgtattcttccttgagtttggcaactagccaaactgggagagaataggcaatggagtcacgcttgttttttcgcttgatgctagcaatatctggccagccttcacgcaagatacggcgaaggacagcgttgaccaatttttcactgccttttttacggagtttggccaattccactgcttcattaaccacagcatgatctggaatcttgtccaaatagcggagttggtaggcactcatgagaagaaggacatagagccagctgtctaactggtctctgtcttcgataaagtgggataggtaccattccagagtcagtttacgggctaccgttccatagaccagctcggtcactaagcccttgtctgctgccaaaagttgacttccctttagatgcttatttaaggcgatatttgaatatgcttggttcacaaaaacatcctctagcactgctagagctaaacttctagccgtttctactttagtcaccaaatcgttctcctacagtcaatgtacgtccaactccgttgaggaaggaagcaatgtccatcttaggcttaccagctggctgcacttgtttgagggatagagccccttcagccgttgcgacaatcaattctttcttgccgatagagagaatctcacctggatttccctgaccttctactggtagggcttcataaatcttaaagcggtcgcccttaaggaaagtatgggcaacaggccaggggttcattccacgaatttggttaaagagttgacgattggttttgttccagtccagtttttcttcctctggctttatatttggagagaaggtaacctgactcgtatcctgcggttcaggtttgatatcaccagcaatataggcaggcagagtgtccaaaagcaaatcacgaccaactagcgccaatttttcaaacaaggtgccaacattgtcctcatctgtgatcggaatgctgcgacgagaaatcatatctcctgcatccatttccttaaccatttccatgatggtcacaccagcttcctcatccccttgaatcaaggcataatggataggcgcaccaccacggtgtctaggaaggagggaggcatgaacgttgacagcaaagtccatgctatcaaggagtttgcttgggagaaactgcccaaaagcagcagtcacaattccatctgctcctagcttcataagatcttccatctctggacttccagataatttttcaggttggtagatagatagtcctgcttccttggcagcctgcttgactggggtttcttggataacttttttacgaccaacagcacggtctggctgggtcacaacggctagaatttcgtaacggtcatctgtcaaaagtccttttaagactgttgctgaaaagtcgggggtccccataaagattagttttgtcatatcttctccttcttataaaaattgctgcggctcatggtcaatgctgagacggagctcactattttcccgttcttgagtcaaggctaaaacctggttgagggtcgaccccagctcatcttctaaacggtatttaattaaaatctggtaatgatagaggttgtgggtacgggcaatcggttttggcgttggccccagaatgggactggtctctgacaagcctgaccgcaaaatgttcatgacttcataggcacgtttgaaaacctcttcttctttcttgtgagaaagggtaataccaatcgtgaaatagtaaggtggatagccgagttgtcgtctgattcccatttcataggcataaaagccttcgtaatcttgatccttggcaaatcgaatagcatagtgctgcggattgtaggactgtatcaagacttgacctgccttttcagcccgacctgatcgacctgccacctgagtcaagagctggaaggttctctcagaagaacggaaatcaggcagattcaaggccgtatccgcatttagaactccgactagggtaacattgggaaaatccaaaccctttgcaatcatctgagtaccaagtaaaatatccgcttcccctcgcccaaactggtcaagcaaggcttggtgactgcctttctttcgagtcgtatccacatccatcctcagaatgcgagcttggggaaagagttctgctagctcatcataagccttctgagttcccgtcccatagtaacgaatactgcggctcttacagttaggacagacctgaggaatatccttcgagaaaccacaataatggcagttcatagtcttggtatccatatgcaaggtcagagaaatatcgcagttgggacaagtatccaccgtcccacactcccgacacatgacaaagctagaataaccacggcgattgagcatgagaaccacctgctcttttttaaccagacggtcttggatagcctctagcaaaggaggcgtaaagtttgacgtctcattttgtccgatatagtctcgaaagtcaatcacttgaacctcagggattgtagccaaaggattggcacgttgggttagacgtaagtgttgatagacgcctttgccagcacgtgcccggctctctaagctcggcgttgcagatccaagtaccagagttgcttgattatactgagcccgtaaaatagctacctctctggcatggtaacggggattgctgtcctgcttataagccgcttcatgctcttcatcaataatcatgacacccagatttttcagaggagcaaagatagcagatctggcaccaacaacaacttgggcatcgccacgctccaccttgcgccattcatcatacttttcaccattggataatcctgagtgaagaatggctaccttgtccccaaaacgtgctataaaacgctcggtcatctgaggagtcaaggaaatctcaggtaccagcaaaatagctgtcttgcccttatccagggcaccttggataatctgcaagtaaacctcggtcttcccacttcctgtaatcccttgaagtagaaagggaggttgagaactgccaatagaactcacaaccgcatcacgcgcctgtctttgttctggatttaactccaaaggtctacttgcttcaattccttcaaaataagcagccgagcgttgaacttccttttggactatggtaacagcaccttgatccacaaagaagttgacttgctctcgcgagtaggactctaacaagctagccaaggaagcgctctctggatgagacagcagataatctctcagttccaactttttcttggcacgtgtagaaatctcaacaccttctaattgagcatggtcaacctcataccaagactgggtcttgaccttcttttgatcgactgcctgatattccagaccaagcaggccttttctagtcaaacgcatcatttcagcttgcttggcaaggtctagtgaagaaaaggctagcgaatcttctgaaccaaacaggcgcactcgttcttcctgactcaagccttccagaggatagagaatcttgtcatagctagaattcagaaaccctggaagcatggccttgaggatagagattttgtaggagaagacagatttgcgtaactcctcagccagccagagttgttctggcgtgagaacaggagaaaaatccagcacctctgcaatatcttttaaatcttgctccatctcttctccatctgattgggacttcaaaccaagaacaatcccttgaatcaggcgattacccttaccaaaaggcacatgaacccgcatcccaacttccagcattccctcaaattcctccggaatcctgtaactatagggctggtccgtctgcatcaagggcacatctacgataatcttagctagggccatcttctcacctcctccttgtcagtacattcttgcaatagaaaaaataagattgagtccccccaaccttaaattttttcaccatcttctttttctttagcaatttgctctttgattttcttttcttcttcttctttgcggcgtttttcttcttcgatacggcgacgcactgcttcacgttttccttctggatctgggtgaattgtaacgtttcctgattcgatttcttctaaagcgcgaagagttgatttttcagacttgaaaccttgagttgctggggcacctgcttccaattcgtgggcacgttttgcttccaagattacgagtgaatattttgaaggaaccttgtcgagcaaggtatcaatagagggttttaacatcatttgcttgtacctattttctaaattttatcgggtagttggagattttggtaacatctcctgatagtgaccaatgacacgatccacacagaagtgttctgcttcaatcacacatttgacacgttcagcagctaggggtacctgatcgttgacaatcgcataatcatactcacgcatgagggcaatttcttccttggccttttcgattcgttgggcaatcacttctgcactatctgttccacgacctaccaagcgatcttgcaattcatccaaatctggtggtgtcaggaagataaagacagcatctggaacctttttcttgacctgaagagcaccctgaacttcaatttcaaggaaaacatcgattcccttgtccaaggtttcattgacataggtcagaggagttccatagtagttaccgacatattctgcgtattccaacatctgtccttgacgaatcagctcttcaaattcttcacgagtacggaagaaatagtcaacaccgtccacttctccaggacgttgtgcgcgtgtcgtcatcgatacagaatattgaaattggttttcagaactctcaaaaatctctcttctaaccgttccttttccaacccctgaaggaccagaaaaaacgattagtaagcctcggtctgccattgtgtctccttttagtcaatctgtgaaataacatttctctagaataatggcaaaaagccagattatcctttacagtctttctatctagtgtaacaaaaaagcagtaatttttcaactgctctttcttatttatttagcataatctactgcacgaagctcgcgaatcacggttaccttgatatttcctggataatcgagattgttttcaattttcttacgaactttgtgagccaagattgtgactttgtcgtccttgatttttcctggattgaccatgatacgaatttcacgtcctgcttgaagggcaaagctagtttgcactccttcaaagccgttagcaatttcttccaaatcatggagacgcttgatgtagctttcaagagactcactacgagcacctggacgggctgcgctcaaggcatctgctgcagcgacgataactgctatcacgctctcagcttcaacatctccgtggtgactagcaatcgtattcaccacaactgggggttccttgtacttacgggccaattccataccgatttcaacgtggctaccttcaacctcatggtcaatggctttcccgatatcgtgaaggaatccagcacgacgggcaagagccgcattttcaccaagttcgctcgccatgataccagccaacttagcaacctcaatcgaatggcgcaaaacattttgtccatatgaagtacggaactgcaaacgtcccataatcttcatcaagtctggatgaaggtttggcgcaccaatttcataggcagcagcctcaccgtattcacgaatcttattgtcaatctcttgacggtttttctcaaccaactcttcgatacgagctggatgtatacgaccatctttgagcaacatttccatagtcatacgggcaatctcacgacgaatcggatcaaatcctgacaaggtcaccacttctggtgtatcgtcgataatcacatcgacccctgtcaaactttcaaaggtacgaatgttacgaccttcacgaccaataatgcgtcccttcatagtatcgtctggcagatgaactgttgagtttgttgactccgctacatattcaccagcgatacgttgcatagcttgaaccaagatgtccttggccattttgtcagaacgttccttgacctcttgctcagcttcgcgaatgcgactggcaatctccctggtcaagttttcctctgtctgagccaagataatatctcgtgcttctgcctgagacagcgcaccaatacgctctagttctgcttctttttgtctttcgacttcctctaattgctcttcacgcgcatcaaggtttttcgctctatcagaaatactttgttctttttgttcaagtgtttgttctttactcgtcaaattgtcgtccttacggtcaaggctagtagctctctctgtcaaacgactttcgatttgtttgagttcttgacgttctgatttgaattcagcgtccacttcttcacggtattttctggcttcttctttggcctccaatagtgcttcttttttaagagacttgctttcacgtttggcttcattaacaagtaaatccgcttcacgctcagcttgtccacgtaaattagttgcttcttgttcagcatttaaaagcatcaactctgcagcttcctgagatgatttcatcttagctgagatgctgacatatccaatgactaaaccaatgatgacggcaaaaacagcaatcgcaagcgacatgatttccatgtttttacctcattttattgttattccgaatgacatacattcttttacattctaccataaaaaagtgattttcacaaacctaaaatagaatatgttttgaggaatttggaacacatttaccaaaataaacttgttgtttagaaatagtagtttagtagagacttgagaaaaagcctacctttcaatagacttagtaatgatctttaaaggacaagaaagccacgctatctccatccatcatataaatcaagcgattttctgcatcaatacgccgtgaccaggctccttggtaatcatatttgagtggttctggtttacctattcctgtaaagggatcacgttgaatatccttgattagtttattgattctttttaacgttttcttatcctgattttgccagtagcaataatctgcccaggcatcttctgtaaacttgagcagcatttcttactcctcaataacatggacctgagtacttccagcacgaacttgagccattcctcgcaaaaccttatcagaaagttccttattttgagcaattctcagggtttcttggatactatcccactcactctttgaaaggactacaatgtcctcatctggatttttattgaccaccgtcaaaggctcaaattcatcatttaccttcttcatgtagtcctttaaatgatttcggaatgttgagtaaaggactgcttccataaccatacctcgttttagctcttttccactattatacacgaaaagaaagaaattgtcaggaacttgtacaagattttcttttctatctatttatactcaatgaaaatcaaagagcaaactaggaaactagccgcaggctgtacttgagtacggcaaggcgacgttgacgcgatttgaatttgattttcgaagagtattattcgtaaaaaatctcaaaaagcctacctttcggtagacttagtttgtttctattc

SEQ ID NO: 88 - DNA, 7001 bp; double-stranded, linear
acgtagaaaaactatttctatcacagataatattccgtatgttgttggaggtattgaaataaacgtcctaggtatctttctcagtctatgtgacttacaagggaaaactcttttcgagacagaaattttgaatgaagattatcctatttcagaaatcaattccaccattaccaatatgataaaaacagctatagagtacgtccctttggaaacaaaattacttggatttggcttatcaatacctggacattataacaaagactccggaagtatcattacaaacaaccccatatgggaatcttttaatttattaaatgtaattaaaagattcaattttccttttattgtaaaaaataatatcgattgtatggctataggacaatacctttttaatccacacaatacccccgataactttattttcctacacgctggattaggtatttacacttcctttttcacaaaagaaaaaataggagcctctaaaaatccttatatcggagaaattggacacaccattgtcgaattgaatgggcaatattgtgaatgcggaaaaaaaggttgtttacaaacatatatttcggatgcttggttaatcaaacacgcccaattattatttaaaaattcccaactaactgtactaaaaagccttgtaaagactgaaaaagacattcatttagacacccttttaacggcttataatttaggcgactccgctttacgtcaacaaattgataaaggagtcaatttattagccacttctattgcaaatctcctcctcatcaatcctgctgataaaatctatatcaacagtcaattgcttaattatcaacctttcactcatgaagtcagggataaaatccaagaccagctccacttcgttccctttactcgtaatatagaaattgaaattttaccttacaacaaacatcgtggaagtataggagcttgtgcattagctatcgtcgcttttttcatagaacatagcaatgtattacaagatattatttcaccttaatatattagaaatctatagacctgtttaaatcaactataacctgtagtagatatctcgtatttagacaatatgaaaacaagacgacttccatataggaaaccgccttctcgctatgttgagtgatttatattaaaataacttttcttctagctgcattttattattataaaaacattcatcataacccccagaacttaaataacaatttttattcaagatacatactcctagaataaactttatatgaaattctcatttttgtttttacaattctccttagttaaatcttgtttaatatatgttttacatatagtatttagcgccacatagtactgaactctctccaaaaacggttattcctctttgaatagggcgttatcacaagaaaagcatctccacgtttcaacttcatatggctcaaaaacaatcaattgatgctaaaacctgtacctagatgtttcggttcataaaaccatgaaactgtaaaagtggatgaaattgatagcgatagtcaaatcaagaggcatcataactctaaaaagtcacaatatataagttcatcctcggaaaaatatcattctaattgttgaaatgcctacatgaaaagaaacgtcaaatgctcatgaaacaacgaatacaggtatcaaaactatgacaaaacaaatccctaaatttactaaagacactgctcaactttacacctgtaaatggttgttgtataataaagttacaaagatgtacgaccacactgttgtaaatcatagtgttcgcgaatatattactgatagcatttctacaaatacaagtaaagagagcggatgagattcaaacgaaatatgtcagtgctttggcattcctagccttcatatcatttaaagaattctatagacaaaattttttccaatacagacactcgtaacaactgcttcatttttctaccaacatatttaggaacaggataagatacaagagtattaatccatagctcagttctataccaatctaagacaaataagctaaaaaaacgattgataataagcaaatagattccaaattttctctatctgctcattttaataaacaatactagtgtaactatccttccagtcagaagcttgtcaaatcacaccgaaaattcttctaaaatttatctcgttaggcaatcaagcaaaaactcgacgatagtacaaacattatcatacaggattgacttcctaaattatatactttagtaaggttttcggataagaaaaaaggttcattttacatttctaaacattcttttctaagatgaaaaacagaatttttcgattgtgatttaaagcaacaagaagattttcagtatcatcctatagatacgagctaattaagaaaaactacatttttgaatataaactacaataatataaactaaattttataggaggaagacaatggattggtacgattatatgatacaggcatccaaacaatcacaattcaacgcaagccattggtttcgctatttgcgaaaagttatttttgaagactattcttatttaacaaaccaagatgtagaaaagttgctagactccaaagaactaacccgttttcaaaaaattagcttgaagtatgcctttcaagagcatactccaactcataaatatgtgatttcattaaataaacctgctaagttaaccaatgttcaaaaattgatggagaaatacaaacatggataaaatgaaaccggtcttccaagccctaaataaggaattaattcaggaaaatctgactttaacaattatctgtgtcggtggttatgtcttagaatatcatggtttacgtgccacacaagatgttgatgcttttatggctctataatatttgtagtgggtaaatcccctatggatattatggagcctatttttgtgtagaaaaaaagtcccatatgacctataatgaaaagcgacaaaacaactcattagaaagaatcatatggaacaattacattttatcacaaaattactagacattaaagaccctaatatccagattttagacatcatcaataaggatacacacaaggaaatcatcgccaaactggactacgacgccccatcttgccctgagtgcggaaaccaattgaagaaatatgactttcaaaaaccgtctaagatcccttacctcgaaacaactggtatgccttctagaattctccttagaaaacgccgtttcaagtgctatcactgttcaaaaatgatggtcgctgaaacttctatcgtcaagaagaatcatcaaattcctcgtattatcaaccaaaaaattgcgcaaaagttgattgagaagatttctatgaccgatattgctcatcagctggccatttcaacttcaactgtcattcgcaagctcaatgattctcactttgagcatgatttttcgcgtcttcctgagattatgtcctgggacgttgaaacagtccggggagtgactgtttcaatcgggagatggagatgagctttattgcgcaagattttgaaaagctcgatatcatcactgttcttgaaggtagaacacaagctgtcatccgagatcactttcttaaatatgatagagccgtccgatgtcgcgtcaaaattattactatggatatgtttagtccttactatgacttagctagacaacttttcccgtgtgctaaaatcgttcttgatcgctttcacattgtacaacatcttagccgtgctatgagtcgtgtgcgtgtccaaatcatgaatcagtttcatcgaaaatcccatgaatacaaggctatcaagcgctactggaaactcattcaacaggatagccgtaaactcagcgataaacatttttatcgccctacttttcgtatgcatttaaccaataaagagattttagacaagcttttgagctattcacaagacttgaaacatcactatcagctctatcaactcttgctgtttcactttcagaataaggaaccggagaaatttttcgaacttatcgaggacaatcttaagcaggttcatcctatttttcagactgtctttaaaaccttcctcaaagataaagaaaaggttatcaacgcccttcaactacactattctaatgccaaactggaagcgaccaataatctcatcaaacttatcaagcgcaatgcctttggttttcgaaactttgaaaacttcaaaaaacggatttttatcgctctgaatatcaaaaaagaaaggacaaaatttgtcctttctcgagcttagctttttttcaacccactacagttgacaaagagccggaaaaaggaacagccttagctttcctttcatttctttttatttccctcgtagtaaacgtgctagcttccacaaaacaaacaggattcccagaaatgccagtaccactagcccacggtacaaccattgagaggttgcaacacgcgatacagattgtccttctttcgtaaaagcaaccctcgcaactgcagctgtttgtggatctgatttttgataaacagcgactcgttcaaaattcactaataagcgtttattaaaggtaggaatcggatcgcaggttatcaaggtcatgatatttttagagctaaccgattctaatttttcccattccgacggtaaaataatctctgtgtccatcatctgatattctacaatttcctggccattatcataataaagagcatctccaacttttagctgatccaaatggcggaaaaagacatggcttggctctgcacggtgcccagcaatcactgagcgaatccctgtaccatccagaggcagcggtgtaccatccacatgagccaagcccatccctaaatgatgataatctgctcccaaataaaccggctccatgatttccaaacttggaatagacaagtaaccatagactgcatcagggtcgtcagacacttggtaattgacctcatatccctccgccaaaaaaggatctacaatgcgattttgcgaagccaagcgttgattgtaggcgagagaatggttctgttgttcttggtacatttcagttgtcatggatttcacaaatgtagcatgacctttcacctgtccaagagactgcaacaccatctgtccaaaacaataaataggaatcaaacaggctaccaacatcaacaagtatcccaataaggctcgtagtttagtccttgacatgacgcccctccaattgcttttctagtcctttgacaatccgtcgattacgatacacgcgatacagcaagagaaggatgaccgccatcgctcctagtaataaccacaaccagaattgcccacgctctctcaccgctcgattccgctctgcaattggtgccgtatacggaatccgcttcccacgtaccaacagacgatgactgttaatcatatacggtgtacaagtcaacaaggtcgcataatcttccccatgttgaatcaagacaggctcaaagtcattcggctccaccgtcactatctgatccacttggtaggccaacacctgatctaaaacgtgaagataaaagatatccccttttttcatcttatccaattgactgaacaattctgccgttggcaatcctctgtgagcagtgatcactgtatgggtattttcacctccaacaggcagcgaagccccttctaacagccctgcccctttctgaagaatgtcctcactcgttccgacatacatcggaatttcctgatcaatcgcaggaatttccacatagccaatccgctcatggacctttagcatattggcatattctgagacgcctttctttttctcttgctctgtaaaaggatcaagaatttcagatggtttcaaggtcgcattgaaggcttgagccaagcgccaacgctcctcaagttctgccttatccatctgggaaaccgtctcatcaaactctttaataacctcgtttgactcaatacgataataataacgagacaccaatggatatatcgcaacggcgaatcctactaagaaaatcagaagaaggatcagcggatgtttcttcttttttgtgcctttttttcgtgaacgtctactgttgtccatcctccaccttcacttccttccttgctgctttcagcgccttcaaagccttttccggttgttttttcttcttgcgcaagcgtcgaataatccataaaagaatcacaatcaaaccaactgccacataaaacaggtagcgatagagatgactgagtttgtttgctgcaataaattcttcctcaacctctgctacgtacggtatccgatgcccccgaaccaatagacgatgggtattgatcatgtatggcgtacaagtcagcaaggtcacataatcatgacctggtacaatcaataaatcatcaaagttcgtcggctcaatcacctttacttgatccacttgataggccatcacttccttgatattgtgcacataaaacttatccccaactttaagtttggtcaaatccgtaaacatcttagctgttggcaaacctgtatgtgccgtaatcaccgcatgggtcgaattgcctccgatcggcagagaagttccctctagatgcccagccccttgctgcaatacctcttcagcagtaccagcataaaccggcaaatccacgtcaataacggggatttccacatgccccatccgctcatggatttctaacatacgtgcatactctgctcgcccttttttcttcatttcttccgaccaaggatcgccactcactacattattcaaagagtcattgaaggcttgtgccaatttcattcgttcatcaatgtcagcctcatccaacgttgctttttccttatcaaagtcagcaatttgttgatttgattccactcgataatacaagcgagacaccagcggatacgccattaccgccattccaatgaaaaataccactcctaataggagattatttcgtttttgcttttttgtttttaccatttttatcagcatccctttatcttcaaacttcagggtatc

SEQ ID NO: 89 - DNA, 10411 bp; double-stranded, linear
gagggagcttaagaagttaccaccgtcctctagcgccttatccgcatcaaagttaaggttgatatttttaaaactgtcgccagcttgtgatacgatgctttgtttaaggtcatttagggttttagtgaaatctgcattgctgaggatatcactctttgagagattcaaggcaaaattgatgatgatattgatctggtttcctgttatgacctgatcaagtttgtaattttttaaggtatcttcaacaatcttgcggatatcttcttctgtcagatttcccttactttctttagctttggcgagtcctgacttgatatcagctagggcaacgtttaatttattagcatcatagcctgatttgtccttgttttcagcattgatatctgacaaagcttttagctcttcttgagccaaatctttattagcttgtggcaccttggctccattagcctctagcgaatagtaaatccctgctaaagcactttctcctgtaactggaataggggctgctacagtgattttggcatgttccatacccagcgttactgctgcgtttcggtacatatcctgagtcaccttagtgatattttctggtgtttcaatcttgacctcaagtggcgatttgtcacctagcttttgaatcttggctgatgaatacaactgtaagctagagtcattggccacattcatgattttagaataaacatcaggtgtcatggtcttgagttctttggtatctgttgaggcattgtagcccagttttttaagagtttgatttttttggtcttcagatagggaggaacctaggacatattcaggttggacataggtttcatcgataactttttgaacatctgttgctgcatggacgctattcatagctgttactgcccacaagatcgcagcgctagtcagaaagagtttctttctcatagggaatttcctcctttacttctttagagtaatatatctatcttaaagaaaacttataacaaaaacacctggtctagccagatgttgaaaagagagtgaaacatttgatgatgtaaaggttaagtcgtacctgtctagaataataatagtttcctccatttacatagagttcagcaccgtgaaaaatggaaatggggtgaatataactataagtctttccagtcctattaccaagcaagggggcaacagtctcacgagagtactgtttggctagagccagggtattttccttgccattttgggcgataaaatcgatataggcaggtccaaaattataggcttgaacagctgtccagatatctacccccttcttctgcgccagatagagattgcctgtcagagtttgaatgccttgccgaatgctagaggcattatcattgatggtgttggtggaaccacttgcagactcactagactgcataacatcgccttcttttccttttgtttcagtataaatcatagcaagcacaagctcttcgtttgctggggtgtcttgttcactcaatatttctcgcaccatgggttgataggtcatgacttgtttgacatcttgatgaacgcggtaagctttatagccagcaaaaaggaagactgctagtacaagcactcttcgaattcgtttaaacattatttactttggatatcctcgatatttttgattaagatagagtaggttccattttcgttttggataaactcaacagactcggcgtcttgatagacgttattgggaacgatgagctcaattccatttgataaggagagtttttggttttcaaatttctttaattggcgactggcatcaatttcatcaaattgaacaggttctggtacggcttctttgacttggtcaataaagctcaaacgagccgtcagattgttgtcaaaaaggtcattagccaatttctcaggtgacaattcattgctttcttctaggttgttgaaaatagctgatttgaccttggattgaaattgaaaatcatctgtgttaaaagatttagcaattctctgggctgttttttccagttccttgatagattttttaggagaaatcttaggagcgacagcaagaagattatctgaaaaatagttcaaaaaagtcccgttgtacttgattcgtttttcaatcaggtgatacttgctactctgaagattgaccaccaaggcctcatcagctcctgttccaaatccaggcaggttattctgagttagcttgattggattatcaacttctcctccgaggtgggtcaaggtctcccgcagggcaattcgcaagaaagcgaaatgttctacaccttctttagaaaattgcacaaaaatcaagtcattggtcttgagattttcagaaatgctaaactcctctttccagagattagccagcgttactgatgtctccaacaaatcgtctgtaatatgattgaagaagggattttcttcttcgaaaatcccagtcttggcttcatctgaatacacatgttcaatttttttacgcaggtattcttcgatttttggagtaatattgagaaacttatctgctaagaacagttcggtatcatccggactgaactggtgaataatggctttcttaatataaatgtccataaaagttttagtcctcgtataatgggaaggcatctgtcaattctttgactgcacttctcacttcttctaatacagcctcattttctgaattcttaagggttttaatgatgagttcagccactttgcgactttcttcttcaccaaatccacgtgcagtaatggctgctgctccgatacgaatcccacttgtcttgaatggtgacaagctttcgtaagggattgagtttttatttaaggtaatattgacttcatccaacaagttttgagcaactttgccgttttctacaactttagtcacatcaacaaggaagagatggttttcagttccacctgaaataatacggaaatcagggtcttgcaagaagacatctgccatagccttgctgttcttaattacattggcagcatattccttgaaggctggatccaaaacttctttgaaggaaactgccttagccgccacaacatgctctaaaggaccgccctgaatacctgggaaaatagctgaattgatttttttagcaagttcttcgtcattggtcaaaatcaaaccaccacgaggtccacgaagggttttgtgggtcgttgttgttgtgatatgagcgtatggaactgggcttggatgaaggccagccgcaaccaagccagcgatatgggccatgtccaccatgagcttcgcaccgacagcatctgcgatttcacggaattttgaaaaatcgataatttgagaataggctgaagcaccagctacaatcagttttggttttacttcttgggcttgtttcaagatagcatcaaagtctaagagttccgttttaggatcaacactataagaaacaaagttgtaggtttgaccagagaagctaacaggagccccatgagtcaaatgaccacctgatgccaaatccattcccataaccgtatcacctggctcaatcaaggacatgtaagccgcacagttagcttggcttcctgaatgtggttgaacattggcaaatttagcaccgaaaatttcttttgcgcgttcaatagcaagagtctctacaacgtctactacatcagttccaccataataacggcgtcctgggtaaccctcggcatatttatttgtcaagatagacccttgagctgccataacagccttggaaactacgttttccgaagcaattaactcgatattattttgttggcgttcttcttctttggcaatagcattccagagatcagcatcatatgctttaaaatcatctttgtcaaaaatcataggtcttctcctttattgtgtgactagtccattagtttgattttacaataagaaaatcaaactaacagatgcgaataaaccgtttctgcattttatcacaagtatagccaactttttcataaaatgcatgagcacccagacgatgattggcagaatttaagcggataaacccataaccacatctttttgcttcttcttccaacccttgtagtaaacttttaccaataccttgaccttgcgcttgaggtgaaactgctaaagctaagatattaaatcctgctttggaatagagtgattcgtaaacttcagcgtggacatatccaagtaagacatgattagctgcatcctcatagccaagtaggaaatgatgggaatcctgagacagtctagctagttggctagccgtttcctctggactaaaagtataacccaaagcctcttggttgatgtcacatatagctttcacatcagtttctcttaaatctcttagcatctcattcctcctcaaaagaaatctttggcaaccgagcaagaatatcttctcgcttaatggccccttgacgtaagattttcaccttgtctcccgacaaattcaaaatagttgaatcctgtccagttagaaaagcatcgtcttccagacccagaacctcttggtcaaaatcctctagaatttgattaaaggtcactccactcgcctgacctgagatattggcagacggcccaatcaagggacctgtctctcgaatcaaatcaagggtaatgggatgactaggcatccgaaatccaacagttgcaaggccagaattgacccaatagggaactcggtcattagcttcgagaataatggtcaagggacctggtaaaaagatctctacaagtttttgaagataagttggctgattctttgaaaagtacaagatgtcctctaaagaggcaacattgagattgagcgccttgtctctacgtcgacgtttaagctggtaaacatggtcaactgctttttcgtctagcgccttagcaaagagaccgtaaactgtctctgtaggcaaaacgacagctccaccattttccaactcttgtctaatcctgtccatcatcaacgacaaccatcctatcttgaccaaattggtccttgagtgttcgtactcgcttttcaggaagatgtttcctaaaaagttcaggaacactttgaccttgcttgtatccaatttcaaggtaaatcttaccaccatctttgagatagtcttttgcatcttccgcaattctacggtaaatagctaggccatcctcatctgcaaagagagctagatgaggctccgaatacaagacattcaagcctacctctgactcatcttcacgagagatatagggtggattggaaacaattatatcatatttttcagaaatttctgtaaaacagtcagatttttttaaaaatatttgaagattttgatttttagcattttcgctagctacatctaaagcatcttgggaaatatctgctgccgtcactgaccaatctggtctgttttttgctagagcgagagcaatagctccactacctgttccgatatctaggaccataagatttttcacaggattttcagccaggataagctccaccaactcctctgtttctggacgaggaatcaaaacccgttcatccacctttaaatgcattccataaaaatctgcctgtccaatgatgtactgagctggcttgtgagctgctagttgctggtaaatatcttctacaaattgtttttcttcctctgttgtcacctcctgctggagggcaaaaataaagtctgtaaaagatagatttttcagactacgatagacaaaagagaggctttccgcttcctctccttgtcttatcaactcttcttcaaaatttgaaaataattgagctaatttcattatttgtttaattcttctagtttttgtgtttggtcataaagcaccaaggcatccacaacttcgtccaatttaccagacaaaatcgtatctagtttttggagggtcaagccgatacggtggtctgtgacacggttttgtgggaagttataagttcggatccgttctgaacggtcaccagtaccgattgtcgacttacgctcagcgtcctgctcatcttgagcaatctgagcaaagtggtcagcaacacgggcacggatgattttcatggccttctcacggttcttctgctgggtacgttcttcctgcatctcaaccttgatattggttggcaagtgaacgatacgaacggcagtcgcaaccttattgacgttctgtccaccagcaccagaggcgtgatagatgtcgacacgaaggtcttttggatcaatgtcgtattcaacctcttcaacttctggcataacaagaactgtcgctgtcgaagtatgaacacggccttggctttctgtcacaggaacacgttgcacacggtgggcacctgattcatacttaagcttagagtatacagactgacctgaaaccatagcaaccacttctttaaaaccaccgacaccattcatagaggcttccatgacttcaaagcgccaaccttgggcttccgcatacttttggtacatagttagcaaatctccagcgaaaagtgccgcttcgtctccaccagctgctccacggatttcaaggatgatattcttgtcatcgtttggatcctttggaaggagcaaaattttcagtttttcttcatattcttctttttcagccttggcatctttgagttcttgcttggccaattcttccaagtccgcatctccgcctgattccttaatcatctcttcggcatcgacgatattttgaaggacttgtttatactcacggtaggctattacggtgtcacgattggaagcttcttcttttgaaagctccataaaacgcttggtgtctgaaacgacatcagggtcactcagcaattctcctaattcttcataacggtcttctacaacttgtagttgatcatagatgttcattttttctccttatttctcaattgttaaatcatagattgctactacttcattctcggatatttccccagtttctttaaatccataactgaggtaacaaaatcttgcctgttcattttctggttcatargacaaccaaagtttattgcttaaacctgctggcgctgttcgaacatagtctagtactttatccataattggtttaaaatatccttgattttgaaaattcttatcaatcataaaacgaaatagtaaataatttccactactaattccgatctttttatcataagctatcatcacaaaacctataattgcatcattatcataaactgccaatggagctacaaaatctccatttttagtgtagacgtatgcttcagctaaactaattgcgttggttgcaatgaattgtttttgatattccttgacatccaaatttaaaacatcaaaataattttccattgtaacatctcttagttcaattgtcatagttttgctccttgttagaggttatcattggcgcaaaataatgtttacggcaaactgagatataggtttcgttaccaccaatctggatctgttctccatcgtaaacgggcagtccatcctgtgttcgcaacaccatggtcgcctttttcttgcaatactgacagatggtcttgatttcgtcaatcttgtctgctaaaagcaagagatatttggaaccttcgaacaattcattgcgaaagtcatttttcaagccaaaagccatgacgggtatgtctaactcgtccacaacacgagctaggtcgtaaacatggtggcgtttgagaaactgggcttcatcgaccaaaacacagtaaggtttttctggtaggtctcggatatagccaaagatatccgttgtttcctcaatcgcaagggcagggcgtttcatgccaattcgactcgacacatagccaacgccgtcacgcgtatccagagccgaggtcataatcacaacaccttttccttgctcctcgtagttataggccactttgagaatctcaatcgttttaccagagttcatggtcccataacgatagtacaactgtgccatgtttcttgcttcacgtccatttctaaatttttgctacattctagtatatcataattttcttaagctttaaacggcaaaatgtggtaaaatagaagaaatcaaaaactagtggaggaagctattatgccatttgtacgcatcgatttatttgaaggacgcacgctcgagcaaaagaaagctcttgctaaggaagtaacggaagcagttgtccgcaacactggagcccctcaatctgctgtccatgtcatcatcaacgacatgccagaaggaacttacttcccacaaggggaaatgcgtactaaataagctagcttaagcagaattgcttaggctttttcaatctccaagtagcattcattgaagaaatatcctaaatttgttacaatttgaaaagaaacttggagaatttccaagaaaagagctattaattaaaggaaacattatgattacacgtgaatttgataccatcgctgctatctctactccactaggtgaaggggctattggtattgtccgcctgagcggaacagacagttttgctattgcgcaaaagatttttaaaggaaaagacttgaacaaggttgccagccacactctcaactacggtcacattattgatcctctgactggtaaagtcatggacgaggttatggttggggctatgaagtctccaaagaccttcactcgtgaggatattatcgagattaacacccacggtgggattgcggtgaccaatgaaattctccagctagctattcgtgaaggggctcggttggcagaacctggtgaatttaccaaacgtgcttttttaaacggtcgcgtagacttgacacaggcagaggctgtgatggatatcatccgtgccaagactgacaaggccatgaacattgcggtcaaacaattagacggctccctttctgacctcattaacaatacccgtcaagaaatcctcaatacacttgcccaagttgaggtcaatatcgactatcctgagtatgacgatgttgaggaagccactactgctgttgtccgagagaagacaatggagtttgagcaattactaaccaaactccttaggacagcacgtcgtggtaaaatccttcgtgaaggaatttcaacggctatcattggacgtcccaacgttgggaaatcaagccttctcaacaacctcttgcgtgaggacaaggctatcgtaacagatatcgctgggacaacacgagatgtcatcgaagagtacgtcaacatcaatggtgtacctctcaaattgattgatacagccggtattcgtgaaacggatgatatcgttgaacaaattggagttgagcgttcgaaaaaagctcttaaggaagctgacctagttctgctagtactaaacgctagtgaaccactaaccgcccaagatcgccaactcctagaaatcagtcaggagactaatcgcattattcttcttaacaaaactgacctgcctgaaacgattgaaacttcggaactacctgaagatgtcatccgcatttcagttcttaaaaatcaaaacatcgataaaatcgaagagagaatcaacaacctcttctttgaaaatgctggtttggttgagcaagatgctacctacttgtcaaacgcccgtcacatttccttgattgagaaggccgttgaaagcctacaagctgttaaccaaggtcttgaactagggatgccagttgacttgcttcaagttgacttgacccgtacttgggaaattctaggagaaatcactggagatgctgctccagatgaactcatcacccaactctttagccaattctgtttaggaaaataagaaaaatccatgatccttcattcggtcatggattttaggttctataatatttgtagtgggtaaatccactatagatattatggagcctattttattgtagaaaaaaagtcccatatgacctataatgaaaagcgacaaaacaactcattagaaagaatcatatggaacaattacattttatcacaaaattactagacattaaagaccctaatatccagattttagacatcatcaataaggatacacacaaggaaatcatcgccaaactggactacgacgccccatcttgccctgagtgcggaaaccaattgaagaaatatgactttcaaaaaaccttctaaaattccttatcttgaaacgactggtatgcccactagaattctccttagaaagcgtcgattcaagtgctatcactgttcaaaaatgatggtcgctgaaacttctatcgtcaagaagaatcaccaaatccctcgtatcatcaaccaaaagattgctcaaaagttaattgaaaagatttctatgactgatattgcccatcagctttccatctcaacttcaactgttattcgtaagctcaatgactttcactttaaacatgatttttcttgtcttcctgagattatgtcttgggatgagtatgcttttacaaaagggaagat

SEQ ID NO: 90 - DNA, 2393 bp; double-stranded, linear
gttttgggttctggaaattatcagatggttggaaaagccgtccacatcaagatagtgttcggagatttaagtttaaattgaagaaactaacacagaggaaatggagtatagacctaacaagacgtattgagcaactgaatttgtctattcgaggatggataaactattgctcattgggaaatatgaaaagtatagtcgccagcatagatgagcgcttgcgtactcgcctacgagtgattatctggaagcaatggaagaagaaatcgagacgattatggggattgcttaagttaggagttcctaaatggatagcagataaggtatctggctggggcgaccattatcaattagtagctcagaagtcggtacttaaacgtgctatatcaaaaccagtcctggaaaaacgtggactggtttcgtgtttggattattaccttgaacgacatgcgttaaaagttagttgaaccgccgtatgccaaacggcacgtacggtggtgtgagaggggctagagattatcccctactcgattaactcccctgaaatttattttaattatgcaaatttcacgtatttttgatgctgagacgacgatcctgggaacttttcagatatttttttgactatctaaatctatcattagaaaagcttagagcgccaaaggatttgagcgtttttctgatttttaagactttttccagtctctttttcgattgaagatgtaattattctactaactaactaacttcttagtactagccaacaacgataatcataattcctcctaaaattaggaataataaaggcaatagtttttgttttttcatgtaaaaaacctcacttttgttttctgctattttatgctaaaatattaaaaatcaaatttaattccaaagtttgtaactaaagggggagcgctacatgtctaattcatttgtcaagttgttagtctctcaattatttgcaaatttagcagatattttctttagagtaacaatcattgctaacatatacattatttcaaaatcagtaattgccacatcactagttcctatcttaataggaatatcctcttttgttgcgagtcttttagttccgttggttactaaaaggttagcgctaaatagggttttatctttatctcaatttggaaagactatattattggcgatactggtaggaatgtttaccgtaatgcaatccgtagcgcctttggtgacctatctatttgttgttgcaatttccatactagatggttttgcagcacccgtttcctatgctattgtgccacgctatgcgaccgatttgggtaaggctaattcagccttatcaatgactggtgaagctgttcaattgataggttggggattaggtggactcttgtttgcaacaattggtctgttacctaccacgtgtatcaatttagtcttgtatatcatttctagctttctgatgttatttcttcctaacgctgaagtggaggtgttagagtcagaaactaatcttgaaattttgctcaaaggttggaagttagttgctagaaatcctagattaagactttttgtatcagcaaatttattggaaattttttcaaatacgatttgggtttcttccattatacttgtttttgtaacggagttattaaataaaacggaaagttactggggatattctaatacagcatactctattggtattataattagtggcttaattgcttttaggctatctgaaaagttccttgctgctaaatgggaaccccaattattcaccccaaatctaaaaaccatccagaatccttgccttagcttagatcctggatggtttcttttttcacccaatgggtgttttttactagacaaaaaagagtttcccctttatggtataagtgtagaaaaaaacacaaaaagaaaggaaactcacatgaacagtttaccaaatcatcacttccaaaacaagtctttttaccaactatctttcgatggaggtcatttaacccagtatggtggtcttatcttttttcaggaacttttttcccagttgaaactaaaagagcggatttctaagtatttagtaacgaatgaccaacgccgctactgtcgttattcggattcagatatccttgtccagttcctctttcaactgttaacaggttatggaacggactatgcttgtaaagaattgtcagctgatgcctactttccaaaattgttggaaggagggcagcttgcttcacagccaaccttatcccgttttctttccagaactgacgaggaaacagtccatagtttgcgatgcctcaaccttgaattggtcgaattctttttacagtttcaccagctaaaccaactcattgtagataacgattctacccatttcacaacttatggcaagc

SEQ ID NO: 91 - DNA, 4762 bp; double-stranded, linear
tttgtatctttttaggtctctttcaatccaaaccctttaaactatacgtcatttcggttcctgcaagtcttgtggtaattttaggtttgattttacttttcttttcacaagagcctctgcacgcttcttatttgatggtcgtcttccctgttttcctacttttattggtaaccaatattaagagtcaacagagggggcgtagtgctagaagaagccgaagagaaacgccattatgcctatggagtcgtttcttcaaaggaaatctatatctgctagtttttgggtttgtctatcttttgtctgttccttttttgatgaagtttgtcctttatccagtaccttatcaagaacgtaatcgtcttgctgatttggtaaaagaggagacaaatacggaagatgctatctcatgcatgggatgatactgcgactctttatcgtaagagtgagcgcttgtcccatcggcgattttgtccccgttgcactatacagcaactgaggaaaatcgtaataagttacttaatgacttgaaagaaaaacaacctaaggtgattgtggtaaatgataaggtggtagtctggtctgaagtggaaacactcttaaaagaaaattaccaacaagtaaagactgattactcagagtttaaagtctataaaattaaataaccaaatcaatatcttgtgtatttttaaaaattttaggatttttaacacaagatattgatttttctttttagagtggtataatactttttagaaagaacattttagaaaagagcatgcatatgattgcactagaagaaaaaattacaattttgccaactctcttcgtcgagaaacgagatgggagacgtgttgtatttgatgtggacaagattgacaaggctctccacaaggcggctgacaaggttatggatgtgacacccctggttgaaaaatgcctcaatgatctgactgagcgaattattacagaaattcatagtcgctttccacagggaattaagatttacgaaattcaaaatatcgtagaacatgaactccttgaagccaaagaatatgcgctggctgaggagtatattacttatcggacacagagggattttgagcgctcaaaagcgacggatatcaactttagtattcataaacttctcaacaaagaccagacagttgtcaatgaaaacgctaataaagacagtgatgtctttaacactcagcgtgatttgacagcagggattgttgggaaatcaatcggactgcaaatgcttcctaagcacgtagccaatgcccaccaaaagggggatatccactatcacgatttggactacagtccctatacccctatgaccaactgctgtttgattgattttaagggtatgttggaaaatggttttaagattggaaatgcagaggtagagagtcccaagtctatccagactgcgacagcacagatttctcaaatcattgccaacgttgcttctagccagtacggtggctgttcagctgaccgtatcgatgaaattttggcgccttatgcagagaagaattatcaaaaacatctcaaagatgcagaagagtgggtattgcctgaaaaacaggaagattacgcttggaagaaagcgcaaaaggacatctacgatgccatgcaatctcttgagtatgaaatcaatactctcttcacttcaaatggacaaacaccttttacttcgttaggttttggtctgggaaccagtcgttttgaacgagaaattcaaaaagctattttaaacattcgcatcaagggtcttggttcagaacaccgtacggctatctttcctaaacttatctttacgcttaaaagaggcctcaacttagaggaaggaactcccaactatgacatcaagcagttggctctagagtgtgcaaccaagcggatgtatccagacgtcttgtcttatgataagattgttgatttgacaggttctttcaaggtgcctatgggctgccgttctttccttcaagggtggaaggatgaaaatggtgtagaagtcaattcaggtcgcatgaatctgggtgttgtgacggttaatctgcctcgtattgctcttgagtctgaaggtgatatgaataagttctgggaaatcttcaacgagcgaatgaatatcgcagaagatgctcttgtttaccgtgtcgaacgcactaaagaggcgacaccagcgaatgctcctattctttatcagtacggtgcttttggccatcgtctaggtaaagaagaaagtgttgaccagctctttaagaatcgtcgtgcgaccgtttcgctgggctatatcggcttgtatgaagtagcgacagttttctttggtaacagctgggaaagtaatccagatgctaaggaattcacgctagacatcattcacgatatgaaacgccgtgtagaagagtggtcagaccaatatggctaccatttctctatctactcaacaccatccgaaagtctgacagaccgtttctgccgactagatatagacaagtttggctctattcctgatatcacagacaaggaatactacaccaactctttccactacgatgttcgtaaaaatccaacaccgtttgaaaaattggactttgagaaagtctatccggaagcaggtgcgtcaggtggtttcatccattattgtgagtatccagtccttcagcaaaatccaaaggccttggaagctgtctgggattatgcttatgaccgtgtaggctatctaggcaccaatactccgattgaccgttgctacaagtgtgactttgaaggggattttgaaccaactgagagagggtttgcttgtccaaactgtggcaatagcgaccctaaaacagtagatgtggtgaaacgaacttgtggctacctaggtaatcctcaagcaagaccgatggtcaacgggcgtcacaaggaaatcgctgcgcgtgtcaaacatatgaatggttcaacgattaaaatagctgggcatcaagtaacaaattagaaagaaatgaaatgggaaaatatcaactagacgataaggggcgcgcacaagtgacccgttatcacgagaaacactctaaaggtggagctggtaagaaagaacgcttgcttagcttcagagaacaatttttaaacaagaacaagaaaaaataaaagtgagagccagctctcgcttttctcatagtgggaggtaaggatggaattacgcagaccaagattagcggataagaaagctgttttagatatgatgacagagtttgaaaaatttcagtcgcctcacgacggcggtttctgggatacagagaactttgtgtatgaagactggttagaaagcaatcaggaacaggaaatggggattaatctgcctgaaggatgggtttctgcaattcagttagtggctttttctgagaaaggtcaagcagttggatttcttaatctccggttgcgcctcagtaactttctactagaagaaggtggccacattggctactccattcgtccatctgaaagaggcaagggttatgcaaaagagactctccgtcagggcttgcaagttgctaaggaaaagaacatcaagaaagctctggtgacctgtagtgtgaataatcctgctagcagagcagtcattctagcaaatggtggaatatttgaggatgctcgcaatggagtcgagcgttattggatagaggtagcgaatgaataatccaaaaccacaagaatggaaaagcgaggaacttagtcaaggtcgtatcattgactacaaggcctttaactttgtggacggcgaaggcgtgcgcaactctctctatgtatcaggctgtatgtttcactgcgagggatgttataatgttgcgacttggtcttttaatgctggcattccctatacagcagaattagaagagcagattatggcagaccttgcccaaccctatgttcaaggcttgactttgctgggaggggagccttttctcaatactgggattctcttgccacttgttaagcggattcggaaggaattgccagacaaggacatctggtcctggaccggctacacttgggaagaaatgatgttggaaactccagataaactggaattcttgtcactgattgacattcttgtcgatggaagatatgatcgaactaagagaaatcttatgctccagtttcgaggttcatctaaccaacgaattatcgatgtgcaaaaatcgctcaaaagtgggcaagtagtgatttgggacaagctcaatgacggaaaagaaagctatgaacaggtgaagagagaatgaagaaaaaggacttagtagaccaactagtctcagagatcgagacggggaaagtcaggacactgggaatatacggtcatggagcttcaggtaaatcaacctttgcacaggaattgtaccaagctttagattctactacagtaaatttgctagagacagatccttatatcacctcaggacgccatctggtagtacccaaggacgcgccgaatcaaaaggtgacagccagtctgccagtggcgcatgaactggagagtttgcagagagatatccttgcttgcaggcgggtatggatgtcttgacaattgaagaaccttggaaggctagtgaggtcttgtctggagccaaaccaattttgattgtcgaagggatgtctgttggctttctacccaaggaactctttgaaaaaaccatctgtttctacacggatgaggagaccgaattaaagcgacgccttgctagagatacgactgtgagaaatcgcgatgcgg

SEQ ID NO: 92 - DNA, 3832 bp; double-stranded, linear
gatgcaggtttcgacccacatattccagaaaattactttaaagatgatgatgttaatcaggtaccttgtctttgttggtcttcatctgcagccctctttttcagtaattgggtagaccatgcggtctatcaggagacgccttttgattggagaaagatagaagatgatgcatctgcatatgggtatttataagaggaattatgacatatttagacgcttttaaatcaggtaccttggttttaccgagtgccctgctcttgcattttaaggaactctttccttctagcgacgattttctggtttggcaatttttctatttgcaaaatacgacaggcttagaagaaatgtcgccaagccagattgctgaaaggattggcaaggaaatttcggatgtcaaccagtccatttctaatctgacggaaaggggactgctccagtatcgtactatcgaattaaatggcgaaattgaattgctctttgatgctagtttggccttggaacgtttggatgacctgtttggagcagttcattcaagttcagaccagctaacacctcaaaaccagctcaaggatttggtggaaaccttccagcaggagttgggacgattgttgacgccttttgagattgaggatttgaccaagacactaaaggaagatggaaccagtgctgacttgattaaggaggctcttcgtgaagctgttttgaatggaaaaccaaactggaagtacattcaggcgattttgagaaactggcgccatgaaggaatcaagagtgtggctcaaattgaggccaagagagcagaaagagaagcaagcaatcctcagttgacacaggtatctgcagatttcataaatgccatggatctctggaaggattaatccatgcaagtaggcttgaaatccgagtaagatttgcaagctgtgtataattgtgatagaataaatagaaaataaattgaaaaaagaggtatgtgaaatgtcacgtaaaccatttatcgctggtaactggaaaatgaacaaaaatccagaagaagctaaagcattcgttgaagcagttgcatcaaaacttccttcatcagatcttgttgaagcaggtatcgctgctccagctcttgatttgacaactgttcttgctgttgcaaaaggctcaaaccttaaagttgctgctcaaaactgctactttgaaaatgcaggtgctttcactggtgaaactagcccacaagttttgaaagaaatcggtactgactacgttgttatcggtcactcagaacgccgtgactacttccatgaaactgatgaagatatcaacaaaaaagcaaaagcaatctttgcgaacggtatgcttccaatcatctgttgtggtgaatcacttgaaacttacgaagctggtaaagctgctgaattcgtaggtgctcaagtatctgctgcattggctggattgactgctgaacaagttgctgcctcagttatcgcttatgagccaatctgggctatcggtactggtaaatcagcttcacaagacgatgcacaaaaaatgtgtaaagttgttcgtgacgttgtagctgctgactttggtcaagaagtcgcagacaaagttcgtgttcaatacggtggttctgttaaacctgaaaatgttgcttcatacatggcttgcccagacgttgacggtgcccttgtaggtggtgcgtcacttgaagctgaaagcttcttggctttgcttgactttgtaaaataatcagtaagtagcaaaagctaggtggaacagcattcagatgtctgttacattttttataggagagaaagattgaaaacaaaaattggattagcaagtatctgtttactaggcttggcaactagtcatgtcgctgcaaatgaaactgaagtagcaaaaacttcgcaggatacaacgacagcttcaagtagttcagagcaaaatcagtcttctaataaaacgcaaacgagcgcagaagtacagactaatgctgctgcccactgggatggggattattatgtaaaggatgatggttctaaagctcaaagtgaatggatttttgacaactactataaggcttggttttatattaattcagatggtcgttactcgcagaatgaatggcatggaaattactacctgaaatcaggtggatatatggcccaaaacgagtggatctatgacagtaattacaagagttggttttatctcaagtcagatggggcttatgctcatcaagaatggcaattgattggaaataagtggtactacttcaagaagtggggttacatggctaaaagccaatggcaaggaagttatttcttgaatggtcaaggagctatgatgcaaaatgaatggctctatgatccagcctattctgcttatttttatctaaaatccgatggaacttatgctaaccaagagtggcaaaaagtgggcggcaaatggtactatttcaagaagtggggctatatggctcggaatgagtggcaaggcaactactatttgactggaagtggtgccatggcgactgacgaagtgattatggatggtactcgctatatctttgcggcctctggtgagctcaaagaaaaaaaagatttgaatgtcggctgggttcacagagatggtaagcgctatttctttaataatagagaagaacaagtgggaaccgaacatgctaagaaagtcattgatattagtgagcacaatggtcgtatcaatgattggaaaaaggttattgatgagaacgaagtggatggtgtcattgttcgtctaggttatagcggtaaagaagacaaggaattggcgcataacattaaggagttaaaccgtctgggaattccttatggtgtctatctctatacctatgctgaaaatgagaccgatgctgagagtgacgctaaacagaccattgaacttataaagaaatacaatatgaacctgtcttaccctatctattatgatgttgagaattgggaatatgtaaataagagcaagagagctccaagtgatacaggcacttgggttaaaatcatcaacaagtacatggacacgatgaagcaggcgggttatcaaaatgtgtatgtctatagctatcgtagtttattacagacgcgtttaaaacacccagatattttaaaacatgtaaactgggtagcggcctatacgaatgctttagaatgggaaaaccctcattattcaggaaaaaaaggttggcaatatacctcttctgaatacatgaaaggaatccaagggcgcgtagatgtcagcgtttggtattaagcgatgatttgaaagagggatgtgatagtagcaccctctttttctttgttttatgatagttcatcctcgagtaaattcaagttcttgctcggaaatgaagcttatatagtagattgaatatagacaaataccttgtgattggtaaaacattttagaaattcatttacctttcctaatcgacttggtttcatcttatttcaatctattatagtattggggaatttcttcaaaccacatcagcttggtcagttctacctgcgacctcaaaacttgtgctttggtcaagctgggtttagtttcctagtttgctgatggatttccattgactataagcatccaaccctctttttgtcttctaaagaattcttaaattatcagtctattgcaacttttctcatataagttctttgtcttgctattggttttccttagtagtatactaaggtagtaatcattaagaagtggttacaaaaaataatgaatgaggtaaagaaaatggtagaattgaaaaaagaagcagtaaaagacgtaacatcattgacaaaagcagcgccgg

SEQ ID NO: 93 - DNA, 10690 bp; double-stranded, linear
tgaaaaaatcctcatgaacctggcgccaatagacaagtgtcttgtttccctcaccttccttataggcatggtcagctgacactcgattgaagggtttaacagaaacctttgtaatttcgacaatgcagacagcctgattttgactatctaaaatgacatcgaaggtccctacttggggaagtggttcgtcttctagcacatagaggtcataggctgatgctgttgctgtcttttctcctttaaacaccaaatccgctaaaaggtctggttcaactccaaaagcccaggcatcgatttcatctccgatcaaaggattgatttgcttgtatttattccacatttcttgcggtatcatgggtgctcctttgtaattttttactttcttcttttatgtgtttaagatgatctggatggtcaatctctaaatcaaaaatctctggaatagaactgtagtggataatgcacttgatacccaactgattcattttttgtatgaaagaagtattcagatagcctgctacagcaaaatcaatcttgttctttcttgctttatcctgcatatctcttagcatatctaacattattggactttccatatcatgccattgactgtttctcatagtcgcaaaaacaaaggaagtcaaatcattcattccaactacaatctttgaaatgcccgtttccagtatactagataagtcaaaatacgctgacggtaattcaatcatcgttccgactttcccagtaaaaccctgctgacgcaatactgtaatagcttgttttaattggtcggcatcattgacaaaaggaaagataacagatagattggggttggtttgataaacttctgtaacgacatgtgcttcagcctgaaattcatccaaacacgccagtaaacgcctagttcctctatagccaaacaagggatgcccttcgtcaaaaaactctttagtccccactaaacaattggcttctgtattcgttaattcagtaaaacgataccaaacttccttacctaagtaaaaggagcaaatagtatcaagataatctttcacaaattcctgacaactttgtaatagtatattttgattgagctctctcaataagtattccccacgaatcatgccgacgtggtgaaatagttgaggataaattttttcaagaattttttcgccactaagggcaagttgatttctcatcattcaccttccaattcatgtaagaagtcttgtccagttctggaaatcctaataattcagacttaaccttcaagactaatggcgatgcattttcttctgtaatctcttgaatatccatccaaatatatccaagtgaatcattcgcaccatcagacacagcttccgaaatcgtaacttgaggtgcactctcattcatttcaacatcatacaaggctatgacatggtgaaccataaaattttttaactcttccctgacgaaaacatcgtagattcgaggattagagtagcttctaacagtaaatcccgtctcttccataacttctctagtcagcgtttccgtcagtccttcaccaagttgctgactgcctccaggtagatcataccgatgttgataagggcctctcgttttttcaatgcaaagtaactttccattttcaaagcaaacacagtagaccccaaagtgatttttgatttccatccaactcctcctacttcaaagaccagccaccatctattgtcaagatttgtccttgcatggcgctcgcttttccacttgctaaaaaaagactaagctctgctatttcctctggctcaatccagcgcttgattggggtttcactagccacccagtcagccaaaccacctggttcaaaatccgcagcggtcatagctgtcttgactgctcctggagcgataccaaagacctgaatcccagcttcagcatagtctagagccaactgcttggtgaagccagccaaggcatgcttggatgaagtataggcgtgaccacctccacctgctaggctagaagcaatggaacacatattgatgatgattccctttttattttccagcatttgtgtcaaataataccgagtcaactctactggaataatgtagttgatttcaaaaatctcttgaatgtcctgcgccgtttgttccaacagtggtttgtaatcatccaaaactccagcagtattacacaaaacatccacctgagggcaccagtcaaaaataggttccaagtccaaggtcaaatctctctgtaaaaagcgaaaatcaccctctaagagtggcttttcaccttggtcaactccataaacttgatagcccttctctaaaaagaggcgagcttgagccaatccgatccctgaactcactcctgtaatgagtacacgtttagtcatgcacttctacccaatccgttgccaaaacatcacaaactgtcgggctccacatggaaaaaccttctccttcgccagaaacgttgattaggaaataaggtgtcatttcaagtgcaagcccattttgctcgatggtatcaaagagttggacatagttttccgcacctccccaaccagttcgtacatattttctcttagcctttaacccaggcaggatctcttcaaatgtcatgtttttctcctttaattctacattcttcatttaattatagcaaaaaaccgctttatacggctttttgaatgtgagttattcaaacctgctactacttacggcaaattattccctgcagcaagataaatttcataccattcttttcttgttaagctaaagtttgccgctcggctaacttctctcaagtgcttaggatttgttgtacctacgactgcctgcatttttgctggataacgcaatatccaagaaatggcaatagttgaagaggttactccatatttaatagctaaacgatcaagtacttgatttaaagcttgaaatttctcatttccaacaaaattccctttaaaatacccgaattgtaagacagaccatgcttgaatgaccacatcgtgtaattggcaatattcaaaaatgctgccatctcgcatagctgcttgactatcttccatattaacatgaaaagctgattcaaatcctggagtaaaagccgcactcaattgtagctgattaacagctaacggctgcttgacatcttttttaagcaactccatcatcataggattttgattagaaactccaaaatctcgaactttaccttgtttataaaggagattaaaggcttctgctacttggtcagattccatcaaagcatctggtcgatgaaggagcaagctatctagatgatcaatcttcaatctttgcaaaataccgtctactgattttataatatagtccttagaaaaatcaaaataggtaaattcttcaatgcgaatgccacatttggactgaatccacatcttttctcttaaatctggacgattttttaggacaagacctaacagttcttcacaacgaccacgaccataaatatcagccaagtcgaaggcattgattccaacagaaagtgctgtttctacaagctcttcaacttcttttacagatttatcttttattctcatcattccgagaacaatttctgataattctttgtcatcttgaccaagagttatgtatctcatcaaatttttctcctttaatttctaacattcttcccttcattataacaaaaaaccgctttgcaacgactttttgactatacttcactccattttatcttcttaaacccacggaacaagacaaagattccaataaagaggacagctaaaggaataacttttgtaaggaaaacatttgaaattcccatccactcataataacggagcagagaacccaccacaagatgggcaataatcatactgacaaatggacgaaagaccgcttctttccaattccaaataccgataactagcgaaatcgtaaagacagacaaactatcccagggagccggaatataaaaggctccttcttgtatgaagcttgccattcctacatatcctaaaacaactagaagaactatagtcccaacaacaatgtaagtgccaattttcattttaggagaatcttggactaaacttcttcgtaaaattgtggccacaagtccaaatccaatcagaaaaataagaagttgccctaaaaatgtgagcaaattgactgttaagagaggacctttagaaaaatcacttagtagttgataataacgtaataccgccaggacaagaattggcgtcaaaagggactctttgatagaactgcgaggtgctcccttgagaatctctttcattatttttttaggattcttacctagataatcctctgcactcatgccatctcgttctgcttctgagaaatctagcatcatcaaatagatctgctctctgagatagtcttcatcatagagaaatccagcaagattaaaactttcccacaactcctcaaaatacttttgattctcctcagaaaactcatgtagcaaagcgcttgtttcttcgtaatacttcattttcttcatggtttaacccccattcttaatcccttctactttttgactcaaatcgtcccattgttgccaaaagactgagacacgctcttctccttctttcattaatgaaaaatacttccgatctggaccatctggcgacgggcgcatgtcgcctcttatccattgatttttttctaacttttgcaacaaaggataaatagttcctggaacgatagtatcaaatccagcctctcgcaaagtctgaaccaactcataaccataccgctctttttgaccaatcatatccaagacacaaccttcaagaacaccttttaatagctgagtttctttcatcacttctcccttctaatctattttgtaatacctactagtgacttcacctatagtatatcacttctacactagtttgtaaagcataatagttaatactcttcgaaaatctcttcaaaccacgtcagcgtcgccctaccgtatgtatggttactgacttcgtcagtttcatctacaacctcaaaaacatgttttgagctgacttcgtcagtttcatctacaacctcaaaacagtgttttgagctgacttcgtcagtttcatctacaacctcaaaacagtgttttgagctgacttcgtcagtttcatctacaacctcaaaaacatgttttgagctgacttcgtcagtttcgtctacaacctcaaaacagtgttttgagcaacctgcggctagcttcctagtttgctctttgattttcattgagtataaataaaaaaacagaactagcctgaactagtcctgtctacttttacccaatcacacttccatttggtacagctggatcaactgtgagaagggttaatttgccatcatgttcagctgagagaatcataccctggctgacatattttttcatcattttacgtggtttgaggttagcaacgatttgaactttcttgccgaccaattcttgttcatttggatagtattttgcaattcctgaaagaatctgacgatcttctccatcaccagcatccaagcggaattgaagcaacttatctgaaccttctactttagacacttctttgacttctgcgacacggatttcaaccttgtcaaagtcttcaaacttgatttcatccttgtttagtttgagctcaacttcgtccggattccattctttttcgactgctggtttattgccttccatttgttccttgatataggcgatttcttcttccatatttagacgtggaaagataggtgttcctttggcaactacagtcacatctgctgggaagtcagccaaactcaagttttcaagactagaaacttcttccaaaccaagttgagtcaaaactgcacgactagtttccatcataaatggttcaatcaagtgagcaactacacgaatgctggctgccaagtggctcatgacacttgccaattggtcacgaagagcttcatccttggccaagacccatggtgcggtctcatcgatgtatttattggtacgagagatcagagtccagactgcttcaagcgcacgtggatagtcaactgcttccatgtgtgtatggaagtctgcgattgattgtwctgcaacctcagcaagaacatgatcatattcagtcacaccttctacataggcagggatttgtccatcaaagtacttattaatcatggaaaccgtacggttaaggaggttcccaaggtcattagccaattcatagttgatacggccgacatagtcttcaggagtaaaggttccgtctgaaccaactggaaggttacgcatgaggtagtaacgaagtggatctagtccataacgctctaccaacatttcagggtaaacgacattcccttttgacttagacatttttccgtctttcatgacaaaccaaccatgggcaatcaaacgatcaggtaatttaacatccaacatcataagaaggattggccagtagatagagtggaagcgaaggatatcttttcctaccatatggaagactgttccattccagaacttgtcaaagttaccatgttcgtcttgagcgtagccaagagctgtcgcatagttaagaagggcatcaatccaaacgtagacaacgtgttttggatttgatgggacaggcactccccatgtaaaggttgtacgagataccgccaaatcttccaagcctggctcgatgaagttgcgtagcatttcattaaggcgaccatctggcgtgataaattcaggatgagctttgaaaaattcgaccaaacggtcttggtatttgctaaggcgaaggaagtatgattcttcagaaacccattcaacctcatgacctgatggagcaataccaccagtcacatttccagcttcatcacggaaaacttctgccagctggctttctgtaaagaattcttcgtctgatactgaataccaaccagagtattcacccaagtagatatcatcttgagcaagtaagcgttcaaagacttgtgcgacaactttttcatggtagtcatcagttgtacggataaatttatcgtatgagatatctagtaattgccagagttctttaactccaaccgccattccatcaacataggcttgaggtgtaataccagcttcttccgctttctgctggattttctgaccatgttcatcaagacctgtcagataaaatacatcgtagcccatcaggcgtttgtaacgtgctaggacatcacatgcgatagttgtgtaggcagaaccgatatgaagtttcccagatggatagtaaatcggcgttgtaatataaaaatttttttcagacataatttttcctttccaggcaaatgaaacctgtttttctaacacttcattatatcacatttttaatgaatttcaatagggaaatccatacaaaaacaagatagacgagtgtccatcttgttgatctcattcataacgaagggcttcaattggatcaagtttcgatgccttgttggctggcaagactccaaaaatcataccaacactagccgaaactgcaagactaaatagggcgactgggattgatactccaacttctataccttctattaaaccttgcagtaacaaacctgctaaggcagttaaaccacttgcaattgtcaagccaattaagccacctaacaaggtcaaaatcatggattcaatcaaaaactgaattaaaatattggcacgtgttgcacccaaagccttacgaagaccaatctcacgagtgcgctctgtcaccgaaaccagcatgatgttcatgacaccagttcctccaacaaagagagaaatccctgcgatggaactaataatcgtcgtcataaaactaaacgattgttgaatttctgcaaatacaacggactcatctgccacctggtattctccctgttgtaagcctgcaagctctgtcatttttcgtgccagttctggacccagagttggggttaaactggtatcattcactcgaaagacaatattagctatttcatctacattaaaattcgcagcaagggagatattggtagtaataggcaagccaccaaacccatatatttttgatcttttagcctccggactagtataaaccccaatgacccggtaactaaatccattgacttctacaaccttgttaatagcctcttgaggagattcaaataaactaatggacaattcctcatctagcaaaatgacacttgcaaactctttgaaatcttgctctctcagactacgacctgcaataatttcattcttaacagcgtccatgtaagttctgtttccacctgtcaaattagcattctcaacctttttatcttgataggtcaagatggcattcgttgaattggttacatagtaactatccactcccttcagtttagctgcctcttggacccaggattcttgcggttttggcggttcaacaggaacttcctcttcctttccagaaaccgtaaaagctgattgtttctgagtaaaagacccgtctttactttttttaggagagaaaaagacgctaatatttttctgagatttagtcatatctttattgacttgacgagatagggaatcacccaaagccataatcacaacaactgatgaaacaccgataataatcccaatcatagtaagcaaagaacgcatcttgtgagccatgatagatgaaaaggcaaatttcagattctgcatcttagttttcctcctttcctaactgagcactgtcagacgaaatgaccccatcccgaatgacaatctgacgtttggcataggcagcaatctcaggctcatgcgttaccatgataatggtttttccttctttattcaaatcaaccaataattgcataatttggttacctgttttggtatccaaggctcctgtcggttcatccgctaggataatagaaggattgtttaccaaggcacgcgcaatggctacacgttgcttttgaccaccagataattctgaaggtaaatggtgactacgttctgtcaattcaaccttgtctaaatattcctcagccaacttgcgacgttttgaagacgaaactcctgcgtaaatcaagggcaattctacattttgcagagcattgagcttcgatagaagaaagaactgctgaaagacaaaaccgatttgttggttacggaccttagctagttgtttttcaccaagcccagccacttcttgaccttcaagataatattctccactggttggtgtatccaacatgccaatcgtattcatcagagtggacttaccagacccagatggtcccatgatggctacaaattcaccctcattcacttctagattgatatttttgagaacctgcagttcttggtcaccattacggtaacttctgaagatattttttagactaattagttgcttcatcagccttcacctcttttccttcttccaaggaagatgttggattactgatgaccttagcaccgttcgttaaaccagaagtgatttcttgattttctgcgtcagcatttcccaatgaaacctcaacttttttagccttttgttgttcatccacaatccagacataatttttactatcatccattactagactgctaacaggaacaagaatagccttagttttgcttttaacctcaatgttgacagaaaaaccttgtttcaaatcaccaacctcgcctgtcacatcaatagtataagggtatttagaacctgtattattcccggctgctggactagctgcttcaccattgtttttaggatagtcagaaatatagcttaatttcccagtccattttttatcaggatacactttagaagtaaagcttacttcttgacctacagaaaggttggctagattgtactcagacaattctcccttgacttgtaaattttcattgctgacaatatgaaccataacttgactcgcccctgttggagatttagaaacattgctattgacttcgaccacagttccctctagggtactgagaacagttgttgcatccaattgactttgagccttgcttaattgcgccgcagcatctgcacgcgcatcacgggcatcacccaattgagcgtcaatagaagcaacagaatttccagccactggagttgggctttgcaccgttgcatcttctcctcctactggcgctggtaactgtggagccggagctgaagcggcttcatttcgtgcttgattgagttcattgatatgacgatctgccctagctactgctcgactagctgaatcataggccgcctgcgcttctgaactactgtacttgactaaagcctgcccttcgctgaccttatcgcccacagaaacaaggatttcatctaaatcacccttactagcatcaaaataaacatattgttcattttttgctgttactgtccctgacaataaaacagaggaggccacgcttccttccttggcaacaacaagatgagtaggctcatcttttagagcagtctgagaaggttgtctaaagagtaaaatccccccagcacccaatacaactacactcgcagcaccgattgctgcatacagttgccactttttagctttaccattctttttcttcataatgaaactccttttcttttttacaatactttgctattataccaaatttccctccagcaaacaatacagttcaggattaaacaatcgttcggaattttgcttttcgg

SEQ ID NO: 94 - DNA, 8195 bp; double-stranded, linear
gagaaagcgcccacgtttccccgaagggagaaaggcggacaggtatccggtaagcggccagggtcggaacaggagagcgcaacgagggagcttcccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgacatgattacgaattcgagctcggtacccggaaaatccagaaaatgcttgaaaaaaatcctagaagatggtataatactaaattgtaagggttatcacatataactcaaaaaaagaaagaacaaaaggagagtcaaactatggcttctaaagatttccacgtagtggcagaaacaggtattcacgcacgtccagcaacattgttggtacaaactgctagcaaatttgcttcagatatcactcttgagtacaaaggtaaatcagttaaccttaaatcaattatgggtgttatgagtcttggtgttggccaaggtgctgacgtaactatctcagctgaaggtgcagatgcagatgacgctatcgctgcaatctcagaaacaatggaaaaagaaggattggcataagggaaatgacagaaatgcttaaaggaatcgcagcatctgacggtgttgcagttgcaaaagcatatctactcgttcagccggatttgtcatttgagactattacagtcgaagatacaaacgcagaagaagctcgccttgatgccgctctacaggcatcacaagacgagctttctgttattcgcgagaaagcagtaggtacgctcggtgaagaagcagctcaagtttttgatgctcacttaatggttcttgctgacccagaaatgatcagccaaatcaaggaaactatccgtgcgaagaaagtgaatgcagaagcaggtctgaaagaagttacagatatgtttatcactatctttgaaggcatggaagacaacccatacatgcaagaacgcgcagcggatwtccgcgacgtgacaaaacgtgtattggcaaaccttcttggtaaaaaattgccaaacccagcttctatcaatgaagaagtgattgtgattgcgcatgacttgactccttcagatacagctcaattggacaaaaactttgtaaaagcttttgtaaccaacattggtggacgtacaagccactcagctatcatggcacgtacacttgaaattgctgctgtattaggtacaaataacatcactgaaatcgttaaagacggtgacatccttgctgttaacgggatcactggagaagtgattatcaacccaacagatgaacaagcggcagaatttaaagcagctggtgaagcctatgcgaaacaaaaagctgaatgggcacttttgaaagatgctcaaacagtgactgctgacggtaaacacttcgagttggctgctaatatcggtactccaaaagacgttgaaggtgttaacaacaacggtgcagaagctgttggactttaccgtacagagttcttgtacatggattctcaagacttcccaactgaagatgagcagtatgaagcatacaaggctgttcttgaaggaatgaacggtaaacctgttgtcgttcgtacaatggatatcggtggagataaggaacttccttacttcgatatgcctcacgaaatgaacccattccttggattccgtgctcttcgtatctctatctctgagactggagatgctatgttccgcacacaaatccgtgctcttcttcgtgcgtctgttcacggtcaattgcgtatcatgttcccaatggttgcgctcttgaaagaattccgtgcagcgaaagcagtctttgatgaagaaaaagcaaaccttcttgctgaaggtgttgcagttgcggataacatccaagttggtatcatgatcgagattcctgcagcggctatgcttgcagaccaatttgctaaagaagttgacttcttctcaattggtacaaacgacttgatccaatatacaatggcagcagaccgtatgaacgaacaagtttcatacctttaccaaccatacaacccatcaatcctacgcttgattaacaatgtgatcaaagcagctcacgctgaaggtaaatgggctggtatgtgtggtgagatggctggtgaccaacaagctgttccacttcttgtcggaatgggcttggatgagttctctatgtcagcaacatctgtacttcgtacacgcagcttgatgaagaaactcgacacagctaagatggaagagtacgcaaaccgtgcccttacagaatgctcaacaatggaagaagttcttgaacttcaaaaagaatacgttaattttgattaatcgaaaagtccctgcaactcagttacagggatttttttgatattttaaaaagaattttcaagaaaatctttcttatagaaagtccaaccttgaaaaagtagtggtcagaacaaaaaatacttaaatggttcataaaattcttgacaagttggatatttaggagtaaactattaaccagttaagtaatagagaggagtttctgcaatttagaaatgaattgcaactagaaatatcaaatagaaagagagtttcgatgaaaattaataagaaataccttgttggttctgcggcactttgattttaagtgtttgttcttacgagttgggactgtatcaagctagaacggttaaggaaaataatcgtgtttcctatatagatggaaaacaagcgacgcaaaaaacggagaatttgactcctgatgaggttagcaagcgtgaaggaatcaatgctgagcaaatcgtcatcaagataacagaccaaggctatgtcacttcacatggcgaccactatcattattacaatggtaaggttccttatgacgctatcatcagtgaagaattactcatgaaagatccaaactataagctaaaagatgaggatattgttaatgaggtcaagggtggatatgttatcaaggtagatggaaaatactatgtttaccttaaggatgctgcccacgcggataacgtccgtacaaaagaggaaatcaatcgacaaaaacaagagcatagtcaacatcgtgaaggtggaactccaagaaacgatggtgctgttgccttggcacgttcgcaaggacgctatactacagatgatggttatatctttaatgcttctgatatcatagaggatactggtgatgcttatatcgttcctcatggagatcattaccattacattcctaagaatgagttatcagctagcgagttggctgctgcagaagccttcctatctggtcgaggaaatctgtcaaattcaagaacctatcgccgacaaaatagcgataacacttcaagaacaaactgggtaccttctgtaagcaatccaggaactacaaatactaacacaagcaacaacagcaacactaacagtcaagcaagtcaaagtaatgacattgatagtctcttgaaacagctctacaaactgcctttgagtcaacgacatgtagaatctgatggccttgtctttgatccagcacaaatcacaagtcgaacagctagaggtgttgcagtgccacacggagatcattaccacttcatcccttactctcaaatgtctgaattggaagaacgaatcgctcgtattattccccttcgttatcgttcaaaccattgggtaccagattcaaggccagaacaaccaagtccacaaccgactccggaacctagtccaggcccgcaacctgcaccaaatcttaaaatagactcaaattcttctttggttagtcagctggtacgaaaagttggggaaggatatgtattcgaagaaaagggcatctctcgttatgtctttgcgaaagatttaccatctgaaactgttaaaaatcttgaaagcaagttatcaaaacaagagagtgtttcacacactttaactgctaaaaaagaaaatgttgctcctcgtgaccaagaattttatgataaagcatataatctgttaactgaggctcataaagccttgtttgaaaataagggtcgtaattctgatttccaagccttagacaaattattagaacgcttgaatgatgaatcgactaataaagaaaaattggtagatgatttattggcattcctagcaccaattacccatccagagcgacttggcaaaccaaattctcaaattgagtatactgaagacgaagttcgtattgctcaattagctgataagtatacaacgtcagatggttacatttttgatgaacatgatataatcagtgatgaaggagatgcatatgtaacgcctcatatgggccatagtcactggattggaaaagatagcctttctgataaggaaaaagttgcagctcaagcctatactaaagaaaaaggtatcctacctccatctccagacgcagatgttaaagcaaatccaactggagatagtgcagcagctatttacaatcgtgtgaaaggggaaaaacgaattccactcgttcgacttccatatatggttgagcatacagttgaggttaaaaacggtaatttgattattcctcataaggatcattaccataatattaaatttgcttggtttgatgatcacacatacaaagctccaaatggctataccttggaagatttgtttgcgacgattaagtactacgtagaacaccctgacgaacgtccacattctaatgatggatggggcaatgccagtgagcatgtgttaggcaagaaagaccacagtgaagatccaaataagaacttcaaagcggatgaagagccagtagaggaaacacctgctgagccagaagtccctcaagtagagactgaaaaagtagaagcccaactcaaagaagcagaagttttgcttgcgaaagtaacggattctagtctgaaagccaatgcaacagaaactctagctggtttacgaaataatttgactcttcaaattatggataacaatagtatcatggcagaagcagaaaaattacttgcgttgttaaaaggaagtaatccttcatctgtaagtaaggaaaaaataaactaatgaaaaatgaaagtctcgataaagaggctttcatttttattatgtatatatgtaaaattcttgacaagcaatattaaaaagagtaaactattaactagttaattaaccggtttattactttatagtgaatcaaatatacttaagaaaagaggaaagaatgaaaattaataaaaaatatctagcaggttcagtggcagtccttgccctaagtgtttgttcctatgaacttggtcgtcaccaagctggtcaggttaagaaagagtctaatcgagttkcttatatagatggtgatcaggctggtcaaaaggcagaaaacttgacaccagatgaagtcagtaagagggaggggatcaacgccgaacaaatcgtcatcaagattacggatcaaggttatgtgacctctcatggagaccattatcattactataatggcaaggtcccttatgatgccatcatcagtgaagagctcctcatgaaagatccgaattatcagttgaaggattcagacattgtcaatgaaatcaagggtggttatgttatcaaggtagatggaaaatactatgtttaccttaaggatgcagctcatgcggataatattcggacaaaagaagagattaaacgtcagaagcaggaacacagtcataatcacgggggtggttctaacgatcaagcagtagttgcagccagagcccaaggacgctatacaacggatgatggttatatcttcaatgcatctgatatcattgaggacacgggtgatgcttatatcgttcctcacggcgaccattaccattacattcctaagaatgagttatcagctagcgagttagctgctgcagaagcctattggaatgggaagcagggatctcgtccttcttcaagttctagttataatgcaaatccagctcaaccaagattgtcagagaaccacaatctgactgtcactccaacttatcatcaaaatcaaggggaaaacatttcaagccttttacgtgaattgtatgctaaacccttatcagaacgccatgtggaatctgatggccttattttcgacccagcgcaaatcacaagtcgaaccgccagaggtgtagctgtccctcatggtaaccattaccactttatcccttatgaacaaatgtctgaattggaaaaacgaattgctcgtattattccccttcgttatcgttcaaaccattgggtaccagattcaagaccagaacaaccaagtccacaatcgactccggaacctagtccaagtccgcaacctgcaccaaatcctcaaccagctccaagcaatccaattgatgagaaattggtcaaagaagctgttcgaaaagtaggcgatggttatgtctttgaggagaatggagtttctcgttatatcccagccaaggatctttcagcagaaacagcagcaggcattgatagcaaactggccaagcaggaaagtttatctcataagctaggagctaagaaaactgacctcccatctagtgatcgagaattttacaataaggcttatgacttactagcaagaattcaccaagatttacttgataataaaggtcgacaagttgattttgaggctttggataacctgttggaacgactcaaggatgtcycaagtgataaagtcaagttagtggatgatattcttgccttcttagctccgattcgtcatccagaacgtttaggaaaaccaaatgcgcaaattacctacactgatgatgagattcaagtagccaagttggcaggcaagtacacaacagaagacggttatatctttgatcctcgtgatataaccagtgatgagggggatgcctatgtaactccacatatgacccatagccactggattaaaaaagatagtttgtctgaagctgagagagcggcagcccaggcttatgctaaagagaaaggtttgacccctccttcgacagaccatcaggattcaggaaatactgaggcaaaaggagcagaagctatctacaaccgcgtgaaagcagctaagaaggtgccacttgatcgtatgccttacaatcttcaatatactgtagaagtcaaaaacggtagtttaatcatacctcattatgaccattaccataacatcaaatttgagtggtttgacgaaggcctttatgaggcacctaaggggtatactcttgaggatcttttggcgactgtcaagtactatgtcgaacatccaaacgaacgtccgcattcagataatggttttggtaacgctagcgaccatgttcgtaaaaataaggtagaccaagacagtaaacctgatgaagataaggaacatgatgaagtaagtgagccaactcaccctgaatctgatgaaaaagagaatcacgctggtttaaatccttcagcagataatctttataaaccaagcactgatacggaagagacagaggaagaagctgaagataccacagatgaggctgaaattcctcaagtagagaattctgttattaacgctaagatagcagatgcggaggccttgctagaaaaagtaacagatcctagtattagacaaaatgctatggagacattgactggtctaaaaagtagtcttcttctcggaacgaaagataataacactatttcagcagaagtagatagtctcttggctttgttaaaagaaagtcaaccggctcctatacagtagtaaaatgaatggagcatattttatggagaagtaacctttcgtgttacttctcttttttagaaaaacgtaacaga

SEQ ID NO: 95 - DNA, 2004 bp; double-stranded, linear
tttactaaaaggaaaaaagaactgatttctcagtccttcattaatcttattccacactaaataggtatgggtaaacaggttgttgaccttggtgaatctcgacttcaacgtcttcgaattcttctacgatttcttgagcgatttcattggcaagttcttcgcttccgtcttcacctacatagaaggttacgatttcactgtcttcatccaacatatgtttcaaggtttcagtcaatgtttggtgcatatcagggtttgacacaagaatttttccatccaccatacctaaattatcgttttcatggatttctaagccatcgatcgttgtatcacgcacggctgttgtgacgcttccgctaacgacatcgctaagagcagctgtcatacgctcttggttttcttcaatggacttgcttggatcaaaggcaagaagacttgtcataccttgaggaagagtgcgagcctctaccactaccgctggttgctccaaaacttctgccgcagattgagctgccatgaagatgttcttgttgtttggcaagaagatgatgttacgggcattaacctgttcaacagccttgataaagtcttctgttgaagggttcatggtttgaccgccttcgataacataatccacgccttgagaacagaagatatctgctagacctttaccagccaccacagcaatcaaagcatactctttttcttcagccgacttgataacttgagtagcttctttctcaacctgtgcttcgtgttggttacgcatattgtcaacttttaccttgaccaagctaccatatttgagaccttcttgcataacaagtcctggatcttctgtatgaacatggactttgacaatttcatcatcgttaacaacaaggagagaatctccaagctcatccaagtagttacggaattcatcgtagtcaaaatctttagcataggttggaccttgcttaagagctaccatgatttcagtacagtaaccaaacgtgatgtcctcagtcgctacgtgaccagctacagacttatgatgctctacattgatcatctcactcatgttggcaggagtcgctacaaagtcctcagatgcaatatattcgccagtaagggctgaaaggaaaccttcgtagatgaagaccaatccttgaccacctgagtccacaacgccaacttctttcaatactggaagcatgtctggtgttttagctagagctgttttagcaccttccaaggctgcgcgcatgacttcaacagcgtcatctgtttgctcagcttttttcttagcaccgatagcagctccacgagaaactgttaaaatcgttccttcaacaggtttcatcactgccttataggcaacttccacacctgattggaaggccagagccaagtcttgacctgttaactcgtctttatccttgatagcttgggaaaatccacggaaaagctgagacgtaatcactcctgagttcccacgcgcacccatcaaaagccctttggcaagaatgctcgctacttctccaactgtagaagctggcttgtctgcaacttctttagcaccattttcaatggtcattcccatatttgtcccagtatctccatctggaactggaaagacgtttaatgaattgacatattcagcttgcttattcaagcgagttgatgcagcctgcaccatttcttgaaataagctagtagtaatttttgacacggttattctcctacaactttgatattttgaatgtagacatttacagtctgagcagtaattccaagctggttttccaagctaaaggcaacacgctcttgaatgttttttgacacttcactaatctttgttccgtagcttaacacggtatatacatcaactgcaatactgccatcttcggctgcctttacgacgacacctttagaataattttccttacctagcagggcttggaaattatctttgagggcatttttactagccataccgaccacaccagaaatctcagttgc

SEQ ID NO: 96 - DNA, 11915 bp; double-stranded, linear
ccgggttgggctgttcgcccattaaagcggcaccacagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataaacgctgaaagcatctaagtgtgaaacccacctcaagatgagatttcccatgattatatatcagtaagagccctgagagatgatcaggtagataggttagaagtggaagtgtggcgacacatgtagcggactaatactaatagctcgaggacttatccaaagtaactgagaatatgaaagcgaacggttttcttaaattgaatagatattcaattttgagtaggtattactcagagttaagtgacgatagcctaggagatacacctgtacccatgccgaacacagaagttaagccctagaacgccggaagtagttgggggttgccccctgtgagatagggaagtcgcttagctctagggagtttagctcagctgggagagcatctgccttacaagcagagggtcagcggttcgatcccgttaactcccattttagcgggtgtagtttagtggtaaaactacagccttccaagctgttgtcgcgagttcgattctcgtcacccgctttgaactttgttctttgtaccaagtttttgacttgggcgcgtagctcaggtggttagagcgcacgcctgataagcgtgaggtcggtggttcgagtccactcgtgcccatagtgtttagtccattactaggggattggaatattatctgttcactaagaggacacgggcttgttcccgtataaactattttggaggattacccaagtccggctgaagggaacggtcttgaaaaccgtcaggcgtgtaaaagcgtgcgtgggttcgaatcccacatcctccttttatattaacgcgggatggagcagctcggtagctcgtcgggctcataacccgaaggtcgtaggttcaaatcctgctcccgcaataaggctcggtagctcagttggtagagcaatggattgaagctccatgtgtcggcggttcgattccgtctcgcgccatttatatattttggaagggtagcgaagaggctaaacgcggcggactgtaaatccgctccttcgggttcgggggttcgaatccctccccttccattttacgggcatagtttaaaggtagaactaaggtctccaaaaccttcagtgtgggttcaattcctactgcccgtgttaatagaattatggcgggtgtggtgaagtggttaacacaccagattgtggctctggcatgcgtgggttcgatccccatcactcgcctattttatattggggtatagccaagcggtaaggcaagggactttgactccctcatgcgttggttcgaatccagctaccccagttactatttgccggcgtggcggaattggcagacgcgctggactcaaaatccagtgtccgcaaggacgtgccggttcgaccccggccgccggtatagtatagtgttaggaacgttgttattcttcgttccttttttatattatttttggtataattatagttattcaaattttatttagattaagaaagtgtaggggagtatgtcttgttctatcgatttattaaaacatcggtatttgaaaaatattaaagaaaatcctgaattgtttgtcggaattgagttggagtatcctgttgcaagtttagaaggggatgctacagatgttgaagttatgaaggatctatttcattatttagtttctactttggatctcaccgtagcaaaggtagatgattttggcaatctgatccagttagtagatccgataagtcaggatgctattttatttgaagtttcctatacaacgattgagtttgcatttggtaaggctgaaacgattcaagaggtcgaaaatcgtttcaataattatatgaatgtaattcagagaaagttagctgaatcaaatcatgctattgttggctgtggtatccatcccaactgggataaaaatgagaattgtccagtggcttatccacgctatcagatgttgatggattatttgaatttgagtagaaatattattaaatcagatttacatcatttccctgaatatggtacttttatctgtgggagccaggttcagctggatatttcaaaaaccaactacttacgggtgattaatgcttttactcaaattgaagcggctaaggcttatttatttgcaaactctgaattttcgggtgcggattgggatacgaaaatttcaagggatattttctgggaagaatctatgcatggtatctatccagagaatgttggggtcaatgctagactccttaatgatgaaactgatttttttgactatctaaatcattctgcgatttttactgcggaacgtgatgggcagacctattatttttatcctattcaggctggggactatttggctacgtccgaaatccaagcatttgctctgaatggggatgaggttattatttacccccaagagaaggattttgaaactcatcgtagttaccagtaccaagatttaacgactcgaggaacagttgagtttcgtagtgtgtgtacacagccacttgataggacttttgcttctgcagcttttcacttgggattattggttaatttagacaagttagaagcttacttagaaacagcacctttctttaaagtatttggttatgattacaagtctttaaggagacaattttctaagaaaaatcttacagatgaggaagaaactacgattattgaattttccaaagacttactcctactagctgaggagggactagtggtgagaaataaggaagaaatgacctatttacagcctttgagagaagaattgagcctataatttctcttataaagggagaattttctgaaaaatcatgatataatggacgagactatagataaaggatagagagtaatgacattagtttatcaatcaacgcgtgatgccaacaatacagtaactgccagccaagcaattttgcaaggtttggcgacggacggcggtttgtttacaccggatacttatccaaaggtagatttgaactttgacaaattgaaagatgcttcttaccaggaagttgctaagctagttttgtcagcatttttagatgactttacagttgaggagttggactactgtatcaacaatgcctacgatagcaaatttgatactccagctattgcaccattagtgaaattagatgggcaatacaatttggaacttttccatggttcaacgattgcctttaaggatatggccttgtctattttgccatactttatgacgactgctgctaagaaacatggtttggagaacaagattgttatcttgacagcgacatctggtgacacggggaaagctgctatggcggggtttgcgaatgtgcctggtactgagattatcgtcttttatccaaaggatggtgtcagcaagattcaagagttacaaatgaccactcagactggcgacaatactcatgttattgctattgatggtaactttgacgatgcgcaaacaaatgtgaagcacatgtttaacgacgtggctcttcgtgaaaaattgactaccaacaagttgcaattttcatcagctaactctatgaacattggtcgtctggtgccacaaattgtttattatgtttatgcttacgctcaattggttaagactggtgaaattgtagctggtgaaaaggttaacttcacagtaccaacaggaaactttggaaatatcttggctgccttttatgccaaacaaattggtttgccagttggtaaattaatctgtgcttcaaatgacaacaatgttttgacagacttctttaaaacacgtgtctatgacaaaaaacgtgagtttaaggtaacaaccagcccatctatggatatcttggtatcttcaaacttggagcgcttgattttccatcttttgggaaataatgctgaaaagacaactgaacttatgaatgccttgaacacgcaaggacaatataagttgacagactttgatgcagagattttggacctctttgcagctgaatatgcgactgaggaagaaacggcagcagagatcaagcgtgtttgtgagttagattcttatatcgaggaccctcatacagctgttgcttcagcagtttataaaaaataccaatcggccactggagatgtaactaagacagtgattgcttcaacagctagtccatacaagttcccagtagttgcagtagaagctgtaactggaaaagcaggtttaacagactttgaagccttggctcaattacatgaaatctcaggcgttgcagtgccaccagcagttgatgggcttgaaatagctccaattcgtcacaagacaacagtggcagctgctgacatgcaagcagcggttgaggcttatttaggactttaagacagagggagcaaactcggttgggaaaccaactgagtttcttttcatcaggaggagagattgtttaagaaaaataaagacattcttaatattgcattgccagctatgggtgaaaactttttgcagatgctaatgggaatggtggacagttatttggttgctcatttaggattgatagctatttcaggggtttcagtagctggtaatattatcaccatttatcaggcgattttcatcgctctgggagctgctatttccagtgttatttcaaaaagcatagggcagaaagaccagtcgaagttggcctatcatgtgactgaggcgttgaagattaccttactattaagtttccttttaggatttttgtccatcttcgctgggaaagagatgataggacttttggggacggagagggatgtagctgagagtggtggactgtatctatctttggtaggcggatcgattgttctcttaggtttaatgactagtctaggagccttgattcgtgcaacgcataatccacgtctgcctctctatgttagttttttatccaatgccttgaatattcttttttcaagtctagctatttttgttctggatatggggatagctggtgttgcttgggggacaattgtgtctcgtttggttggtcttgtgattttgtggtcacaattaaaactgccttatgggaagccaacttttggtttagataaggaactgttgaccttggctttaccagcagctggagagcgacttatgatgagggctggagatgtagtgatcattgccttggtcgtttcttttgggacggaggcagttgctgggaatgcaatcggagaagtcttgacccagtttaactatatgcctgcctttggcgtcgctacggcaacggtcatgctgttggcccgagcagttggagaggatgattggaaaagagttgctagtttgagtaaacaaaccttttggctttctctgttcctcatgttgcccctgtcctttagtatatatgtcttgggtgtaccattaactcatctctatacgactgattctctagcggtggaggctagtgttctagtgacactgttttcactacttgggacccctatgacgacaggaacagtcatctatacggcagtctggcagggattaggaaatgcacgcctccctttttatgcgacaagtataggaatgtggtgtatccgcattgggacaggatatctgatggggattgtgcttggttggggcttgcctggtatttgggcagggtctctcttggataatggttttcgctggttatttctacgctatcgttaccagcgctatatgagcttgaaaggataggaaatgcaaaaaacagcttttatttgggatttagacgggactttattggactcttacgaagcgattttatcagggattgaggagacttttgctcagttttctattccttatgataaggagaaggtgagagagtttatcttcaagtattcggtgcaagatttgcttgtgcgggtggcagaagatagaaatctggatgttgaggtgctaaatcaggtgcgtgcccagagtctggctgagaagaatgctcaggtagttttgatgccaggtgcgcgtgaggtgctagcttgggcagacgaatcaggaattcagcagtttatatatactcataaggggaacaacgcttttaccattctcaaggacttgggggtggaatcctattttacagagattttaaccagtcagagtggctttgtgcggaagccaagtccagaagcggctacctatctgctagataagtatcagttgaattctgataatacttattatataggggatcggactctggatgtggaatttgcccagaatagtgggattcaaagcatcaactttttagagtctacttatgaagggaatcacaggattcaagcgttagcagatatttcccgtatttttgagactaagtgataaaaagattgtgtcagttttgtgacagagacctaacaaactatttcaagtaacctagtttgttacaaggaatagacagttctgttaaataggcccgagagggctttttttctacattttttgtgttatgatagacaggtactcatttgaaaggaatttgaaagaatgaagaaaagaatgttattagcgtcaacagtagccttgtcatttgccccagtattggcaactcaagcagaagaagttctttggactgcacgtagtgttgagcaaatccaaaacgatttgactaaaacggacaacaaaacaagttataccgtacagtatggtgatactttgagcaccattgcagaagccttgggtgtagatgtcacagtgcttgcgaatctgaacaaaatcactaatatggacttgattttcccagaaactgttttgacaacgactgtcaatgaagcagaagaagtaacagaagttgaaatccaaacacctcaagcagactctagtgaagaagtgacaactgcgacagcagatttgaccactaatcaagtgaccgttgatgatcaaactgttcaggttgcagacctttctcaaccaattgcagaagttacaaagacagtgattgcttctgaagaagtggcaccatctacgggcacttctgtcccagaggagcaaacgaccgaaacaactcgcccagttgaagaagcaactcctcaggaaacgactccagctgagaagcaggaaacacaagcaagccctcaagctgcatcagcagtggaagtaactacaacaagttcagaagcaaaagaagtagcatcatcaaatggagctacagcagcagtttctacttatcaaccagaagagacgaaaataatttcaacaacttacgaggctccagctgcgcccgattatgctggacttgcagtagcaaaatctgaaaatgcaggtcttcaaccacaaacagctgcctttaaagaagaaattgctaacttgtttggcattacatcctttagtggttatcgtccaggagacagtggagatcacggaaaaggtttggctatcgactttatggtaccagaacgttcagaattaggggataagattgcggaatatgctattcaaaatatggccagccgtggcattagttacatcatctggaaacaacgtttctatgctccattcgatagcaaatatgggccagctaacacttggaacccaatgccagaccgtggtagtgtgacagaaaatcactatgatcacgttcacgtttcaatgaatggataaacccgacttgataacatcattttgacgaatgagatctagctttcgtgatggaaagcgattctcgttcgttttttctttgtcatactcttcgaaaatctcttcaaaccacgtcagttttatctgaaacttcaaagctgtgctttgagcaacctgcgactagcttcctagtttgctttttgattttcattgagtatcaatttgaatggaaaatggaaagttatcatcttgtaatgagttaagcaacattcttgcaatctattttactttatatcacaattaattagtcaaatattgataaatcaataaaaagagaggggaagaaatgctagagattcaagatttactgtatcaactccgcttgtctgagcaagcgagtacgcaattgtttgaaaaaaggcttgggattagtttgacacggtatcagattttactgtttttgctggagcattctccttgtaaccaaatggcggttcaggagcgtttgaaaattgatcaggctgctttgacacggcatttcaaaattttggaaacggaaggtttggtggagcgtcatcgtaatcctgaaaatcagcgggaagtgttggtagaggctgcgaagtatgccaaggagcagttagtggtgaatccccctctgcaacatatcagggttaaggaagagatagaaagtatcttaacagagtttgagagaacagaactcagccgtttattaaataaattggttttgggtattgaaaatatagaaatttaaggagaaatagatgtcaattattttaacaacgatcgttgctttggagcatttttacattttttatttggaaagtattgccacgcaatcagatgcgactagtcgtgtatttaatatggaaaaggaagaattggctcatccgtcagtaagttcattgttcaaaaatcaaggaatttataaggctctgctaggagtctttctcttgtatgtcatttatttctcacagaatttagaaattgtgactatttttgtcttatttgtgattggtgctgcgacttacggctctttaacagcggataaaaaaattattttgaaacaaggtggatcagctattttggccttgattagtattttactctttaaatacacttgaaggtcgattctaatctcgctaatcctttttaatccagaataagggaaatatgttatacttgtttttaagaaaaaagtctcattgaattggttttgaggagttagaaatgaaagtattagtgacaggttttgagccctttggaggggaaaagggcaatccagctttggaggccattaaaggtttaccagctgaaatccatggtgctgaggtccgttggctagaggtgccgacagtttttcacaaatctgctcaagtattggaagaagagatgaatcgttatcaacctgactttgtcctttgtattgggcaagctggtggaagaactagtttgacacctgaacgagtgaccattaatcaagacgatgcatgcatttctgataacgaagataatcaaccgattgaccgtcccattcgcccagatggtgcttcggcctactttagtagtttgccgattaaagcgatggttcaagctataaaaaaagagggcttaccggcctctgtttccaatacggcagggacttttgtctgcagccatttgatgtatcaggctctctatttggtagaaaagaaatctccatatgttaaggcaggttttatgcatattccttatatgatggaacaggtggtgaacagaccgactactccagctatgagtttagtggatattcggcgagggatagaagcagcaatcggcgctataatagaacatggagatcaggaactcaagttggtaggcggagaaactcattgatagaaaaaagcttgaggggaaaaaccttcaagcttttggacgttttcgggccaatactgctcggtaaaacataattttagtgcattggatataaggtaggagtgaaaaactagcaatgccaaaggtaatccaattgaggaagtaccaaggaagaagctgtaaatctaggacaaagtgctggaacttgtagcccttcataaaggaacggctagtttttaggattcgtcttggtgggacctgtcctaggtctagactataacagagaagaaattccacctgtgaataggcataatactgtggaatatagaggatatttcctacaatgatcaagatgagacttgcaagaaagtagagtccaaagaccatgaggaaacgctcggtttcaactgatgagagatctagatttggaaactcaggatgtagggtgacgaattttttggctaaaaagctactataaaagaggaggtaaatcccaagtaaattagggatactccataaaaagagatagaaacgtttgagaagtagggtcaaaaaggtttgagaaaagcgctcctcatcaaagagagctaggctgttttttacagatggctccgttttagaatctttcatgagtgtcagtgttgcatagacggaactggtcaaaagaatagtcccgataaaggagactagtagaggaaagaggtaggtttgaagtatttggccaagtatgctgaaaaatggctgttctaaaacagtcccgtggatccgagataagggattaagaaaaccagataagatgaccagcatactgggaaggatatagaggagaaagagacggggggtgtcagcctgaaaatgttttgactcctgacgaattgtttttaaatcaatttttggatagttcattctcttattataccatagttcttatacatagttcgtgacagttcctactttttttgataaaatcatacagtgtgtccttgggcacactgtatgaactgggactgtctttcccagcttcggaggtaaaaaatgtcagattcaccaatcaaatatcgtttgattaagaaagaaaaacacacaggagctcgtctgggagaaatcatcactccccacggtacctttccgacacctatgtttatgccagttgggacacaagccactgtcaaaactcagtcacctgaagaattgaaggagatgggttcgggaattatcctatcaaacacctatcatctctggcttcgccctggagatgaactcattgcacgcgctggtggtctccacaagttcatgaattgggaccagcctatcttgacagatagtggtggttttcaggtttattctttagcagatagccgtaatatcacagaagaaggagtaacctttaaaaatcatctaaatggttctaagatgttcctatccccagaaaaagccatctctattcagaataatctgggttcagacatcatgatgtcctttgatgaatgtcctcagttttatcaaccttatgactacgttaagaaatcgatcgagcgtaccagccgttgggctgagcgtggtttgaaggctcaccgtcgtccacatgaccaaggtttgtttggaattgtgcaaggtgcaggatttgaagaccttcgccgccaatcagctcatgatcttgtcagcatggatttctcaggctactctatcggtggtttggcagtgggagaaacccatgaagagatgaatgcggtcttggactttacaactcaactgctgcctgaaaataaacctcgttatctgatgggtgtgggagcgccagatagcttgatcgatggggtcattcgtggggtggatatgtttgactgtgtcttaccgactcgaattgctcgtaacgggacttgtatgaccagtcaaggacgtttggttgtgaaaaatgcccagtttgctgaggactttacgccactggatcctgagtgtgattgctacacatgtaataactatacacgcgcttaccttcgtcacctgctcaaggctgatgaaacctttggtatccgcttgactagctaccacaatctttacttcttgcttaacctgatgaagcaagtgcgacaagccatcatggatgacaatctcttggaattccgtgagtattttgtggaaaaatatggctataataagtcaggacgtaatttctaaaatggaattgatataaaaaaatcctaagttttctcttaggatttttcttctttttttgatagaataaagtgtacaatgaaaggaagaataaactcgtatgcgcattaaatggttttcctcgattagg

SEQ ID NO: 97 - DNA, 9069 bp; double-stranded, linear
gagagggcaacagttctatcgcttcaaattttttcttggtttgcagatattcaagaatcgggagtttttctatagtattcggcagatttattacagccaagcatctcaaaaatacggacagcatcctccatctttttctggccttccttgactctaccttgcttgctatcaaggagaccttctgcccacagataaacaattcggaaataggtctcattttccttgtagaaatgctcttcgataacacgtttaaaataataggcattggtaaattcttcacactcaatactagctaaaaagccattcaatagtatagtatgaaaaaggtttcgattgccagacatttccattagaaaatcagatttacgtaccatttctcgtacatatctagtaaaaagagaaacagataaaaatggagaactgactgaaaataaattgagttcatagattccccagatctcggtagaaaacaaataatcatgaaggacttttccttcctctgctgttaagtctaccctttcatctatgctcttcatataagacttgataataatggcatttagaatatgtttctgtttgttgtgagaatgggcatgcttttatactccctgcgatataagtcctcaagaggtgctatattctttggttccaagacatctgtaatttcttttctcaactcagaatctgtatcatactggaaacctcttgccagaaagaggatctcctccacactggcagatatattttccagagcaaatagaaacttttccaccgaaagctcactctgacctgtttcaaaacgggacaacatagacggcgaaaattgtcctccggttgcttgtctcagtgagatatttcttgactctcgtaattgtctaaagacttttccaatctgctccatagacttccccttgattccgtattttcttcattttatcatatttttcagaaaattcatcaaaaacttgccaaattgtcagaattatgagaaaatagaggatatttatcacgtggagggactgctatgagagacgatatcaaaatcaatgaccgtgctttggccttgcaagaccaaattatcgaaaaactagagaaagtttttgatacagatgtggaattggatgtttacaatctaggtctgatttatgaaatcaatctggatgaaacggggctctgcaagattgtcatgaccttcaccgatactgcctgtgattgcgccgaaagcctgcctattgaaatcgtggcaggtctgaaacaaatcgagggtatcaaagatatcaaggttgaagttacctggtcgcctgcttggaaaatcacacgaatcagtcgctatggccgtattgcccttggactaccacctcgttaagcagaccaatcacttttaaagatgaaaatcaaagggcaaactagaaaactagccgcaggttgctcaaaacactgttttgaagttatggatagaactgacgaagtcagctcaaaacactgttttgaggttgtggatagaactgacgaagtcagctcaaaacactgttttgaggttgtggatagaactgacgaagtcagcccaaaacactgttttgaggttgtggatagaactgacgaagtcagtaaccatacctacggcaaggcgacgttgacgtgatttgaagagattttcgagtatgagtttattttttacctgacttgtccatattccagaagtctgtcacggctccgcgtgaagcagatgatacgatgtgggcatatttaccgaggacaccacggctgtaaagtggtggcaaggttgtttctgccttgcgtttttcaagttcttcttcggatacggccatagaaatttctttggtatcttggtcaaccgtaacgatatcgccggtacggagataggcaattggtccaccatcctgagcttcaggagcgatatgtccaacaaccagaccataagtaccaccagagaaacgtccgtccgtcaagagggccaccttatctccctgacctttaccaacaatcattgaagaaagtgatagcatctcaggcataccaggaccacctttaggtccaacaaaacgaacaacgactacatcgccatcaacgatttcatctgtcagaacggcctgaatcgcatcttcttctgagtcaaagaccttagctggcccaacgtgacgacgcactttaacacctgataccttggcaactgcaccgtcaggagcaaggttcccgttcaagatgataagcggaccatccgcacgttttggattttcaagtggcatgataactttttggcctggagtcaagtctgcaaagtcagccaagttttcagctacagtcttaccagtacatgtgatgcgatctccgtgaaggaaaccatttgccaacaaatacttcataaccgcagggacaccaccgacttcgtagaggtcttggaagacatactgaccagatggtttcaagtcggccaagtgaggcacacgttcttgaatcgtattgaagtcctcaagtgacaagtcaacatttgcggcatgggcaatggcgagcaagtgaagagtggcgtttgtagaaccaccgagagccatcgttacagtgatagcatcttcaaaggcttcacgagtcaagatatctgatggtttgagaccaagttccaacatcttaacaacagcacgtcctgctgcttcgatatcttctttcttatcagctgattcagctgggtgagaggatgaccctggcaaactcatccctagaacttcgatagcagttgccatggtattagcagtatacataccaccacaaccaccagggccagggcaggcattacattcaagacgtttcacgtcctcagctgtcatgtcaccgtggttccattttccgataccttcaaagacagaaaccaagtcgatatctttaccatcaagatttcccggtgcaatagttccaccataggcgaaaatagctgggatatccatattagcaatagcaatcatagatccaggcatgttcttgtcacagccaccgatagcgacgaaggcatccacgttgtgaccactcatagccgcctcgatggagtccgcgatgatgtcacgagatgttagagagaaacgcataccaggcgttcccatagcgatcccgtccgctacggtaatggttccaaactgtacaggccaagcgcctgcagatttgacaccttctttagccagtttcccgaaatcatgcaagtgaatgttacatggtgtattttccgcccaagtcgaaatcactcccacaatcgatgtttcaaagtccttatctgtcataccagtcgcacgaagcatagcacggttaggtgatttaaccatgctgtcataaatgctactgcggtgacgtttatctaattcagtcatcttatccctcccatttcagtttttactattatagcacaattttcgcatgaagaacagaataaaattcttgaattttcagaaaattctatacacatgtgaaatatttaaaattaaaaacaacaaagcggattagtgcactttctgatgaccagaatatgctttttaatccgctttctttaaataacgtactgtaatttttacagaaattctttcaaataagtgtatttaacatctatcttgcattataaatttctagaaccttctcttttatattcgattcactcaaaccatactcattaagaagataatccattttccctacttgaccgaatctttcttgaacacccatccgatgaatttttgttattccatcatcagagaataattcacataaagcactgccaattccacctatctgattgtggttttctacagtaaatatagtttttccacttaacattgtttttatctgttctggtatcggtttgattctaaataaatctatcacacctactgaataacctaatttagacagttcatctgcaactcgaatacttggagcaaccattatgccagaagcaacgattacaagatcttcaccatgccttaactcaatgtagcctttagaaaaatcttctccaccttgatacacaggaactggagcttttctaattgttcgaatatattttagtccttttaagtctaatgtctggttcaatatttcacgaaattggatatcatcagttgcttcgaaaatgattgatttaggaattaaacgtaacaatccaatttcttcaaatggcatatgtgttccaccattcatctctgccgttactcctgcatctgatccaatcacagtggcatccaattgtgcgtatccaagagaaataaataattgatcaaatactcttcgtgaagcaaaaggaccaaatgtatgaagataaggtctaaacccctgaatagacaagcctgctgcaaggccgaccatttctgcttccataatcccaacattcacataacggtctccaaagtccttttcaagattattagtagccatcgaacttgacaaatcggcttctaagactactatatcagaatcactttgattagcctctaaaaggaagtctctatatacatgccgtaattctttcgtacttctcatcattctgtttcctccaattcctgacttaatctttctacaactgaagttaacatttgtttctcctctacagtagggcgaagatgatgattggatttcatttcttccagctcttgaaccccttgacctttaatagtatctaatacaatgcacttaggtgatgaattatttgactgttttaattggacaatcccttcataaatttctctaatatctgaacccttgaccctaatggattcaaatccaaatgctgaaaatttttctacgaaatcacctggattacaaatatcctttgtaaaaccatctaattgttttttgttatcatcaacaaatacaattaagttggataactgttgatgagaagcaaactgtatagcctcccaacattgtccctcatttaactcaccatctccaacaatagcgtaagtataaaagggactctttcttattctctgaccatatgcaagtccagttgcaacactaattccttgtcctaaagagcccgttgtcatatctatgcctggcgttagatttctatcaggatgagacggtaatttggttccatttgtatttaaagaatataagaattctttgtcaaagaaaccattcaaatagagtgtactgtatagagctggtcctccgtgaccttttgataatatgaaataatctctatctcgtgctgcaaatatttctggagtcattggcattatttcaccataaagcaccgctaaaacttctacgatagacagacttcctccgtaatgtccgaatccaagatgattcaatgttctaagagtatttaatcggatgttagtcgcaaattttcttaacccatcttctctatttttacttaaaatcatcccttattcctccgttgcagatggctttttaataaaggatactccaaacataactgctagaataagaacaagaccaatcacaatgcctgcttgtgagccaaattgatttaacattcctaaaataattcctgatagaccaaaatctgcatctgagaaagttgatccttggaaaccaagtcctcccaaaactggcattaaaaagactggaagaaaactgattaaaataccttgtaaaaatgctccaatagtggctccacgaacaccaccagatgcattcccaatgacacctgcagtcgctccacagaagaaatgaggcacaacacctggtaagataacaaccgttcctgaagcaatcataattaccatacttactaaaccaccaacaaaactagagataaatccaattagaactgcattgggtgcataagtataaacaatcggacaatccaaagcaggttttgaattaggtacaagacgctctgaaatacctttaaaggctggaacaatttcgcccaaaataaggcgaacacctgctaaaataacaaatacccctgctgcaaattgacctgctaattgtaaagcataaactagaccacttgtaccactactgatttctttttctatatattctgaccctgcaaagatagctacaataatgtaaataactgccatggataaagtaatactaacagtactatcacgtaaaaaagctaaactctttggaaatttaatgtcctctgttgattttgatttgtcaccgataaggctaccagtaaaaccactcaaccaatatcccaaagaactgaaatgacctaaagctaccttgtcatttccagttaattgaaccatatatttttgcacaaatgctggggaaatactcataataataccgagtgctaatcctcctagtaagatgagaggcaagctagtaaagccagcaactgataaaatgaccgcaatcatacatgccatatatagagtgtggtgccctgttaaaaaaatatatttaaatcgagtaaaacgagcgattaagatattgaacaccatgcctgcaaacataatcattgcagtagctgagccatatgttgttaaagctacagctacaattgcttcattattcggcacaacgccagataaatgaaaagcatgctcaaacatggtaccaaatggatttaaagaattttgtacaattcctgcaccaccagatacaactaagaaaccaacaaaggtcttaattccacctttaataatatcaggtaatttcttcttctgaagaactaatcctaagattgcaattaaagctactaaaatagctggtgtactaacaatatccaatatgaacttcatcatgacgctagcctcctatataagtcctttttcttcacaaagtttagtaattaattctcgtagttcatccatatcaataatactatttaagatacgaacatctccaagatgactagctgaatcagctagatcacgaccaacaatccaaatatcagctgcatttggatctgctccacctaaatcataatgttcaacttctacatccgaaacattcaaatcactcaatacagattcaatattcatctgtaccataaaacttgaacctaatcctgaaccacaagctgtaccaatttttaacattatctaatcctcctgtttaattatcattttaatgtcatcatagttttttgatgatattaaagtttgaacatgatttttatctcttaaaattgttgttaaatgtgacaaagcctttaaatgactctcattatcaatggctgcaatacaaatcaacaatcttacctcttgttctggattatccaataaataaatcggttcttccaaaactaacattgacattcctatttcattcacaccttcatctggccgagcgtgaggaattgctactcccttccctaaattaataaaaggtccaaactcttctactttttgaatcattgcctcagggtagttctcagttatcttatcttgatccaaaagcggtttagctgctaaacgaatcgcctccttccatcctaatttttgcgaactaacctgataggtttctttggtaataagttgttctagcactggtacaatttcctttctatcatttttttggtaaagataattctttaacgccaatcttaattccaattcttgtgtaataattccatatcttttgacaatattcaggatttgttcaatctcaaaatctccatactctaaattcggaaaatcttttaacactagttctactagttgtattgcttgctcttcagtcatcataaccgaaactagataatttggcttttctgtctccacctttatggtagaaaaaaccatatcatagtcactactagctttcacctgtaaatcatcaatctttgaggttcctataaactcaatttgaggaaataatgctaatagattctcttttaacatcaatgaagaactaacaccattaggacaaatgattgctgctttataccatttttgaggcaaagtatctgctttctttaaataacctccgaaatggataacaaaatatgctgtttcactatcaggtatgggattgtcaatagcgtccatcaagggcatcaaagaatctttgactaattcaaataaatcaggataatgttctttaacatgcaatacatattcatttgaactaggtaggccgaactttaatctatagtaagccggtataaggtggcggcgaagattttctctcaatccttccctttgtttaaaatgtaacaaagaaatatcttccattctacttataatagcctctgttaattgattaaagtaaaccggagcaacatctacttcaccttcaaagcaacttgataataaaacggtgatatagcgataatcatcctcagaaaacaccgtatctataattcccaaatcaaccactgtatccaataaaatagtggttatatcttgaataacaggagatactaatgtctctgaaagacatactctttcaacatccctttgatacctacacagaatgaatactaaaccgaaaaggtaaacttttaattgattaacaataggtactagctgtagcttctcataataatctttaactacctgatcaatcaaatcataagttaatgaatacccccaactggataaaacataatccaaaccccaaatccctatggaggattccagcaactcactaaccatttgaaaagctaagcggtgcttattccactctgaaccgtgtaaagtataaccttttgctctactgtaccctagctccaaatcattatctaacataatctttcttaatgattgaatatcagataaggttgtattcttacttactttcaaaaagtcttggtaatgactattcgatataaaatctaatcggcaaaaagtgtaaagatagattaaagctaagcgagtcgactttggtaaaaccaattcatccgacttaataatatctgtcaaagactgcttcgtacgatttgataaactatagcgaccttgctttttatccagcactatccctttattagctagataaggcactaaataatctattccttctttgacttcctttataggtaagctcaccttaacagataattcatataacgatagctcacaatgatccatcaaagtcatcaaaataactagtgctctataatcaaac

SEQ ID NO: 98 - DNA, 8654 bp; double-stranded, linear
cgagacaacaagatgaagaaaaatttgccctatcgtttgtggcgcttgcaagtgtagcacttcttgcagcctgtggagaagtgaagtctggagcagtcaacactgctggtaactcagtagaggaaaagacaattaaaatcgggtttaactttgaagaatcaggttctttagctgcatacggaacagctgaacaaaaaggtgcccaattggctgttgatgaaatcaatgccgcagtggtatcgatggaaaacaaatcgaagtagtcgataaagataataagtctgaaacagctgaggctgcttcagttacaactaaccttgtaacccaatctaaagtatcagcagtcgtaggacctgcgacatctggtgcgactgcagctgcggtagcgaacgctacaaaagcaggtgttccattgatctcaccaagtgcgactcaagatggattgactaaaggtcaagattacctctttattggaactttccaagatagcttccaaggaaaaattatctcaaactatgtttctgaaaaattaaatgctaagaaagttgttctttacactgacaatgccagtgactatgctaaagggattgcaaaatctttccgcgagtcatacaagggtgaaatcgttgcagatgaaactttcgtagcaggtgacacagacttccaagcagcccttacaaaaatgaaagggaaagactttgatgctatcgttgttcctggttactataatgaggctggtaaaattgtaaaccaagcgcgtggcatgggaattgacaaaccaatcgttggtggtgatggattcaacggtgaggagtttgtacaacaagcaactgctgaaaaagcatcaaacatctactttatctcaggcttctcaactactgtagaagtttcagctaaagctaaagccttccttgacgcttaccgtgctaagtacaatgaagagccttcaacatttgcagccttggcttatgattcagttcaccttgtagcaaacgcagcaaaaggtgctaaaaattcaggtgaaatcaagaataaccttgctaaaacaaaagattttgaaggtgtaactggtcaaacaagcttcgatgcagaccacaacacagtcaaaactgcttacatgatgaccatgaacaatggtaaagttgaagcagcagaagttgtaaaaccataatagaaaaatgttgaaatagggaatgagcctttgactcactccctgtttcgatatttaatactcttcgaaaatctcttcaaactgcgtcaacgtcgccttggattatatatgtgactgacttcgtcagtcttatctacaacctcaaagcagtgctttgagcaacctgcggctagtttcctagtttgctctttgattttcattgagtataagaacctatcaaaaagtgagggaaaaccctcggaattataaatagaaagagtgaatcttatgctccaacaactcgtaaatggtttgattctaggtagtgtttacgcgctgttagccctaggatataccatggtttacggaattatcaagctcatcaacttcgcccatggtgatatttatatgatgggagcctttatcggttatttcttgatcaattctttccaaatgaatttctttgtagcgcttattgtagctatgctagcgacagctattcttggtgtcgtgattgagtttcttgcttaccgacctttgcgccactctactcgtattgctgttttgattacggctattggggtttctttcctattggagtatggaatggtctatctggttggtgccaatacccgtgccttccctcaagcgattcaaacagttcgatatgatttgggaccaattagcttaacaaatgtgcagttaatgattttggccatttccttgattttgatgattttgttacaagtcattgtccaaaagactaagatggggaaagccatgcgtgcagtatcagtagatagcgacgcggcgcaattgatggggatcaatgtaaaccgtacgattagctttaccttcgctttgggttctgctcttgcgggtgcggctggtgttctgattgctctttattataactctcttgagcctttgatgggggttactccaggtcttaaatctttcgttgccgcagtacttggtggtatcggaattattcctggtgcggctcttggtggctttgtgattggtctattggaaacctttgcgactgcctttgggatgtcagatttccgtgatgccattgtttatggaatcttgttgttgatcttgattgtccgcccagctggtatccttggtaagaatgtgaaagagaaggtgtaaacgatgaaggaaaatttaaaagttaatattctatggttactccttttgttagctggctatagcttgattagtgtactggtttcagtcggagtacttaatctattctatgtacagattttacaacaaattggaattaatattattttggctgttggtctcaacttaatcgttggtttttcaggacaattttcacttggtcatgctggtttcatggcgattggtgcctatgcagcagctattattggttctaaatcaccaacctacggtgccttctttggagctatgcttgtaggggctttgctttcaggagcagttgccttacttgtcggcattccaaccttgcgcttgaagggggactatcttgcggtagcaactctgggtgtttctgaaattatccgtatctttatcatcaatggtggaagccttacaaatggtgcggcaggtatcttagggattcctaactttacaacttggcaaatggtttacttctttgtcgtgattacaaccattgcaaccttgaacttcttgcgtagcccaattggtcgttcaaccctctctgttcgtgaagatgaaatcgctgctgagtcagttggggttaatacgactaaaattaaaatcatcgcttttgtctttggtgccattactgcaagtattgctgggtcacttcaggcaggatttatcgggtctgttgtaccgaaagattacaccttcatcaactcaatcaacgttttgattattgttgtatttggtggactcggttccattacaggtgcgattgtttcggctattgttctgggaattttgaatatgcttctccaagatgttgctagtgtgcgtatgattatttacgctttggccttggtattggtaatgattttcagaccaggtggactccttggaacatgggaactgagcctatcacgtttctttaaaaaatctaagaaggaggaacaaaactaatggcattacttgaagtaaaacagttaaccaaacattttggtggtctaacagctgttggagatgtgactcttgaattgaacgaaggggaactggttggattaatcggtccaaacggagctgggaaaaccacccttttcaaccttttgaccggtgtttatgaaccaagcgagggaacagtaaccctagatggtcaccttttgaatgggaaatcaccttataagattgcctctttgggacttggacgtactttccaaaatatccgtctctttaaagatttaacagttttagataatgttttgattgcttttggaaaccatcacaaacagcatgtttttactagtttcttacgcttaccagctttttacaagagtgaaaaagaattaaaggctaaagctttggaattgttgaaaatctttgatttagatggtgatgcagagactcttgctaaaaatctttcctacggacaacaacgtcgtttggaaattgttcgtgcccttgctacggaacctaaaattctcttcttagatgaaccagcagcaggtatgaacccacaggaaacagccgaattgactgagttaattcgtcgtatcaaagatgagtttaagattacaatcatgttgattgaacacgatatgaatctggtcatggaagtaacagaacgtatctacgtacttgaatatggccgtttaatcgctcaaggaactccagacgaaattaagaccaataaacgcgttatcgaagcttatctaggaggtgaagcctaatgtctatgttaaaagttgaaaatctttctgtgcattacggtatgatccaagcagttcgtgatgtaagctttgaagttaatgaaggagaagttgtttcccttatcggtgccaacggtgcaggtaagacaactattcttcgcaccttgtcaggtttggttcgaccaagttcaggaaagattgaatttttaggtcaagaaatccaaaaaatgccagctcagaaaatcgtggcaagtggtctttcacaagttccagaaggacgccacgtctttcctggcttgactgttatggaaaatcttgaaatgggagctttcttaaagaaaaatcgtgaagaaaatcaagctaacttgaagaaggttttctcacgctttcctcgtcttgaagaacggaagaaccaagatgcagccactctttcagggggggaacaacaaatgcttgccatgggacgcgccctcatgtcaacaccaaaacttcttcttttagatgaaccatcaatgggacttgccccaatctttatccaagaaatttttgatatcattcaagatattcagaagcaaggaacaacggtcctcttgattgaacaaaatgccaataaagcacttgcaatctctgaccgaggatatgtactggaaacagggagaatcgtcctatcaggaacaggaaaagaactcgcttcatcagaagaagtcagaaaagcatatctaggtggctaaaacaatccagtggattgttttagtcggcagatggagattacgaagtaatcatcaatatagtccgggggacctttttagtcggtagattgagattgcaaacaaatctgcatctacattgaaagcttaatttctaataattgaaaaaatcgaatgaaaaatttcttaccttcattcacagagctcgatttcagagctctttttgctagcttattcatacttttctgaatttcgaaaaagaaatgtaagcgtttgatagatttacaaaaagattgtataatagggataagaatagaaaaggagaagtctcatggcagttaaagattttatgacccgcaaggtagtttatattagtccagatataacagtatctcatgcagcagatttgatgagagagcaaggtttgcaccgtctgcctgttatcgaaaatgatcaattagttggtttggtgactgagggaaccattgcacaagcaagtccatctaaagcaacaagtctttctatctatgagatgaattatcttctgaataagacaaaagtaaaagatgtcatgattcgcgatgttgtcactgtctcaggctatgctagtctagaagatgcaacttatctgatgttgaaaaataagattagtattctccctgtcgtagataaccatcaagtatacggagttattactgaccgtgacgttttccaagcctttcttgaaattgcaggttatggcgaagaagggattcgtgtacgctttgttacagaagatgaagttggtgttcttggaaaaattgtttctttgattgtagaagaaaatttgaatatctcccatacagtcaatattccgcgtaaggatggtaaggtgattatcgaagtgcaaatcgatggatcaattgatttaccagccttgaaagaaaaatttgaagcaaatggtattcaagtggaagaaatcgctcgcacttcagcaaaagtcttgtaagaagggaagcccaaaggcttcttttttcatgaaaaggggattagagcaaaagatggaaagaaatgataaaatatgctataatgaaataatgtaaaaaaggagtatttatggacatttcagtaattcgtcagaaaattgacgcaaatcgtgaaaaattagcttctttcagggggtctctttgacctcgaagggctagaggaagagattgccatcttggaaaacaagatgacagaacctgatttttggaacgataatattgcggcccaaaaaacgtcgcaagaattaaatgaattaaaaaacacttacaataccttccataagatggaagagttgcaggatgaagtcgaaattttattggattttttggctgaagacgagtcagtgcatgatgaactggtagcgcagttagccgaacttgataagataatgaccagctacgagatgactctactcttgtcagaaccttatgaccacaacaatgccatcttggaaatccatccaggttctggtggtactgaggcgcaggactggggtgatatgttgcttcgtatgtatactcgttatggtaatgctaaaggctttaaagtggaagtgttggattaccaagcaggtgatgaggctggtattaagtcggtaactttatcatttgaagggcctaatgcctatggtctcctcaagtcagaaatgggtgttcaccgcttagtgcgaatctcaccatttgactctgccaaacgtcgccatacctctttcacatctgtagaagtgatgccagaattggatgatactattgaagtggaaatccgtgaagatgatatcaagatggataccttccgttcaggtggtgccggtggacaaaacgtcaataaggtttcaacaggtgtacgtttaacccacattccaactggaattgttgtccaatcaacagtagatcgtacccagtatggaaatagagatcgtgccatgaagatgttgcaggctaagctctatcaaatggagcaagataagaaggctgcggaggtagattctctcaaaggtgagaaaaaggagatcacttggggaagccaaatccgttcttatgtcttcacgccttatactatggtaaaagatcaccgaactagctttgaggttgctcaggtagataaggttatggatggggacctagatggttttatcgatgcttatctcaagtggcgaattagctaagatagaaaggaactcacatgtcaattattgaaatgagagatgtcgttaaaaaatacgacaacggaacaactgctctacgcggtgtttcggttagcgttcaaccgggggaatttgcttacatcgtaggaccttcaggagcagggaagtcaacttttattcgttctctgtatcgtgaagtaaaaatcgataaaggaagcctatcagttgctggttttaatctggttaagatcaaaaagaaagatgtcccgcttctacgtcgtagtgttggggttgtcttccaggattataaattgttaccaaagaaaactgtctatgaaaatattgcttacgctatggaagtaatcggggaaaatcgccgtaatatcaaaagacgagtgatggaagttttggacttggttggattgaagcataaggttcgttctttcccaaatgaactctcaggtggggagcaacagcggattgcgattgcgcgtgcaattgtaaataatcccaaagtattgatagctgatgagccaacaggaaatctggatccggataattcatgggaaattatgaatctcttggaacggattaacytacaaggaacaactattttgatggcgactcataatagccagattgtaaataccttgcgccaccgtgtcattgccattgaaaatggccgtgtcgttcgtgacgaatcaaaaggagagtatggatacgatgattagtagattttttcgccatttatttgaagccttaaaaagtttgaaacgaaatggttggatgacagtagctgctgtcagttcagtcatgattactttgaccttggtggcaatatttgcatctgttattttcaatacagcgaaactagctacagatattgaaaataatgtccgtgtagtagtttatatccgaaaggatgtggaagataatagtcagacaattgaaaaagaaggtcaaactgttacaaataatgactaccacaaggtatatgattctttgaagaacatgtctacggttaaaagtgttaccttttcaagtaaagaagaacaatatgaaaaattaaccgagataatgggagataactggaaaatctttgaaggagatgccaatcctctctatgatgcctatattgtagaggcaaacactccaaatgatgtaaaaactatagccgaagatgctaaaaaaattgaaggtgtctctgaggttcaagatggcggtgccaatacagaaagactcttcaagttagcttcatttatccgtgtttggggactagggattgctgctttgttaatttttatcgcagttttcttgatttcaaataccattcgtattaccattatttcccgcagtcgcgaaattcaaatcatgcgcttggtcggagctaaaaacagttatatccgtggaccgttcttgttagaaggagcctttatcggtttattgggagctatcgcaccatctgttttggtctttattgtttatcaaattgtttaccaatctgtcaacaaatcgttggtagggcaaaatctatccatgattagtccagatttatttagtccgttgatgattgccctactatttgtgattggggttttcattggttcattgggatcaggaatatccatgcgccgattcttgaagatttaggtaaaatagctgcttttatgaggagattgtaaaatctccttttttgctacaagagtttttgaaaagagatgcgcagaagaaaagagcttccaaagaagtcccccagagaagacttc

SEQ ID NO: 99 - DNA, 19718 bp; double-stranded, linear
tgtcgcgtcaaaatcattactatggctatgtatagcccttactatgacttggctaaacacgttcgctttcaaatttctaggctcaggctgaaacagtctcccaggctgttcactcccgaatgctaaaatcgttcttgatcgctttcacattgtacaacatcttagccgtgctatgagtcgtgtgcatgtccaaatcatgaatcagtttcatcgaaaatcccatgaatacaaggctatcaagcgctactggaaactcattcaacaggatagccgtaaactgagtgataagcgattttatcgccctacttttcgcatgcacttaacaaataaagaaattcttgacaagattttaagctattcagaagacttgaaacaccactatcagatctatcaactcttactttttcactttcagaacaaagaccctgagaaatttttcggactcattgaggacaatctgaagcaggttcatcctctttttcagactgtctttaaaacctttctcaaagataaagaaaagattatcaacgcccttcaactacactattctaatgccaaactggaagcgaccaataatctcatcaaacttatcaagcgcaatgcctttggttttcgaaactttgaaaacttcaaaaaacggatttttatcgctttgaacatcaaaaaagaaaggacgaaatttgtcctttctcgagcttagctgacttcaacccactacagttgacaaagagcctaatttccataaaaattgacatggaaattataaaaccattactagtttagtcctttttgataacgtgccaattcggcttggttcgcccaaacatagtgacctggacggatttctaccatagatggcttatcagtctcatagtcgtgttgacttggatcgtaaaccttcaagaccttcttacgttccaagattggatctgggattggtaccgctgaaagcaaggcttgagtatatgggtgaattggattgttaaacaattcttctgtttctgcaacctctacaataacacccttgtaaataactgcgatacgatctgaaataaagcgaacaaccgacaagtcatgggcgatgaagagataggtcaggccgagctctttttggaattttttgagcaagttcaagacttgggcacgtacagaaacgtccaaggctgaaattggctcatctgcaataacaaagtctggttgcatgaccaaggcacgggcaataccgatacgttgacgttgaccgcctgagaattcatgagggtaacgagtcaagtgctcagcaagaagacctacttcacggataatattttgaactttctctttacgttcttcttcatccttaaataaacggtgattgtaaagaccttcagaaataatataatcaacagtcgcacgttcattcaaacttgcggcagggtcttggaaaatcatctggattcgacgaatcaattccgcagcttgttcacgcgatttcttaccattaatcttttgaccatcaaaaatgatatctccattacttgtatcatttagaccgatgatagcacgaccaatagttgttttcccactaccggactcacctacaagcgagaaagtttctcccttgttgataaagaagttagcatttttaaccgcgacaaacttcttacttccttcaccgaaggaaatttctaaatctttgatttctactaatttttcagacatttccttcctcctagtcagccagatgggcaaatcccattttttcacggatcttatcatggagatttgcaatcacagctggtttttctactttcggagcatcctcatgaagaagccaagttttagcccaatgtgtctctgatactgagaattgaggagctttttgttcgaagtcaatctgcattgcgtagtcagaacgcaaggcaaaagcatcccctttcaggtcagtataaagtgacggaggtgttcctgggattgagtaaagatcccctttatcatcagcaagctgaggcaagctagacaagagactccatgtatatggatggcgagggtcatagaagacttcctcaaccgttccatactcaacgatttctcctgcatacataaccgctaccttatccgcaatacttgccaccacaccaaggtcgtgggtaataaagattgttgtgaaatgatactcgttttgtaaagattttagcaaatcaataatctgagcttgaatagttacatccaaggcagttgttggctcatcacagatcaagacatcaggtcggcaggcaagggcaatagcaataacgatacgttgacgcattcctccagaatattggaatgggtattcattaaaacgtctatctgcgtctggaatgccaaccttattcatgtagtcaatggccaattctttcgcttctttagctgtttttccttggtgttttacaataacttctgtaatctgactaccaattgttttaatggggtccaaactagtcattgggtcctggaagatagtcgcaatcttagcaccacgaatttgttcccaatccttgtgagaagataaagctgtcaagtcctgaccacggtagtcaatactaccttgggcaatacgaccattttcttcgagcatacctgtgaaggtctttgtcaaaacagatttacctgatcctgactcacctaccaaggctaatacttctccttcgactagttcaagggaaacgccgcgaatggctgtcaatactttgtcacgaacgtcaaattccacgacaatatcgcgagcagtcaaaattacatttttttcttttgtcatttctactcctatctatgtgtacgtggatcactagcatccgctaagttttgaccaactacgaaaagggacaaggataccaagacaagggttgtcaatggaatccagaacaagtaagcattggttgttacgttttgtgaataatccgaaatcaaacgacccaaacttggcactgtaatcggtaatccaagaccgaagaaagacaagaaggcttcgtatgagataaagcttggaagcatttgagtcatggttgtcacaataacagataccaattgaggcatgatatttttggcaacaatcttcaaggttggtgttcccaaagtacgtgacgccaagttgtattccaagtcacgatagcgcaagatttgcacacggatcatgaaggcaataccaatccatgttgttacgctcatggcaaaaatcagattccagaatccagctccgattgagtaagtcaagacaataacaatcaaaagaggtgggatgtttgagatgacgttgtaaacttccatcatgacacggtcaactgattttgaaataccccaaataccaccgacaaaaacaccgataaccaagttaatcactgtcgcaatcacagaaatgaggatggagttacgagctccgaaccagacaccgtcaaagagcgatttaccgttactgtcagtaccgaaccaatgctccgcatttggcttgatataacgaacactaaagtcgtttaccttgctgacatcattgaaatcaaacttagaaaacattgggtagatgaaacttatcaaaatgatggctaccaagattcccaacatgactacagttgattttttcttcataaattgtttaaacactgatttccagtaagaatatgctggcgcatcaatagtttcagaggcaaaatcgtcacgttttacaaactgaaatttttctttatcgattgtagacattatttgcctcctttctcagtcaatttaatacgtgggtcaataatagtcatccaaatatctcccaaaagacgtgagaagatagaaatacatgtaaagatgaagacaagaccaacgaccatagagttattagatgcttttacagagtcaatcaacattttacccatacctgggaaggcgaagactgtttcagtaagggttgcaccaccgataaccccaataatggcagcaggaattcctgaaaccagcggaaccatggcatttttaaagatgtgtttgtttgaaatttctttttcagacaaaccttttgcacgagcgaaacgaacaaagtcttgagattgcaagtcaatcatgtaacgacgaatccaaatggctgtaccaggagcacccaacaaaccaaggatgactgctggtaaaacgtaagaacgccaatctccagctcccaagatagggaatgaatctggaagggcaatagatgatccaatcaatcgaacgatgtaaaccaaggcaatcgttggaagagcaagcaagaaggtcaaagcccctgttgagaggctatcaatccaagtgttcttgaaacgagccatggctgaaccaagtggcacggcaagagcataggcaagaaccaaaccaatcaaaccagtaatagcagagctgacaatcatagatggatattggtaattactttcagtcgctgtataaggatcatctttcccatagctagctacttcacgagagtcagcctgactaggtgacttgtaggttcttgagtaaatatttacagaagacgttttcttacctgttgggaactgaacttgggcagttttggtttgtccttgaccttgagtaataacctgaagaactggtgtattagcataggttgggtaagagtcacctaaattcaagttcacaaagttttgatgaacaaatgggaactgactgttaaagtacaagagatatttatgtttagttcctgaaccgaccaatgaccatccgatagctggatcattttcaaaacgaaggtagcgtttcaagtctggattttcagggtcttggattttatttgtatggtcaatgtcaatcaagttagcatagaagtgaaaaacacgttcaaaaattggaatttcacgagtagcatagaattgaccactttcagtaaattctcccaaagtccaaccatgacctaattgattgatgtacttttcataaatagctttattggtcgcatttgcttctactgttacagaagaatccatgctacttgccttttcttgcaactctttagtatcgtaatactcaatgtagcccatacgctcaaacacagtattttcatagttatcacgtttatcagccgttgtcgcaattttattatagttaggatcctgcttgaaaatcaattttcgaggaaccaaggtatagataatcgtgtaggtcaaagtcgttactaagaaaatcgaaaccaatgaccgcaaaacacgcataaaaatatattttttcatattatttcctttaaaaatcccaaaagaaccttctcctcatggagagaaagttctattagaaattatttacttcacatgacttgccaattctttttgagctttctcatttgattcagctttttctttcaaccatttttcacgagctttttcatactcttccttagtcaccactttatcttgtgatttcaaatatttgaagtaaacatctgaccccttagagcctgtttgcgcagaagctccagtaaatggaacaattcgtgaaagcactggtgctgcaccagaagaagccatagcaggaataaagagtgaactatctgtcaaccatgcttgagccgctgcatatttttcataacggacattcaagtcgcttgtctctctggcagcttcatcaactaatttatcgtattctttcaaaccaacttgaactactgaagggctatttggattatcaaatcctaaatatgtttttgtagtttcactgctagttgtttttaaaatatccaggtaagtagatgggtcttgatagtctggcccccatgaaactcctcctgatacatcccaatcctcagatgaagcattggcagcatagtaagtaatattaaggaattcatcacttgtcatttgttgaatatcaacaacgacattttcaacaccaagaactgtttctacagattgtttaaaggactgaatacgagatatgtagttttttgatgcttggtctactggaacgtccagatgaataggaaactgaacgccgtctgcttctaaagctttcttagctttcgcaaactctgccttggccttgtcagcattgaataaaccatcctgcccatcagctaaattcacacctttccactcatcaccataagcaggaagttgagcagcgactaaatcaccaaaggtcttctcaccagctgaaacaaagtctggttttacaaataaattacgaactgctaaagctgctccatctttaccattgatttgagctgagtaagctgagcgatcaagagcaaaattcaaggcttgacggaaatctttgttaagcaatgccttcttagtagctactttctctgaatctgtagttttagaagtatagttgtaactttggcgatcaatattcacacccagaccagcaatcccagagcctgattgtgtgtaatagatattgtccttgtattcttctgcaaccttagaatagttggagctggtagggtaaagacgggcataactataagctccactagtgaagttacgctctagcgactcctgatctgatccatcatagtaagctagattgatagtatctaggtggacattttctttatcccaatattgctcattttttacaaactctacagaagattttgcagtcaaccctttcaacaagaatggaccattataaagcaaggatgtcggatctgttggtttagcaaaatcgcttccttttgatgtttcgaattcttcattcagaggccagaaaatagaataggtcaacttagagttccagaacggttcaggctggttcaaagtgtattgtaacgtataatcatcaaccgccttgacaccaactgttgaaaaatctgttgaagttcctgatagataatctgccaagcctttaaccgaattttcagctaaatacatagcttctgattttttatctgctgcgtgttttaaaccgttcacgaaatctttagccgtcacctctgcatattcttctccatcagaggtaaaccatttaacccctttacgaatcttataagtgtaggtcaaaccatccttagagacttcccaatcctctgcaactgcaggagcaagattaccgtaattatcgttagtgaataaaccatcaatcccatttgaagtcactactgttgtactatttttacttgaaatcaggtagtccaaggtttctgggtctgctgtataaacatagccataagctttaggggctgatgaatcagatgattttgaagaactgcatgctgcaagtacacctgctgctaataaaacaagacctgctgtagcaaatacacgattttttttcattttctactcctctgtttatgtgaattatagattgacaaccattatatcacattatccattaaaaatcaaacaaattttcagaatatttaggcttgttggcacaaatttttcattttttttgaatatatgattcaaattgtcgttcgaagtgtcaaagactacagtgaaaataggaaatttgacgcagaaactttggagtttaggaagacatacagtaaaatgaaatacggacggaacaatgtgattttggaattcaaattaaattataacaatattgtagaagtatcattctagtattcaagattcagtttactatgtcttttcacaccaaccttatcccgaattcaattacttttgtgatttacatatatagattaagactatcttttatactttaaaatttctcgctaccttatccactatatgctcctcgctatcacgtttctattcatagcctacgatttcactattgctttctctgacaattcttatttcctgcgtcagacttaaaacgatctatccccagaccattttaatccgctacctcacgatagtcaggcttggggagcgctattgtattcaccggtagtggagccctacagaggacttacacctcagatgcacgacatgcccatcgtataaaaaatctcctacccaaggtagaagatttcaaacttataaaacttaatccgtcatgtccgataccaacattcgatgctccaatggaatactgcacataactagcaagaaaataaagcctgactgaatccagaagagagccaagtcaaaaattccgtgcacagcaaccactgtaaggaaagatagataaaggccgataatcggacgtttccccgactcctgactcatatccatcatcaagcgaacaggagcaacagaagacaaaactaataaaatagtccccacaattccgtaactcagaatcgtatcaatataaagactgtgggcatgttcatgataaggagcatgtatccgaggataagagttcatataggtcaatggcccttcaccccaaaaaggattttgcttaaacaaggccatcccagcatcccagatagaaatgcgttcttccatagaagagtctaaagtacccattcgaactcccaaatcactagaaaagaggaaactcaaaccaatcgcgaagaccccaatactaagccaaaaggccttccagtttttaatagtcgtaaagagatagataattgctccagcgataatagcaggaaaggcagttcgattttgagtaaagttcaaaccaaagagattaacaaagcctgcaatcacacagaatactttcaaccaattcaacttggtcgttgtaaacagatagaaagcaatcataatacagaaacaacaaataattccataataattaggattaaagaaggtcacttctgcccggttctgatgccacacctgcatattgggtgaaagaaaagcatagttaaatttcttcacaatttggaaatgttctaaactggcaaaagcagctgacaagacactaccaaacaagacaaactgcaaaatcaatcgaaagaatttatgggataaaatcgactgatagtgcaaaaagaaaatagtaaatagaaacattcctactgaagccacaagacccatccaattttgtgcaagaatggatataacagtactatagctaagaaaaagaagcagcatcggatgctcccccattttctgaagaatacttttcatgtctcctgtaaaaatcaaactgataatatataaacagagtacaactacaaaaagataaaagggtaaaaagatactcaggataattcccaataaaatcagctctttactagacaaccccttcagcttttcaataaagcctattgatttcaaaatgaatcctttctctccaaatcagctgattcagataatagtaagctatcctatattgtaccacttttttagcaatttgaaaacaaaggaaacgttttccaaaataaaaaccctattttatccaccatatcaaggcttcaaaatgatacttcaactccattctcaattacccgataagtctgattttgcaaatcaatttctactactgctgttacggacttatctttattttgacgtttgattacaatgctgtgagctgttggtgtctctatctcagtagtcccttctagatcaaaggcttctgaacggttacggaaagaaaatagattgagaagggccttcacaacaggtcgttgcacttcttttgctatttcctcgttgctatagtaatgacgattaatatttcgaccttctttagtttcttctaataatttcaagtcattcttgcctgctaatagacccacatagtaaatctgaggaatacctggggcaaaagcttgaattagacgagcgagaaaatacttgacatcatcatctccaagcgctgaatagtaggttgaattgatttggtagatatctaagttgttatactcggcactagagtacttacgtttgacattggctccaaccttatagagttcatttgaagcatagtcaatctcctcatcggtcaggatatccttgacatctactactccaatcccatcatgggtatctagcgtcgtaaattgcttcatcgggctcatctttaaccacttagccaaacgctctgttctggaactgtaaagagtataaagtgtcaccattggaagagcaaaatcataaacatagtaatcatggtctgctattttaaactgaatcgaatagtgttcatgaatctcaggtaaaagctctgtcccatactcagcagcgatatctcgaactttgtccaataaatcccaaatatctggttccacaaagaaatcattagtatccaatttcttcactgcataagcaaaggcatctagacgaatcaaatcacacccattacttgccaagtgctgaatggtcttacggataaattccatagttacttctttggtcacatcaagatcaatctgctcctcaccaaaggtattccacaaatgttccactgaaccatcttcaaacacaatctcttgctttggtgcacgatccttacgcttgtaaattaaatctacatcagactgtgtcggacggttttctggccaaaacttatcccagtttaaaaagagagctttaaattcactggcttcatgtttttcttgatagtccttataatacttggattgacgagaaatatgattaatcataaaatcaaacataagataatatttctcacctaaacgcttcacatcctcccaatcaccaaaagctgagtccacttcgtcgtagtcaactggcgcaaatccacgatcaactgttgatgggaaaaatggtaaaaggtgaactcctccaatagcatctccaaaatgctcttccaaattatcatataagtctttaagattatttccaaggctatcagaataggtaatcaacatggttttattttgaattggcatcattactctcctttttctaattgaagccaagtctcatatgatctggcttcataaataaaattcattttaaatctctatttatcatcaaactcgtactaatatagactgtgataaacaaagtactactttcttgttttctgcatagaattatcaacaagctaaactcttcctctgtgtcaaagactatagattccatgagctcttcttatactcttcgaaaatctcttcaaaccacgtcagcttcaccttgccgtaggtatggttactgacttcgtcagtttcatccacaacctcaaaacagtgttttgagcaacctgcggctagcttcctagtttgctctttgattttcattgagtattacttcactgccccgttgctcattcctgaaatgatatggcgttggaagaagagatagacaatggtgatactgataatgccgaccacgtaagaggcaaagcttggtccgtagtcgttgaaatattggcctgcgtagttgtattggaacaaaggcagagtccacattttggaatcccggttcaagacaaggagtggcaacatgaagtcattccagaaccaaagggcattgatgatcatggttgtcgcatgcatcggtttcatcattgggaagatgatgcggaaataggttgtaaattgattagccccatcgatctctgctgcttcatccagactttctggaatcgagattttgatatagccaacatagagaaagagggtctgtggaatcgcataggtcaagtagagcaagatcaaaccaaaggtattagccaaaccgagtttactcatcataaccgtaatcggaatcatgatgacttggaaaggtacgaagattccgaggattaagagggtatacatgatggtaaaggcttttcttttactcatattgcgagcgatggagtaggctgccatagggataaagatcattactgcaagtaaagacaagacagtgatgacgacagagttccaataatagcctccaatcccatcagctaagagacggctaaagttgtcccatgtgaagttggttggaaagccaaagaaattatctacaatatccttagtgggtttgaaggaactaaagagggtagcaaggagcggcactaaaatcagaaccgatcctagaatcaatagaatgtatttgccaatcagggcttttctttcatcttgtttcatcatgcttctcctcttaaatttcaaatttcttagatactctcaattggatgatcgaaatcactacaattaagaagaacaagattacggcaatggcattggcataaccgaattggttgtttttaaaggcatagttataaaccaagagcccaagtgaggttgtggcattgtttggaccaccaccggtcatggcaaagacttggtcaaaggcagtcagcccaccttttagggctaggataaagaccatagagacacttggtagcaagtaaggcaattcaatgttccagaaaacttgcttgctagtcgcaccatcaatccttgctgcctctgtaatctcagttggaatagattgcaaaccagctaggaagatgatgatgggcatagccaccccttgccaaagaaggacaaagacagccgcaaagattgctccccacttagtccctaaaagactggtttggaaaaattcaatatgaagggcatttccaatcgctggaagaccgtagttgaagacttgcttgaagatcaaagccactgtcaaaccagataaaacagctgggaagaagaaccaagcacggaagaaggtttggcctttgattttagaattcaagacacgcgcaatgaagatcccgagtgcaatctcaccaaccaccatggcaatcgcaatgattgcggtaaagccaatcgcattcatgaattttggatccatgaagaggagcttaaagttgtttaagccaacaaatttgtagttataagtcaatcctgtccagttggtaaaactgtaaaaggctccttgaaacatcggcacatagaagaaaattgcttgtaacaagagggggatgaccacaaaagcccatgcccaatatttttgtaatacttttttcatagtctctctactcctaatccacatccgctttcatcgggttaaagaaggcattcaaatcattgaccatgccttgtttatcaccggtcaagacatagttcatggtcaaggtatggaagtctgcttcactggtccagtattgttgcaaccagaccaagtgacgatccgtaaaggcatattcggtcataccagcaagcggtgaatcttctcctgcttgtttgaccccttcgatcgctgttggagatccgtccacatcgtagtatttttgcatgacttctggacgggtcatatattccacaaaggcattggcttcttttggatgtttggtggtggctgagatagaccatgccaagtctcccgcaccaacggttaagctttgtcctttttcttttcctggaatcatgaaggtcccaatcttaaagttcggtttttgttcattaatcgctgtgatcgcccaagacccatttggtgtcatgaggacatccccacgtgcgaaggctccgataacatcggtatagccagcaccttcccagttcttttgcttagatccattgatgcgaaggatgtccatgaccttgatatcatctttcataatcggatccgacaatttaatggcatttggttgagaataacgaaggtattgatttgcttcttttcctccacctgttgctgtcgcaaaggctaattgattgtaaccattgagtgtccaagcatctgcacctgcaattccaaatggtgtttgtcctttagcaacgatatctttgactaactgttcaaattcatcccaggtttcaggaaccttcaagcccagttcttcgaatttatctttgttgtagtaaattccataagcattagctgtaaaaggaacgttgtaaactttttcgtttacagcatatttttcagcgtagccatttttcacgcgtttcaggtagtctttgttgctcaaatcttcaaaaacacctgcttttgcccattcttgcagttcgatggactgtgggtaaatattgaccacatcaggcacatctcctgcgagaacgcgtgtcttcaatacttcaccagcatttggtacattgacgactttgaccttgatcttagggttttccttctcaaaatcacgagtgatttcttccaaggttttggtcatttcttttttctggttgaaatactcgatggtcactgtgccatccgcagatttaccatagttggagcaagcgccgagcccaaacaaagctaaacctgtagttgcaagaagtccgatttttttataccattccattagaaagcctcctttataaatttatacacccttattgaactgcaccccaaaagttagacagaataaatctaacttttggggtcagtacatatcatagttttctaaaaatatactgtctactcaaaaaatctccttgggataagataacagttaagcccgcatacattagttctgcacctgagtaaacttcgccattttcctgtaatttatatagtccctcttcatccaaatcttttaattttaaagttgtttccatggtctctacaacagataaaacgcgaacgtaggttacaatcgtttgatttccgtaattaaattgtacagctgcttcattggatacagtatcaggattaattagtctatactgctgtcctaactgaactactggtcgtaattctttatacaagttcacctgattagcaatcgtagctttctcttcatctgataaatttgtcaaatcaagttcatagcccaaatttcccatcattgctacaaggccacgtgtttctaatggtgtcattcgtcccatctgatgattcggtactgctgacacatgagcccccatagaaatggttggatagagataggatgaaccgtattgaattggtaaacgtgcaatggcatcagtattatcactagcccagacttgtgggaaatagcgcatcataccaagatcatttcgtccaccaccaccagagcaggactcaaagagaatatggctgtgcttctctgtcagataagaaacgagttcataaagccccagcatgtactgatgagattgcatctgtgtctctagataagttaatccattccctagcttagtgatattgcggttcatatcccatttaatgtaatcaatatcatgataaaataggagttgatctaagacacttttcaagtattctactacctgaggattggcaagattaagtactaattgattccgagaataagtatgctcatagccaggaacctgaatagcccagtcaggatgttgacgatacaaatcactatctacagaaatcatttcgggttctaaccaaagtccaaactgcaaacctctttcatggatagctgaaatcagactttctagacttccacccagtttttcctcattaacaacccaatcacctaaagcacgattatcatcaaaacgattgccaaaccaaccatcatctaatacaaaaagttcaatgccaactttcttagcttcatctgctaactctaacagtttttctctctgaaagtcaaagtaagtagcttcccagttattgattagaattggacgttcttttttagaaaattcacttagcataatgtgcttcagtacaaaattctgactttcatgactaataccagttaatccctgatctgaatgagtcactaaagctaccggtgtttcaaagtattcctcaggagctaacttccaagaaaagttttctggattaatgccaatagccacccgaacttcattcaattgatttttttgaacaaaagcttcaaagttgccactatacattagttgaatagcaaacacattcccagcatcctctgtgactccttgttcgcatagtagaagagctggtgtttgagcatgaccagaagcacctcggtttgaactaatcgaaaagattccttgttctacctgttgacgtctaacagtcttttcacgagcataagcaccctgcagagttactatttcgtaatctgcagctggaaaatcagccataaaagaaaaatctttatggatgacaacttcctgattactattattatctaatttactgtagctagcaatagtcgcatcattattaaaagtagtataatacaaagtcagactaagttgagccttagaatcttctaacattaagacaagagtctctgtatcgtccatgctatgtggagaaggtaagccctgtggaccattctgaccttttaaaatctttgcttctacaaatcgaaagtctgttacttcagttacactatgctgaacctgtatggttggtttcctaaaatctcctaagccatgttgtccaaaaatctgtcgctgagtatctaaactaaaggttcgattagtagccgttggatttcctgaaaaggcatggtctcgttcataaacactattggaacctttatagttcttaatagtctttcctaaatgtttcaaaagtaagtagccatttcgattttcaataatcaaacttagatttttactctcaacataaaatagattattctctatcctaactcccatttacttcacctcatcactttattgattatattttatcacctgaaatcgctttccaaaatagaaaaatgtctcaagaatatggtaaaatgttaggtaggaggtagcacatgttagttttttcagaataccagactggaacaatcgaccttgccctaagcttttatggatatgaggaatgcacacctaattactcttttggtccagccattcgtgatacatacgttctacattacattactaaaggacaaggaaaatttcattacaagggtaaaattgttgatttaaaagaaggagatttctttctattaaaaccagaggaactaaccttttatcaagcagatagtaaagaaccttgggcctactactggttaggaatcactggagggaaagcccctgattattttgctctttcccaaatttctgatcaatcctatctcatccaatctgaaacttgtcatacccagactactgcaaaactcatctcagacattgtccgcttcgctcagattacaaaatcaagtgaattagctcaactccatatcatgggacaacttcatgaactgatgtttcatctgggaactattgctcccaatcagaaaaaaaagaatatttcatcaacccaccaactctatcttgaatgcaaacgattaattgatagccactatcctcaatcacttacaattcaagatttagcaaaagaactatccgttcacagaagctacttatcaagcgtattcaaagaatttaataccttatcacccaaagaatacctactctacgttcgaatgcaccgagctagacaacttctcgaaaatacccaagagtccatcaaggtaattgcatactcggtaggtttttcagatccactccatttttcgaaagcttataaacaatactttaatcagactccaagtcatacaagaaaagaatactctcaataccaactagtaagaaaggcaacattatgaaatcctaccaagctgtctaccaaatcctatctaaagaaaccgactatatcagcggagaaaaaatcgcagaaaaactatccctaagccgaacagcaatttggaaagccatcaagcgactagaacaagaaggcattgaaattgatagtatcaaaaatagaggatataaactgatgaatggtgaccttattcttccagagattctagaagaaaatcttccaattaaagtcagctttaaacccgaaacaaaatcaacacaactagatgcaaaagaagcaattgatttaggccatgaagcaaataccctctatctagcttcctatcaaacagcaggccgaggccgttttcaacgttccttctactcaccacaaggtggtatttatatgacactccatcttaaaccaaatctcccctatgacaaattaccatcctacacactacttgtagctggagctgtctacaaagccattaagaacctaactttaatagatgtcgacataaaatgggtcaatgatatctatctaaacaatcataaaattggaggaatccttactgaagcaatgacctctgtagaaactggcttagtcacagatatcattattggagtaggtatcaatttcactattaaagacttccctcaggaattaaaagaaaaagctgccagcttatttaaagctacagctcctataacaaggaatgaattgatcatagaaatctggcgtgctttcttcgaaacaccagcagaagagctattatacctatacaaaaaacagtcattcattctaggaaaagaagtcactttcacactagagcaaaaagactacaagggacttgctaaagacatctcagaaaatggaaaacttttagttcaatgtgataacggaaaagaaatctggctaaatagtggcgaaatttctctcaatagttggaagtaaaataacacaattataatataaacgatataaaaataacttcagattagtaattcaattaagttttacggatctgaagttttattggctctaaaaataaaaaagagagttacagactctcattaaaacggagaataagggattcgaacccttgcgccagttacccgacctaacgatttagcaaaccgtcctcttcagcctcttgagtaattctccaattaatgggcacgagtggactcgaaccaccgacctcacgcttatcaggcgtgcgctctaaccacctgagctacgcgcccaagttaaaaaacttggtaatttgaacaaagttcaaagcgggtgacgagaatcgaactcgcgacaacagcttggaaggctgtagttttaccactaaactacacccgcataaatactatcaataaaatggcgcgagacggaatcgaaccgccgacacatggagcttcaatccattgctctaccaactgagctaccgagccttattgcgggagcaggatttgaacctacgaccttcgggttatgagcccgacgagctaccgagctgctccatcccgcgttaataatataaaaggaggatgtgggattcgaacccacgcacgcttttacacgcctgacggttttcaagaccgttcccttcagccggacttgggtaatcctccaatattcaaatggaccttgtaggacttgaacctacgaccactcggttatgagccgagagctctaaccagctgagctaaaggtccgacaagatcattatagcggcgaaggggatcgaacccccgacctcccgggtatgaaccggacgctctagccagctgagctacaccgccatgaatcgggaagacaggattcgaacctgcgacaccttggtcccaaaccaagtactctaccaagctgagctacttcccgagttaaatagaaaaatgcaccctagaggagtcgaacctctaaccgcctgattcgtagtcaggtactctatccagttgagctaagggtgctccatattatgccgaggaccggaatcgaaccggtacgatcgttaccaatcgcaggattttaagtcctgtgcgtctgccagttccgccaccccggcctctctaagcgaacgacgggattcgaacccgcgacccccaccttggcaaggtggtgttctaccactgaactacgttcgcactgttttcttctatctaaaaatgccggctacatgacttgaacacgcgaccctctgattacaaatcagatgctctaccaactgagctaagccggctcatttgttatatcttaatgcgggttaagggacttgaacccccacgccgttaagcgccagatcctaaatctggtgcgtctgccaattccgccaaacccgcatatatgacccgtactgggctcgaaccagtgacccattgattaaaagtcaattgctctaccaactgagctaacgagtctaaaataacttgcgttaccttaaacggtccgacggaatcgacccggtac

SEQ ID NO: 100 - DNA, 4117 bp; double-stranded, linear
ccgtggaaaagtctggatagtgaatggtcttcacacaatgacctgaaagaagcctgagaataattatggagagtagcattctgagaggtgttagcagaaccatatgacagagctgtttgaagagggaatattgaggagaaaaatcctgagcctaccagttggagttggaaagagctgactgttagatcatggtttattatccacaacctgtggataactttgtgaataagagaagttgctaaagaaggagatatataacgatgaagaaaatcaaaccgcatggaccgttaccaagtcagactcagctagcttatctgggagatgaactagcagcttttatccacttcggtcctaataccttttatgaccaagaatgggggactggacaggaggatcctgagcgctttaacccgagtcagttggatgcgcgtgagtgggttcgtgtgctcaaggaaacgggcttcaaaaagttgattttggtggtcaagcaccacgatggctttgtcctttatccgacagctcacacagattattcggttaaggtcagtccttggaggagaggaaagggcgacttgctccttgaagtatcccaagctgccacagagtttgatatggatatgggggtctacctgtcaccgtgggatgcccatagtcccctctatcatgtggaccgagaagcggactacaatgcctattatctggctcagttgaaggaaatcttatcaaatcctaactatgggaatgctggtaagttcgctgaggtttggatggatggtgccagaggagagggcgcgcaaaaggttaattatgaatttgaaaaatggtttgaaaccattcgtgacctgcagggcgattgcttgattttttcaacagaaggcaccagtatccgctggattggcaatgaacgagggtatgcaggtgatccactgtggcaaaaggtgaatcctgataaactaggaacagaagcagagctgaactatcttcagcacggggatccctcgggcacgattttttcaatcggagaggcagatgtttccatccgtccaggctggttctaccatgaggatcaggatcctaagtctctcgaggagttggtcgaaatctactttcactcagtagggcgaggaactccactcttgcttaatattccgccgaatcaagctgggctctttgatgcaaaggatattgaacgactttatgaatttgcgacctatcgcaatgagctctataaagaagatttggctctgggagctgaggtatctggtccagctctttccgcagactttgcttgtcgccatttgacagacggccttgagaccagctcttgggcaagcgatgcagacttgcccatccagttagaactcgacttaggttctcctaaaacttttgatgtaattgagttaagagaagatttgaagctagggcaacgaatcgctgcttttcatgtgcaagtagaggtggatggtgtctggcaggagtttggttcgggtcatactgttggttacaaacgtctcttacgaggagcagttgttgaggcacagaagatacgtgtagtcattacagaatcacaggctttgcctttgttgaccaagatttccctttataaaactcctggattatcaaaaaaagaagttgttcaggaactagcatttgcagaaaaaagcctagctgtggcaaagggagaaaatgcctattttacagttaagcgcagagaatgtagtggtcctttagaagctaagatttcgattcaaccggggacaggtgtccatggtgtcgcctatcaggatgagattcaagtccttgcgtttcaaactggtgagactgaaaaaagtctgacgctaccaaccttgtatttcgcaggagataaaaccttggatttctatctgaacctaacggtggatggtcagcttgtggatcaacttcaagtccaagtttcataaaagaagaacctttgcgcgatgcaaaggttcttttggttattagtgacttggtaaccagctgagggtgaaagttagttgttcagcttttaagaggtcttggtgttgaatagttgatacgagtgttttgtccagtcggcattctttgacaaagttaaaatggttgtggttttgtttagtatggatatccagccatttatcttctttagcgaggtagactcgtagatggtcaaagagagggattccgaggtcatagcttggttttcctggacaggttggataaaatccgagagctgaccagatgtaccaagcagagagactaccattgtcttcatctccaggataggcttcccaacttgggtgaaaagctttctgacggagcgtcttgataagaagggcagtgtagtcagggtaatcgctgtaacggaagagataaggaatgtggaaactaggctggttggaaatggctatttgtccaaaaggagcagtagccatctcgctcatttcgtgaatttcgtaaccatagcctgttgtttcaaagaggggagcatcttgacaggctttcaaaagatagttgctaaaggtttcttttccacccatcagttggattaagccagggatgtcgtggagaacgcctaaagtagcttgaatggcagagcattcagcgtagtctcgcccccaactataaggagagaagtcagggtgaaagtttccttgattgtctcgtgctcgcatgtaacctgtctcagcgtcaaatagctggcggtaattttgtgaagcagccttgtaggtttcagcgatttctatgttctctagttttttggcacagctggcgatacaaaagtcactataggcatagtctagagtatggctaacactttcgtggtggtcggtagagaggtaacctagttcttggtattgggctagtccgtggcggccattgatgccgagagggtcggctttgctggctgtttcgagcatggcttggaagagttctccttctaggtcgggggtcatgtccttgcaggcgctatctgcgataataccgtctaaaagtgtacctggcatcataccccgttcatctggagccagccattttggaaggaaaccagtatcgcggtagctattgaggaaaccttctaaaaagcgttgatagtgctccggtatgataagggcaaagagggggaaggtggtgcggaaggtatcccagaaaccattgttgctaaagaggacaccaggcttgacagtaccagtagccagatccatgtggatggcttgccctgattcattaatctcataaaaagtctgtgggaagaggaagagtctgtagaggcagtggtcaaagaaggttcggtcagcctctcctgtctctataatgtcaaaacgatggaggagattttcccaatccacttgggcacttgatttacagctatcaaaatcttcttgaggtagattgattagagcttgagaaggagagatgaaagaagtggctagttgcatctcggtttgactacttgctaagtcaattcgccagtctccagcttcttggctgatagcaagaatatccgtgttcatttgcagggcagtgaacatcgttagcgaatttttgttagtttcagttttaccttcttgtcgcagggcaagagtccgcttatctacttgctctactgtcagttcatctgctgcgtgaagatagagggagagggctttgccttgcttttgattcaaacgaatagaagcaccatagcaagtcggtgtgagctgggtttcaatctgataacgcagagaaaagagcttcaaatagtgaggctggaagcaagctttatctatatcataagaagactggcggtgaaagaggctgtctccccccagttgactggtgacaggtgtcagaaggagccaagagtagtccccaatccaaggactgggctggtgagttaatcgaatcccctgaaagataggcagatgtggatcaaaaaaccaagatccatcctggtcactggtctggggcacaaagtaattcatcccaaaaggcacgcctgtgtatggcagggtatttccccgagaaaaggcatgcttgttggtagttccaaaacgggtatcgatggtatcaagtagtggtttcatagtctttcctttagctgtttttctacattatatcagtaatagagggcctttag

SEQ ID NO: 101 - DNA, 2727 bp; double-stranded, linear
ctggttcaattattattcactctaagtagtcatatgttctttatttatgtgagtttttaccttttaaaggatcttgttagatgggagaaggttttaaaagtgacagatgataatacaagaaaagttcgtttattagtagccttttttagcattgtcataggctacatcctgagttctttctttattagcctgtatcatttgtggcaagaagcgcttagaggattattatgaaatcaagagtaaaggaaacgagtatggataaaattgtggttcaaggtggcgataatcgtctggtaggaagcgtgacgatcgagggagcaaaaaatgcagtcttacccttgttggcagcgactattctagcaagtgaaggaaagaccgtcttgcagaatgttccgattttgtcggatgtctttattatgaatcaggtagttggtggtttgaatgccaaggttgactttgatgaggaagctcatcttgtcaaggtggatgctactggcgacatcactgaggaagccccttacaagtatgtcagcaagatgcgcgcctccatcgttgtattagggccaatccttgcccgtgtgggtcatgccaaggtatccatgccaggtggttgtacgattggtagccgtcctattgatcttcatttgaaaggtctggaagctatgggggttaagattagtcagacagctggttacatcgaagccaaggcagaacgcttgcatggtgctcatatctatatggactttccaagtgttggtgcaacgcagaacttgatgatggcagcgactctggctgatggggtgacagtgattgagaatgctgcgcgtgagcctgagattgttgacttagccattctccttaatgaaatgggagccaaggtcaaaggtgctggtacagagactataaccattactggtgttgagaaacttcatggtacgactcacaatgtagtccaagaccgtatcgaagcaggaacctttatggtagctgctgccatgactggtggtgatgtcttgattcgagacgctgtctgggagcacaaccgtcccttgattgccaagttacttgaaatgggtgttgaagtaattgaagaagacgaaggaattcgtgttcgttctcaactagaaaatctaaaagctgttcatgtgaaaaccttgccccacccaggatttccaacagatatgcaggctcaatttacagccttgatgacagttgcaaaaggcgaatcaaccatggtggagacagttttcgaaaatcgtttccaacacctagaagagatgcgccgcatgggcttgcattctgagattatccgtgatacagctcgtattgttggtggacagcctttgcagggagcagaagttctttcaactgaccttcgtgccagtgcggccttgattttgacaggtttggtagcacagggagaaactgtggtcggtaaattggttcacttggatagaggttactacggtttccatgagaagttggcgcagctaggtgctaagattcagcggattgaggcaagtgatgaagatgaataagaaatcaagctacgtagtcaagcgtttacttttagtcatcatagtactgattttaggtactctggctctaggaatcggtttaatggtaggttatggaatcttgggcaagggtcaagatccatgggctatcctgtctccagcaaaatggcaggaattgattcataaatttacaggaaattaggctggagaaccagcctttttctaaagataaggagaaatatgaacaaaaaaacaagacagacactaatcggactgctagtgttattgcttttgtctacagggagctattatatcaagcagatgccgtcggcacctaatagtcccaaaaccaatcttagtcagaaaaaacaagcgtctgaagctcctagtcaagcattggcagagagtgtcttaacagacgcagtcaagagtcaaataaaggggagtctggagtggaatggctcaggtgcttttatcgtcaatggtaataaaacaaatctagatgccaaggtttcaagtaagccctacgctgacaataaaacaaagacagtgggcaaggaaactgttccaaccgtagctaatgccctcttgtctaaggccactcgtcagtacaagaatcgtaaagaaactgggaatggttcaacttcttggactcctccaggttggcatcaggtcaagaatctaaagggctcttatacccatgcagtcgatagaggtcatttgttaggctatgccttaatcggtggtttggatggttttgatgcctcaacaagcaatcctaaaaacattgctgttcagacagcctgggcaaatcaggcacaagccgagtattcgactggtcaaaactactatgaaagcaaggtgcgtaaagccttggaccaaaacaagcgtgtccgttaccgtgtaaccctttactacgcttcaaacgaggatttagttccctcagcttcacagattgaagccaagtcttcggatggagaattggaattcaatgttctagttcccaatgttcaaaagggacttcaactggattaccgaactggagaagtaactgtaactcagtaaaagatacgcctacactcctatgtcacttatggatgtaggagttctttttactagtttaagcaggactaagacaggtactaagacaaaatagcaacttctaaaactaacttccagttttgggagagagatggaagttactttgaga

SEQ ID NO: 102 - DNA, 5717 bp; double-stranded, linear
ttttttgtagatttaagtggggtgcaattcctaaaaaataaaaaacaatttttgaaaattatgttagcaggaattgcttcaaattcgattttatcacttacaggtttacttgttttattgttcacatcgtataaattgcttggactcttattttttatcattaacttaggtatgatttttattaattcaattcctttttttcagtatgatagtggtattattttaagatacttgaattctaacaataataacttgaattttcaatatatagttcaacttttaatagcatttgttattatttattttcctttgagtcaactattacagtttttgacacccaatattattgttcgtagtataggaggggtggttgtttctatactgctttctatattatatatgataggaaggacgaaatatgttctacgtaaatagttatgtttttgcttataaaaaagaaggtataatgtatttacgtggtcggagtatgcgggaaatagctatagaacctcaaatttcgcaagaatttatcaacgatctatttaatagttgtaaggaactattagagatagaagaagtattaggcagtaaactaacatttgaactataaatgaacaaattttaatttcggatgagatagatattgatagtagatattctagaactaaaggttactattcgttattttataatgaagagtataataaaatacagaataaaacagtattagtattaggagcaggagtcttaggatgttatatatctctaagtctaagtatgtatggagtgaggaaacttattgtcgctgattacgatataatagaaccatcaaatttaaataggcaaattctttatacagagtcggatgttggtaaggagaagattaatgttctttctgaaaaaatacacaagtataattcagatgttcaggtagtacctatttctattaaagtttcttcagtagaagaattagaaaaaattgttgcggaatatgggagtatagattttatcgttaaagcaattgatacgcccattgatattataaaaattgtcaatcaatttgctgtatcgcataagatatcctacatatcaggagggtttaatggatgctatcttattattgataatatatatatccctaccatcggttcttgctttggttgtcggaatataaacaaagatataaataagtacactttatctgataagacaaagtggccgactacaccagagatgcctgctattttgggagggataatgactaatttaataattaaaatatttctgggatgttataatgaaatcctaatagataacgcttacgtttataatatgagaaatcatgctctaagtcaagaaaaatatgttctggaaaacggagaatgtccaatttgtaaaaaaataataaagtgaaagataacaatattagagcgaaaacatttattcgttcagtttgtttttgcttattatcaggaggagtagcttttttatctgctattgggcagttcactgttatagaaacacaattaatagtattgttcttgggtattatttttgctatatattatgcttactacaataaaaatattcaaacatcattggaaaatatagtatggcttttttcatcgtttgagattttatttttgcttgttaattttagaacatttattcagttaccagtggatatttttattggtatgataatatttttaatgctgtggatatttattatgttaggtatagtgtgtcttagttattatataactttattatttagcaaggaggcttagtatgtttaaaaaaataggtataatgagcatttgcatatatataattattttatactgcttgagaatgtatcgtattatcaataatattgaaacaatcttgctaacggttatatgcttaatgttattgttttttttaagacgtttatttgataaagataagtaaatagatgttaagtaaaaatgtagaatataaaggaggtgcaatgagtatgattgaagttagccatttatcaaaaagttttggtgataaaatagctttaaataatataagcttcactgttaaagaaggttagatttttggatttttagaaccatctggttctggaaagaccacaacgattaatattctgactgggcagttccttgccgataaaggacaatctattattttgggacaaaaatctcaaaatttaacaagcggtgaattaaagagaattggattggttagcgatacaagtggattttatgagaaaatgtctctgtataacaatcttcttttttatagtaaattttataatattagtaaatcacgtgttgataatttgttaaagcgagtaggattatatgatagtcgcaagatggtagcaggaaaattatccactggaatgaggcaacgaatgcttttagcacgagctcttatcaacaaccccgctgtactctttctggatgaaccgacctcaggtctagatcccacaacttctcgaacaattcatgagttaattttagaattgaaaacagcagggacaacgatttttctaacgactcatgatatgaatgaagcaactcttttatgtgattatgttgccttattaaataaagggaaattagttgagcaaggagctccttctgaactcattcaaagatataataaagataaaaagattaaggttacagattataatgggaatcagataacttttgattttacatcactagaacaggtatctcagactgatctggaaaatattttttcaattcattcatgtgagcctactttagaagatatttttatcacattaacaggaggaaagctaaatgcttaaacggtttctggctttggtatggttgcgttgtcaaatcatcctttccaataagagtattttattgcaagttttagtgccttttgctttcacatatttttataaatatcttatggaaacacaggggaaggtcaacgatcaacaggcattagttcttttgatgatgtgtttacctttttctttttctttggctgttggaagtcctataactattatcttgtctgaagaaaaagaaaagtacaatttacaaactcttctgttgagtggtgttaaaggctccgaatacattttatcaactatgtttcttccttttttgctaacttttgtgattatgggaactactcctcttattttaggagttacaattgtacatacttttaattatattacaatcgttcttctaacctctttatccatcattttattctatttattgataggtttaaccgcgaagagccaagtagtagctcaggttatcagtcttcctgctatgattttagttgctttcttaccgatgctatctggtttggataagacagttgcgaagataacagattatagttttatgggactatttactaagtttttcacaaaatgggaggaattttcatggaataaaactctaattcctaatctaacactacttatttggattgttcttctattaactttaattacgataactattaggaaaaagaaaatttcttaattgagttattttaatgattataaacacaagtgggaaggaaaaaatgaactgatctttttgacagcaattctacagaatagtcttattgctatattttgatttgagtgtacgaaaaaagaaaaataacaatagtgctcatactaattgcagaagttttgggtgataagataactgataaattgcaataaaaaatgcaacatttttaaatctcctctataagtgcttcaaaaagtgcttcaaaacctgtcttgtaatccaagtatttttggggacggtgattaataagctagcaaagcatcattaaggattttttcggtaattgttgccaaatcggtttaagaaaatactcacgaagaagtccattcgcattctcattacttcccctttgccaagatgaataggcatccgcaaaataaaacagaattcccatttgttcaattaaagggtaacaagcaaactctttttctctgtccgaagtgaaagtctttaactattcttttggaaagagtcttgtgaggtgttcaatagcagtcaacatggatttagctgtttttacttgacaagtgctagtagaaataatagaatagtaaaaaacctttaaagcagtccagagaggcagctaaggttagacggtgaaagggtggagactacccatttttcgtggaaccttgctgttggcaggttccttttttcgtggcttctgttggccagactctctcactagtaaaggtaaaaggagaaacctatgcgagaacatcgtccaatcattgctcttgattttcctagttttgaggcggtcaaggaatttttagctcttttcccagcagaagaaagcctttatctcaaggtagggatggagctttattacgcagcggggcctgagattgtgtcctacttaaaaggtttgggtcatagtgtctttttggatctcaaacttcatgacattcctaatacagtcaagtcagccatgaagatcttgtctcagcttggtgtcgatatgactaatgtccatgcggctggtggtgtagagatgatgaaggcggcgcgtgaaggtcttgggagtcaagccaaattgatcgctgtaactcagctcacatcaacgtcagaagctcagatgcaggagtttcaaaatatccaaaccagtctgcaagagtctgtgattcactatgccaagaagacagctgaagctggcttggatggtgttgtttgctcggctcaggaagtacaagtcatcaagcaggctaccaatccagattttatctgtctgacaccagggattcgtccagctggtgttgcagttggagatcaaaaacgagtcatgacacctgctgatgcctatcaaatcggcagtgactatatcgtagtgggacgtcccattacccaagctgaggatcctgttgcagcttatcatgccatcaaggatgaatggacacaggactggaattaaagaactagattagaaaaataaaaggagaataccatgacacttgctaaagatatcgctagccacctcttgaaaatccaagccgtttacctcaaaccagaggaacccttcacttgggcatctggtatcaagtcaccgatttacactgataatcgtgtgacactagcctatccagaaactcgtaccctaattgaaaatggttttgtggaagctatcaaagaagcctttcctgaagtagaagtgattgcaggaactgcaacagcagggattccacacggagccattattgctgataagatggacttgccttttgcctacatccgtagtaaaccaaaagaccacggagctggtaatcaaatcgaaggtcgcgtagctcaaggtcaaaaaatggtagtggttgaagaccttatttcaacgggtggttcagttcttgaagctgtagcagcagccaagcgagaaggagcagatgtacttggagttgtagcgattttcagctaccaattgccaaaagcagataagaactttgcagatgctggtgttaaacttgtgacgctttcaaactatagcgagcttatccatctagcccaagaagaaggttacatcacgccagagggccttgatcttctaaaacgctttaaagaagaccaagaaaattggcaagaaggttaggtcagtaagataaagagagacgaggctaccgagtctcttttaccattttatttaaaatatgacag

SEQ ID NO: 103 - DNA, 5558 bp; double-stranded, linear
cctggactttctaaaatgaaatcttgcgacctggatcaagcccttcatgagcatttttcagaagaagaattagctggtcactttcatgtccttctatggactttttttacaatggcattgctatcacacccaatacctatctaagcgcctggttcgtaaactttattgcagctcttcctctaaatttcctaattgttgaaccaattgcccgttttatactaagttcttttcagaaaccatttactggggaagaagttgaagattttcaagatgatgatgaaatcccaactattatctaagccagttctgtaaactactaatatttgaaatccacttccttttagggtgcaatggttataaatgaatttttgagaggatcagaatgaaaaaactagcaacccttcttttactgtctactgtagccctagctgggtgtagcagcgtccaacgcagtctgcgtggtgatgattatgttgattccagtcttgctgctgaagaaagttccaaagtagctgcccaatctgccaaggagttaaacgatgctttaacaaacgaaaacgccaatttcccacaactatctaaggaagttgctgaagatgaagccgaagtgattttccacacaagccaaggtgatattcgcattaaactcttccctaaactcgctcctctagcggttgaaaatttcctcactcacgccaaagaaggctactataacggtattaccttccaccgtgtcatcgatggctttatggtccaaactggagatccaaaaggggacggtacaggtggtcagtccatctggcatgacaaggataagactaaagacaaaggaactggtttcaagaacgagattactccttatttgtataacatccgtggtgctcttgctatggctaatactggtcaaccaaacaccaatggcagccagttcttcatcaaccaaaactctacagatacctcttctaaactccctacaagcaagtatccacagaaaattattgaagcctacaaagaaggtggaaaccctagtctagatggcaaacacccagtctttggtcaagtgattgacggtatggatgttgtggataagattgctaaggccgaaaaagatgaaaaagacaagccaactactgctatcacaatcgacagcatcgaagtggtgaaagactacgattttaaatcttaaaaaccaaaaaaatacagtatccacattcggtactgtatttcttttactctcattcttaagttaaattattaaaatcccatatttggtctatccagccttcataaaagtctggctcgtggcagaccataaggatagatcccctatattctttgagagcgcgtttgagctcatcctttgcatccacatccaaatggttggtcggctcgtccagcactaaaacgttgttttcacgattcatcaagagacagaaacgaaccttggcttgctctccccctgataatacttgaatctggctttcaatatgtttggttgtcaaaccacaacgggcaagggctgcacggacttctgcttgattaagggcaggaaaggcattccagacagcttcaagaggagtttggcgattaccgccttctacttcctgctcaaaataaccaagttctaaataatctccacgctccacttccccagcgattggcgagataatgcccaagagactcttcaagagagttgtttttccaataccattagcaccaataatcgcaaccttttgattgcgttcgaaggtaagatttaaaggcttagtaagaggacggtcgtaaccaatttgcaagttcttggcttggaagataaagcgccctggtgtacgagctggtttgaaatcaaaggatggttttggtttctcactttggagttcgataatatccatcttatccaatttcttttgacgagacatagccatattacgagttgcaacacgggctttattacgagccacaaagtccttgaggtctgcaatctctttctgctggcgttcgtaggctgcctctagctgagatttcttcatagcataaacttcttggaactggtagtagtcaccagagtaacgcgtcagctgttgattttccacatgatagacaatattaataacgtcattgaggaatggaatatcgtgcgaaatgagaacaaaggcattctcatagttttggagatagcgcttgagccaatcaatatgctcagcatccaagtagttggtcggctcgtccaacagcaagatatcaggcttttcaaggagaagttttgccaaaagcaccttggttctttgcccacctgacaaagaagttacatccgtatccatgccaaagtccataacaccaagagcacgcgctacttcgtcaatcttagcatccaaggtatagaaatcacgactctccagacggtcttgaagttctcctacttcttccatgagagcatcaacatccgcgccgtcttcagccattttcatatagaggtcattgatacgagcttcagctttgaaaagctcatcaaaagccgtacggagaacatcacgcaccgactgtctttcagcaaggacagagtgctgatccaagtaaccagccgtcacatatttggaccactcaacctttccttcatctggcagcattttaccagtcacgatactcataaaggttgattttccttcaccattggcaccgaccaggccgatatgttctcccttgaggagacggaaggacacatcttcaaaaattgcacggtcaccaaaaccgtgactcagatttttaacttctaaaatactcattttaattccttaccttgtttttatgtaatcgtttataaaggagccaagccagatagccacccaaagtgttggtccacaaatcatcaatctcaaagacgcgattgaaatcaaagaaaaagtccaagattaattgcgtacactcgattccaagactcacaagaaaactaaaaagaaggaccttttttgttttccgcaaatttggaaatagataaaggagttggaaaatcagaggaaaaaacaagaagacattgaggatattttgtaaaaaaatccaacataattgtccaatgtcactcacttcgcccagtttccagagagaattgaaaggagtcaaaagaaaaaccaggcgtccaagatgctgaatacctggagttcccactcccacggtagattgttcttgaggagtaaagcaaaaacagacaatgcaaatgctatagaaaatgactccccagaccaaaatatgattataagtcttcttcatcattaaggatttaccgctgcgactgccttctggcggtcacgtttcattgtgttagagcgcaattgtccacaagctgcgtcaatatctgtaccatgctcttgacgaaccacacagttgaccccttttttcttaagcgtatcatagaaagccaacacgcactctttgggactacggctatattggtcatgctcactaactgggttataaggaatcaagtttacataagacaatttcttgatgttcttgagcaattcagtcaattccaaggcttgttctacaccgtcgttgacttcattaagcatgatatattcaaaggttacacgacggtttgttgtctcaatgtagtattcaatagcagcaaagagtttttcaatcggaaaggcacggttaatcttcatgatacttgaacgaagttcattgttaggtgcgtgaagagacacggcaagattgacctgaaccccttcatcagcaaagtcacgaattttatgagccaaacctgaggttgaaaccgtgatgtgacgagcaccgatagccattcctttatcatcattgatagtacgaaagaaattcaagacattgttgtaattatcaaagggctcaccgattcccatgacaacgatatggctgatgcgttcatcctgaccacgctcatcaaagtatttctgaaccagcatgatttgcgctacgatttcaccgttattgaggtcacgttgcttcttaatcaaaccagaggcacagaaggtacaaccgatattacagccgacctgagtggtcacacagacagataaaccatagtgttgacgcatgagtacagtctcaattaacataccgtcgggcaattcaaagagatatttgactgtaccatcagcagactcttgcacaatacgttgtttcaagggattgaccacaaactggtcattgagcttagcaatcaaatccttggaaaggttggtcatttcttcaaatgactgcacacgtttacggtagagccattcccagatttgatctgcacggaatttcttttctccctgctccaatacccattcctgcatggtttgatgtaccaaactatgaattgagggtttcatttcttctccttattctctactcacttctgacgaatgacaaaatgacgttgtcccttgtcgtctttctgacgacgtctatttttcttatctgcattcgactttcgtttagtttgagtcggtttctttccttttctagaaggtgtttcttcttccgtcttacgcattttcttgtcaaatgatgctcgcttaggggcttcattttctaagacaaaataggcacaaccataactacaatactctaaaaggtagtcttgtaaacgactgattttttcaagtttttcttctgttcggtcatccttgtaaaaacctcgtaggcgaagctgttcgttgctccagtcccccacgatataatcaaacttggttaatacttctgaaaaacgctgattaaaagtcgtcacatcaaaggcatccttgatattttcaaccaaggaaaaagctatcccttccgtttcgaccttgtccccgtgtaaatggaactccggaccaggaaacttgttatagttgtataattcaggtgcaatttcttttcgcatagatatccttttttcacgattacttaatactttattctaccataatttctagcagttagcacgtttctcataaaaatgaaaaaagtctgacgattttgtcagaccagaatcttataacctaaaaagagaagaacaattcttccctccaactatcattatttagcagctgcgtacaattcatctactttattccagttgattactgaaaagaaagctttgatgtagtcaggacgcacgttgcggtatttcacgtagtaagcatgttcccaaacgtccaagcccaagattggttttttaccttctgagattggtgtgtcttggtttgctgttgaagtcacttcaagtttcccttctttgttgacaaccaaccatgcccaacctgaaccaaaacgagttgttgctgctgcagtgaaggctgcttggaattcttcaaatgaaccaaatgttgcatcgattgctgctgccagttctgctgaaggagctgttttctcgggagtcatcaattcccagaaaagagcgtggttcaagtgtccgccaccattgttgataagtgcttgacggatatcagctgggatagattctacatcagcaagcaaggcttcaaggtcttcaccgatttcagggtgtttttctaaagctgcattggcattgttgacataagtttgatggtgtt

SEQ ID NO: 104 - DNA, 6735 bp; double-stranded, linear
ggaattgtaaatatcatattgtttttgcacccaaatatcgtcgtcaaatcatttatggcagatacaaagctagtatcggaagaatcatacgtgacttatgtgagcgtaagggtgtaataatccatgaagcgaatgcttgttcagaccatattcacatgcttatcagtattcctccgaaacttagtgtttcgtcctttatgggctatttaaagggcaagagcagtttgatgatttttgataagcatgcgaatttaaaatacaaatatggcaatcgcaagttttggtgtagaggctattatgtagatacggtaggccgtaatcagaaagtgatagctgaatatattcagaatcaattacaagaagacagagtagcagaccagctcacgttattcgagtcagtagatccgtttactggcgaaataaataagaggaagtaactaaggtgctttagcacctgctcgggaaagtggtgcgcgaggaagctatttcggtgggcctttggccctggccggtagaagcggcttatagccgcagaacaaaccaccagttcacactggtggttttgatttaaaaaacttgatacataaaaataaaagtctatataaaggatggtaaaattcctgttgtccgatttggacaatatcctaaatagttacaatatatggtctatactttttcttaggagaaagctagatgtacagacgtttgagagatttgagggaggatcatgatctgccccaaaagcaaatagctacaatactttcgtttacaaattcagcttatgccaaaattgaacggggtgagcatgcgttgacggctgatgtattggttaaactctcagatttctatgacgtcagtacagactatttattgggattaactgattttcctgataaaattcgctttagaaaataatctcctcaatttcatagagtttgaaaatgagtgagattttttatttgccctttgacaactgaatagcctaaaatggtactttcctcatttgtggagcaaatttgaatggctcgccatgataagagcgattttaaaatcatcaataaaatagagcgatactttatatgccatgatacaaatgatatacaatgatacttctgaccgttcagcctgccaacgtaaaagagcagcaagtgaaattcttatgatgacttcatcagtcatgccacgttgaatgtgtgagtttgttagataaacgcaattaatcctcaaaaggttccccgaaccttttgagttctacagacgcatcacgtggagtgtgtaagcttgttgctaaaagcgtaaaaaccttggaacgaaaggaataatagactttctgcgaaacaaaaatataatacaataaaactatgaatgatgaagcaagtaaacaattgagcgatagccgtttcaagatccttgtaggtgttcagcgcacgacttttgaagagatgttagctgtgttaaaaacagcttatcaacgtaaacgcgcaaaaggtggacgaaaaagcaaattaagcctagacgatctccttatggtaactattcaatacatgcgagaatagagcacttatgaacaaattgcggctgattttggcattcacgaaagcaacttaatccgtcggagtcaatgggttgaagcaactcttattcaaaatggttttacgatttcaaattctgccttaattctgtaaaaacagtaaaattcgaaggattgtaaggtaagagtttttttctttctgaaaaaatggtataatagcaatcaaaactagaaaataaaacggaatttggaacagatttgtctgtatcctagtagagtggtgatactatgaagattagtaagaggcacttattaaattattccatcttgattccctacttgcttttatctattttgggcttgattgtggtctattcgaccaccagtgctattttaattgaagaaggcaagagcgccttgcagttggttcgaaaccaaggaatcttttggattgttagtttgatactgattgccttaatttataaattgagactagattttttgagaaatgagcgactaatcattttagttatattaatagaaatgcttttattgttcttggctcgttttattggtatttccgtaaacggggcatacggttggatttcggttgcaggaataactattcagccagctgagtacttaaaaatcattattatttggtatttagctcaccgattctccaaacagcaagaagaaatagctacttatgattttcaagttttgactcaaaatcaatggcttccccgtgcttttaatgattggcgattcgttctcctagttctgattggaagtttgggaattttccctgatttaggaaatgcgactattttagtcttggtttccttgattatgtatacagttagtggaatcgcttatcgctggttttcaaccattctggcgctcgtatctgccgcttctgtctttgtcttgaccactatcagcctaatcggtgttgagaccttttcaaaaattccagtattcggctatgtagccaagcgctttagtgccttttttaatccttttgccgatcgtgctgatgcaggtcaccagttagctaattcttattttgccatggtcaatggcggttggtttggtctaggtcttggaaactcgattgaaaaacgaggttatttgccagaagctcatacagactttgtcttttctatcgtgattgaagaatttggctttgttggtgccagtcttattttagctctcttgtttttcatgattttgcggattatcttggtcggtatccgagcggagaatcctttcaatgccatggttgcactcggtgtcggagggatgatgttggttcaggtatttgtcaatatcggagggatttcgggcttgattccatctacaggagtgactttccccttcttatcccagggtggaaatagtcttctagtcttatcagtggcagtagcctttgtcttaaatattgatgccagtgaaaaacgcgctaaattgtaccgagaattggaaaatcaaccaatgaaccttctgttgaagtaggataaagaaaggatagtttatgtctcttcaaaaattagaaaattatagtaataaaagtgttgtgcaagaagaagtcttgattctaacagaattactggaagatattactaaaaatatgcttgccccagagacctttgaaaaaataatacagttgaaagaattatcaacgcaggaagattatcaaggtctaaaccgtctagtgactagcttatcaaatgatgaaatggtctatatttcacgctatttctctatcttgcctcttttgattaatatttcagaggatgtggatttagcttatgaaatcaatcatcaaaataatattgatcaggactatttaggtaaattatctacaacgattaaattggtagcagaaaaggaaaatgccgttgagatcctagaacacttgaatgttgtccctgttttgacagcccatccaacacaagtgcaacgcaaaagtatgttggatttaacaaatcatattcatagtcttttgcgtaaataccgtgatgttaagttggggttgatcaataaagataaatggtacaatgatttgcgtcgttacatcgaaattatcatgcagacagacatgattcgtgagaaaaaattaaaagtgactaacgaaatcacgaatgctatggaatattataacagctcctttttgaaagctgtacctcatttgacgacggagtataagcgcttagcgcaagcgcatggtctgaatttaaaacaggctaaaccaatcaccatgggtatgtggataggtggtgaccgtgatggaaatccatttgttacagcaaagaccttgaagcagtctgcactcactcagtgtgaagtcatcatgaactactatgataaaaagatttaccaactttatcgtgaattttctctttcaactagcattgtcaacgtcagcaagcaagtcagagaaatggctcgtcaatccaaggataactcgatttaccgcgaaaaagagctttaccgtcgtgccttgtttgatattcaatcaaaaattcaggcaactaaaacctatctgattgaggatgaagaagttgggactcgttatgaaaccgccaatgatttctacaaggatttgattgccattcgagattctctactagaaaataagggcgagtccttgatttcaggtgattttgtggaattattgcaggcagtagagatatttggtttttacttagcatcaattgatatgcgacaagactctagcgtctatgaagcctgtgtggcagaactcttgaaatcagcaggaattcattctcgttatagcgagttgagcgaagaagaaaagtgtgaccttctcttgaaagaattagaagaagatccccgaattctttctgcgactcacgcagaaaaatcagaattattagcaaaagaattagctatttttaagacggctcgtgttttgaaagataagttgggagatgatgtcatccgtcagaccatcatttcacatgcaaccagcctttctgatatgctagaattagctattctgttaaaagaagtaggactggtggatacggaaagggcgcgtgttcagattgttcccctttttgaaacaattgaagacttggatcattcagaggaaacaatgagaaaatatctttctcttagccttgccaaaaaatggattgactcacgaaataactaccaagaaatcatgcttggctactctgacagtaataaagatggcggttacttgtcatcatgttggaccctctacaaggctcaacaacaattgactgctattggagatgaatttggcgttaaggttaccttcttccatggtcgtggtggtactgtcggtcgtggtggtgggccaacctatgaagccattacatctcaaccgctcaagtctatcaaggatcgtatccgcttgacggagcagggtgaagtaattgggaataaatacggtaacaaagacgccgcttactataaccttgaaatgctagtatcggcagctattaaccgtatgattactcagaagaagagcgataccaataccccaaatcgttatgaaaccattatggatcaagtagtggaccgtagttacgatatctaccgtgatttggtctttggtaatgagcatttctatgattatttcttcgagtcaagtccaatcaaggctatttcaagttttaatattggttctcgtccagccgctcgtaagactattactgaaatcggtggtttgcgtgccatcccttgggtattctcatggtcacagagtcgtgttatgttccctggatggtacggggttggttcaagcttcaaggaatttatcaataaaaatccagagaatattgctatcttacgagatatgtaccaaaattggcctttcttccaatcgcttctttcaaatgttgatatggttttgtcaaaatcaaatatgaatattgcttttgaatatgctaaactttgtgaagacgagcaagttaaggccatctatgagactattttaaatgaatggcaagttactaagaacgttatcttggctattgaaggacatgacgaactcttagctgacaatccatatctaaaagctagtctggattaccgtatgccttactttaatattctcaactatattcagttggagttgattaaacgccaacgtcgtggagaattgtccagtgatcaagaacgattgattcatatcaccatcaacggaattgcgacaggattgcgtaattcaggttgataattttcaagagtgaatgctaaaagtgaatatcaaaaaaattctaatagactattgacaagtagtttaaaaatgatataatttaaccattcagaaaagtaatcatacaaactttttagagagtctgtggtagctgaaaacagataagtggcaatgatgaaaattgggctgaatgctatttagaatttgaaattataaaaattcggtaagcacaccttacagtgcatctcgttattgcgagactgagcgatagggaaattccctataattgaggtggtaccgcgcatcgacgtcctcacacaagttttttgtgtgaggatttttttgatggaggttagtatggaaagaaaacgatggcgtcgcttgtttagataagtgaaatatgttaaaggaaataaaaaggagaaacagaatgaaaaataaacgtttaattggaattattgctgcattagcagtcttagtagcaggaagcttgatttattcttcaatgaataaatcagaagctcagaataataaggatgagaagaaaataaccaagattggtgtgcttcaatttgtgagccatccatcccttgatttgatttataaagggatccaagatggacttgcagaagaaggatataaagatgatcaagttaaaattgattttatgaactcagaaggtgaccaaagtaaggttgcgacaatgagtaaacaattggttgcaaatgggaatgaccttgtggttggtatcgcaacaccagcagcccaagggttggctagtgcaacaaaagacctaccggttatcatggccgctattacagacccaattggtgctaacttggttaaagatttgaaaaaaccaggtggcaacgttacaggggtatctgaccacaatccagctcaacaacaagttgaactcatcaaggctctgacaccgaatgtgaaaacaatcggagctctttactcaagtagcgaagacaattcaaaa

SEQ ID NO: 105 - DNA, 6516 bp; double-stranded, linear
ctagaggatcccagcaggtaaattggcttcagctggcaaaaaagttgccctcgttgaacgcagcaaggctatgtacggtggaacttgtatcaacattggttgtatcccaactaaaaccttgctagttgctgctgaaaaggacttgtcttttgaagaagtcattgctactaaaaacacgatcactggtcgcctcaacggtaaaaactatgcgactgttgctggtacaggcgtagatatctttgatgcggaagctcacttcctttcaaataaagtcatcgaaatccaagctggtgatgaaaagaaagaactgactgctgaaacaatcgtcatcaacactggtgctgtttcaaacgtcttgccaatccctggacttgctacaagcaaaaacatctttgactcaacaggtatccaaagcttggacaaattacctgaaaaacttggaatccttggtggcggaaatatcggtcttgaatttgccggcctttacaacaaacttggaagcaaggtcacagtcctagatgccttggatacattcctacctcgtgcagaaccttccatcgcagctcttgctaaacaatacatggaagaagatggcattgaattgcttcaaaatatccatactactgaaatcaaaaacgatggtgaccaagtgcttgtcgtaactgaagacgaaacttaccgtttcgacgcccttctctacgcaactggacgcaaaccaaatgtagaaccacttcaacttgaaaatacagatattgaactaactgaacgtggtgctattaaagtagacaaacactgtcaaacaaacgttcctggtgtctttgcagttggagatgtcaacggtggccttcaatttacttacatttcacttgatgacttccgtgttgtttacagctaccttgctggagatggcagctatacacttgaagaccgtctcaatgtgccaaatactatgttcatcacacctgcactttcacaagttggtttgactgaaagccaagcagctgatttgaaacttccatacgctgttaaggaaatccccgttgcagcaatgcctcgtggtcacgtaaatggagaccttcgcggtgccttcaaagctgttgtcaatactgaaacaaaagaaattcttggagcaagcatcttctcagaaggttctcaagaaatcatcaacatcatcactgttgctatggacaacaagattccttacacttacttcacaaaacaaatcttcactcacccaaccttggctgagaacttgaatgacttgtttgcgatttaagttgagatttaatcgtatcgaacagccctctttgggctgtttttacttctgcggaatctcaaatctgtctttctcctcttttatgatataatagaaacatgaacttaaaaactactttgggccttcttgctgggcgttcttcccacttcgttttaagccgtcttggacgtggaagtacgctcccagggaaagtcgcccttcaatttgataaagatattttacaaaacctagctaagaactacgagattgtcgttgtcactggaacaaatggaaaaaccctgacaactgccctcactgtcggcattttaaaagaggtttatggtcaagttctaaccaacccaagcggtgccaacatgattacagggattgcaacaaccttcctaacagccaaatcttctaaaactgggaaaaatattgccgtcctcgaaattgacgaagccagtctatctcgtatctgtgactatatccagcctagtctttttgtcattactaatatcttccgtgaccagatggaccgtttcggtgaaatctatactacctataacatgatattggatgccattcggaaagttccaactgctactgttctccttaacggagacagtccacttttctacaagccaactattccaaaccctatagagtattttggttttgacttggaaaagggaccagcccaactggctcactacaataccgaagggattctctgtcctgactgccaaggcatcctcaaatatgagcataatacctatgcaaacttgggtgcctatatctgtgaaggttgtggatgtaaacgtcctgatctcgactatcgtttgacaaaactggttgagttgaccaacaatcgctctcgctttgtcatagacggccaagaatacggtatccaaatcggcgggctctataatatctataacgccctagctgctgtggccatcgcccgtttcctaggtgccgattcgcaactcatcaaacagggatttgacaagagccgtgctgtctttggacgccaagaaacctttcatatcggtgacaaggaatgtacccttgtcttgattaaaaatccagtcggtgcaacccaagctatcgaaatgatcaaactagcaccttatccatttagcctatctgtcctccttaatgccaactatgcagatggaattgacactagctggatctgggatgcagactttgaacaaatcactgacatggacattcctgaaatcaacgctggcggtgttcgtcattctgaaatcgctcgtcgcctccgagtgactggctatccagctgagaaaatcactgaaacgagtaatctggagcaagttctcaagaccattgagaatcaagactgcaagcatgcctatattctggcaacttatactgccatgctggaatttcgtgaactgctggctagtcgtcagattgttagaaaggagatgaactaatggtttatacttcactttcctcaaaagatggcaattacccctatcagctcaacattgcccacctctacggaaatctcatgaatactacggggacaatggaaacatcctcatgctcaagtatgtggctgaaaaactgggagcccatgtgaccgttgacatcgtttctctccatgatgactttgatgaaaatcactacgacatcgcctttttcggtggtggtcaagactttgaacaaagtatcattgcagacgacctacctgctaaaaaagagagcattgacaactacatccaaaacgacggtgtagttctggctatctgcggtggtttccaactattgggtcaatattatgttgaagcttcaggaaaacgtatcgaagggctaggggtcatgggacactacacgctcaaccagaccaataaccgttttatcggtgacatcaagattcacaatgaagatttcgatgaaacctactatggatttgaaaatcaccaaggtcgtaccttcctctctgatgaccaaaaaccgctgggacaggttgtctatggaaatggaaacaacgaagaaaaggtcggtgaaggggttcattataagaatgtctttggttcctacttccacgggcctatcctctctcgtaatgccaatctggcttatcgcctagttactactgccctcaagaagaaatatggtcaggacatccaactccctgcctatgaggacattctcagccaagaaatcgctgaagagtacagtgacgtcaaaagcaaggctgacttttcttaaacaaaggaaaatgatatcaaagaactccgttatcttgtcggagttttttgtcttttcttttacccttctcccttgcattttctctcattttttgccaaaatagaggggtagaaagaaggtagcatatgtctaaattacaacaaatcctaacatatcttgaatcagaaaaactagacgtcgctgtcgtatctgaccccgtcacaatcaattacctcactggtttttacagtgatccccatgaacgccaaatgttcctctttgtcctagcagatcaggaacctctcctctttgtcccagctcttgaagtagaacgtgcaagtagcaccgtttccttcccagtagtgggctatgtcgattctgaaaatccatggcaaaaaatcaaacatgctcttccacaacttgacttcaaacgtgtcgctgttgagtttgacaatctcatcttgaccaaataccatggtttgaaaacagtttttgagactgctgagtttgacaacctcactcctcgtatccaacgcatgcgcctcatcaaatcagctgatgaagtgcaaaaaatgatggttgcaggtctttatgctgacaaggctgttcatgttggttttgacaatatttctcttgataagactgagacagatatcatcgcacaaatcgactttgccatgaaacgtgaaggttatgaaatgagctttgataccatggtcttgactggtgataatgctgcgaatccacacggcattccagcagctaataaggttgaaaatgatgctcttctcctctttgacctgggtgttctggtcaatggctatgcgtcagatatgactcgtacagtcgctgtcggcaaaccagaccaattcaagaaagatatttacaacttgactcttgaagcccaacaagctgctcttgactttatcaagccaggtgtgactgctcatgaagtggaccgcgctgcccgtgaggtcatcgaaaaagctggttatggtgagtacttcaaccaccgtctcgggcatggtatcggtatggatgtccatgaattcccatctatcatggaaggaaacgacatggtcatcgaagaaggcatgtgcttctctgttgaaccaggtatctatatccctggtaaagtcggtgttcgtattgaagactgcggtgttgttaccaaggatggcttcaacctctttacaagcaccagcaaagatttgctttattttgattaaactatatagcccctatgctttcctttcaaaatatctaggggctattttattgtcatttttctgctattatgctaaagaaattggctgcaataatctaaccctaagtgtctggaatgataacgagggtgctctccgcttttatcaaagacaagggatgaaaccccaagaaacaacaatggaaatgataattgattaagaagtcatctatcaaaagatgttagaaaaagttcaatttcactagaaaatgaggaaaatctccccacaataaaacgcatagtatcaggtattgtgtactgaccccaaacagttagacaattaatttatccgaaggatttagttctgtactgcacaggactaagtccttttagttttaccttaattcgtttgttgttgtagtaatcaatatagtctataatgacttgttccaattggttaagtgatttaaatgttttctcatagccataaaacatttcggattttaaaatgccaaagaaagattccatcataccgttgtcttggctgtttcccttgcgtgacatagatgcttgaattcccttattctctaggaaccgatgataagaatcgtgttggtattgccagccttggtcactatggagaatcgtattctcgtagtgcttctctttgaatgcctgttccaacattgtttgtacttattctaaattaggcgaacaagaaagattaaaagcaataatttcgctgttaaagccatctaaaactggtgataagtaaagcttttgagtacttgctggaatggcaaattcagtcacatctgtgtagcacttttccattgttttagagccttcaaattgggcttgaatgagattctctgccttcttaccaacgtctcctttatgagaagaatattttcgtttctttcgcattttagcttgtaaattgagtactttcatcaagccttgaactcttttatgatttaccagataaccacgatttcttagttctaaatgaacccggcgataagcataatttcccttgtgttcgataaagatggattgaatttcagttttaagctcttggtctttatctgttttgtctagctgtttcaagtgatagtagtaggtccaacgagctagtttaatggcttctagaagaagatctaacgaaaactcagtcattaattcttgaacaatttctgtctttcttctttctctttttcctccttcaatcggagttctcttaacttttttaggatggcattctccgctctcaggtactctccctcttgttttctcaacaatagtatacccgtttttcctgtattgtgctagccagttaagaagtatcgtacgacttgggagaccgtattcaagagaaactctatctttagtccagccttcatgtcagactttattaaccccaattattcaccccaaatctaaaaaccatccagaatccttgccttagcttagatcctggatggtttcttttttcacccaatgggtgttttttactagacaaaaaagagtttcccctttatggtataagtgtagaaaaaaacacaaaaagaaaggaaactcacatgaacagtttaccaaatcatcacttccaaaacaagtctttttaccaactatctttcgatggaggtcatttaacccagtatggtggtcttatcttttttcaggaacttttttcccagttgaaactaaaagagcggatttctaagtatttagtaacgaatgamcaacgccgctactgtcgttattcggattcagatatccwtgtccagttcctctttcaactgttaacaggttatggaacggaatatgcttg

SEQ ID NO: 106 - DNA, 14654 bp; double-stranded, linear
ttttcaacccatatcgtggctcctgaatactacttactgacaactatgctatcagagacttctctacttgttttctatatcattttcatccatagaaaacaactcatccacttgggacatatctttagctatactgttcgatactctctcttttcactttcctttgtagcaatttatttcctgattaatttcgtgtatcctgtagatatggtcattaatttgccatttttgattaatactggtttgattgtcttgctatcagctatctcttatattagtctacttgtcttcacaaaagatagcattttctatgaatttttaaaccatgtcctagccttaaaaaataaatttaaaaaatcataggagtttaaaatgaaacaactaaccgttgaagatgccaaacaaattgaattagaaattttggattatattgatactctctgtaaaaagcacaatatcaactatattattaactacggtactctgattggggcggttcgacatgagggctttatcccttgggacgacgatattgatctgtccatgcctagagaagactaccaacgatttattaacatttttcaaaaggaaaaaagcaagtataagctcctatccttagaaactgataagaactactttaacaactttatcaagataaccgacagtacgactaaaattattgatactcgaaatacaaaaacctatgagtctggtatctttatcgatattttccctatagatcgctttgatgatcctaaggtcattgatacttgttataaactggaaagcttcaaactgctgtctttcagtaaacataaaaatattgtctataaggatagccttttaaaagattggatacgaacagccttctggttactccttcgaccggtttctcctcgttattttgcaaataaaatcgagaaagaaattcaaaaatatagtcgtgaaaatgggcaatatatggcttttatcccttcaaaatttaaggaaaaggaagtcttcccaagtggtacctttgataaaacaatcgatttaccctttgagaatttaagccttcctgcacctgaaaaatttgatactattttgacacaattttatggagattatatgaccctaccaccagaagaaaaacgcttctacagtcatgaatttcacgcttataaattggaggattaggatgcaatatttagaaaaaaaagaaattaaagaaattcaactagccctgctggactatattgatgagacttgtaagaaacatgatattccttattttctcagttatggaaccatgcttggagccatccgccacaaaggtatgattccttgggatgatgatattgatatttccctttatcgtgaggattatgagcgtttactgaagattattgaagaagaaaatcaccctcgctacaaggttctttcctacgatacatcttcttggtacttccataatttcgcatcgattttggacacttctactgttatagaagaccatgttaagtacaagcgtcatgataccagccttttcatcgatgtcttcccaattgatcgatttacagacttgagcattgtcgacaagagctataagtatgtggctcttcgtcaactagcttatatcaaaaaatcacgagcagttcacggtgatagcaaactaaaagattttcttagattatgtagctggtacgctctccgatttgtcaatcctcgctacttttacaagaaaattgatcaactagtcaaaaatgctgtaaccaacactcctcaatatgaaggaggagttgggatcggtaaggaagggatgaaagaaatcttcccagttgatacctttaaagaactgattttaactgagtttgagggccgtatgttgcctgttcccaaaaaatatgaccaatttttaacccagatgtatggcgattatatgacaccaccatcaaaagaaatgcaagagtggtatagtcatagcattaaagcttatcgcaaaaactgattgagggggattatacaaactactaagatagaggttattcaaaaacataattttagtagaaaatgaaatacatattcccacaataaaacgcatcatatcaaggtttttgaaaaaccttgatatgatgcgttttataattttaaagacttttttctatagtagattgaaataagatgcgaacaaatcaattagaaaattcaaattaatttatagaaatattttagtattcctgtgtactgttctaaattcagtctgctatatcttatttttctatttaaatcgcttctgtaacaaagctacgactttcaagtaccttaagcatggcattagctgtatctagcgctgtgaagaggggcaccccgtgttcaatggctgaacgacgaatttgctcaccatcttcgtcagcagttcgttttgttcctactgtgttaatgatagcttgaattcttcctttgcgtacaaaacttgggatatccttatcgtcatcaccaatcttaccaacaggttgggcttgcaagccatgactagcaaagaaggctgctgtcccttctgtcgcaaggattccataaccaatgttttggaaacgacgagccaagttcaaggcttcttctttggcatcatcagcgatggtaaagacgacattaccaaaagttggcaagtgtagataagaagcttcaaaggctttatagagagctttttccaaagtagcatcagaacccataacttcacctgttgacttcatttcaggaccgagcaagctgtctaccttagctagtttggtaaaggagaagacaggtgccttgatatgaacacgggtgctttcagggtaaagtccattttggtagccaagttctgataaactttgaccaagaatgagtttggtcgctacttgagccataggaatattggttaccttagataggaatggaacagtacggctggcacgtggattgacctcaataacgtagactttttcatccttgataacaaactggatgttcatcattccaaggcagtgaagaccgattgctaagcgtttggtgtagtctgcgatggtctcctgaaccttttgcgacaaggtttgtggtgggtaaacagccattgagtcacctgagtggacaccagcacgttcgatatgctccatgataccaggaatgagtacatttttaccatctgaaatggcatcaacttcgcactcttgcccaacgatataagagtcgacaagaactgggtggtctggactagccttaacagcagttcgcatgtaagaacgaaggtcttcttcgttttcaacgatttccatggcacgtccaccaagtacataagatgggcggacaagaactgggaagccaatcttgcgagctgcaagagctgcttcttcttcattggtagccgtttgtcctggtggctgtggaatatccaattctttgagagcttgctcgaagaggtcacggtcttcggcacgatctaggtcagcaacctgtgtaccaaggatggtcacacctgcttttgccaatggctccgcaaggttgatggctgtttgaccaccgaactgaacgataactccctttggttgttccaagtcaatgacgttcataacatcttcgaatgtcaatggctcaaagtaaagcttatctgatacagagaagtctgttgaaacggtctctgggtttgagttcatgatgatagcttcataaccagctgcctggatagccttaacagagtgaacggttgcgtagtcaaactcaaccccttgaccgatacggattggacctgaacctaggacaagtacagattctttatcagatctgatagattcattttcccaaccataggttgaatagaaatatggcgtttcggagtcgaactctgccgcacaagtgtctaccatcttataaactggaacaatcttgttttccaagcgaagttggcgaactttatcatcagtcgttccccagagttcagcaatcttacggtctgaaaaaccattaagtttggctgttttcaaaacttctaaatcttgtggatgagcacccaattcttgctcaatttcaaagatatgcaagagtttatcaagatagaagatatcaatttttgtaagctctgcaatttcttcaggtgtgtagccacgacgaatggcttctgatacgtagaagagacggtcatcttgggctttgacaaccttttcaatcaaggcatcatcagaaactgctgcaagttcaggtatttcattgtggtgcaccccaatttcaagggagcggcaggccttgagaagagattcctcgatgttacgaccgattgccatgacttctccagtcgccttcatttgtgtaccgagacggcgttcacccttttcaaacttgtcaaatgggaaacgtggaatcttagcaactacgtagtcaagggctggttcaaacatggcataggttgaacctgtaactgggtttataacctcatccaaggtcaaacctactgcaatcttggcagccaacttagcaatcggatatcctgtcgctttagaagcaagggctgacgaacgtgatacacgagggtttacttcgataacataatacttgaagctgttaggatcaagagctagctgaacattacatccaccttcaatcttgagggcacgaataatgctcaagctcgcatcacgaagcatttggttttcatagtctgacatggtttgcgcaggggcaaatacaatggaatcccctgtgtgaatcccaactgggtcaaagttttccatgttacaaacaaccaaggcattgtcagctgagtcacgcatcacttcgtattcaatttccttgaaaccggcaatcgaacgctcaatcaaacattgggtaacaggtgacaatttcaaaccattttcagtgatttcacgcaattctttctcgttggcacacataccaccaccagtaccaccaagggtaaaggctggacgaacgatgactgggtagccaattgtcgctgcaaaggcaactgcttcttctactgtgttaacaatttcagattctggaatgggttgttcaagctcttccatcaattgtttaaagaggtcacggtcctccgcttggtcaatggcagataatttggtacccagaagttcaacgccaagctcgtctaggataccatttttagataattccatggccatgttgagacctgtctgaccaccgagtgttggtagcaaggcatctggaccttccttacgaagaatacgtgtcacaaactcaagtgtaatcggttcaatgtaaaccttgtcagcaatttccttgtccgtcatgatggttgcaggatttgagttaaccaaaacaacctcataaccttcctctttcaacgacaagcaagcctgagtcccagcgtagtcaaactcagcagcctgaccaataataatcggaccagaaccaatcaccataattttttgaatatcagtacgtttaggcatatataagatattaagggtgtcaagcggacaaagctaaaataggagttatgacgaagaactgtcagttctaggaataactatctttttagcaccgtccgtagcccgtattcagttcagcaaatacggagcacccttctcctttctattcgtcgcctctcagggcgacattaaataagatacaaaggacgaatagaaagcgattgaattttaggaaatcaaggaaggattgacaatccaagttggtttctctacattctgagctttccgtccgtgttcagttacataaattctccgacgagcttttactcgttcttagtttgattgtttaaaaacttccatcatctcgataaactcgtcaaataggtagctagcgtcgtgtggcccaggagctgcatctgggtggtattgaacagagaaagcaggttggtatctgtggcgcacaccttccactgacttgtcattgatttcttcgtgggtaataatcaagtgctctggcaaatcctcgcggctgactgcataaccatggttctggctggtgaagtctactcgtcctgttgcgatttcacgtaccgcatggttgaatccacggtggccaaacttcatcttataggtcttagccccgtttgccattgcaaagagttggtgtcccatacaaataccaaagattggaatttttccttgtacaccgcgaatcatgtcgagtgcttgtggaacgtcttctgggttacctggaccatttgacaacataactccgtcaggattgagatggagaatttcttcagccgttgtcgaataaggaacaactgtcacgttacagttgcgtttagaaagttcacgtaggattgagtgcttgagaccaaagtccactagcaccacgctcaaaccaactcctggagctggataagacgttttagtagaaacctgtttgatattgtctgtcggtaaaactgttgcttggagctggtccgtcacatggtccatactgtccccaacatgggtcaaggttgcacgcatagtaccatgcttacggataatcttggtaagagcacgcgtatcaattcctgaaatccctggaattttcttggctttcaaaaattcatccaaggtcatttggttgcgccagttgctagctctacgcgcttcttcaaaaacaacgactcccttacaagttggaataatggattcataatcatcacgattaataccataatttcctaccaaaggataagtaaaggtcaagatttgtccattataagactggtctgtaatggattcttggtagccggtcatccctgtattaaagacgatttcgcctgttacatcaatatctgctccgaaggccttgccttcaaaaactgtgccatcttctaatactagaattctttttgtcatattttcacctctcgtggacgctcactggcgtcttttaacgtcttgtgttttagttggcgtttctactcgctagtacggattctaagattgccattcgaacaaagacaccattggtcatttgttggacaatccgtgattttggtgcttcaaccaagtggtctgctatttctacatcacgattgattggagctgggtgcatgaggattgctgtttctttcaaacgatcgtaacgttcttgagtcaagccatgttgggcatggtagtcttcttttgaaaatacagctccactatcatggcgttcgtgttgcacacggagaaacatcatgacatcaacctgatcaatgatttcatcaatggttacaaactgtccatagtctgcaaactcttgacttctccattcctcaggtccagcgaaaaagagttcagctcccaagcgtttcaaaatctgcatattggatttggcaacgcgtgagtggtccaagtcacctgcaatagcaactttaagaccctcaaagtggccaaattcctcataaatggtcatcaaatcaagcaagctctggctagggtgttggcccgaaccatctccaccattgatgatggaagtcgtaatcgttggactagcaatcaattctctatagtagtcgacctctggatggcgaatcacacagacatccactcctaaagcagacagagtcaaaatggtgtcataaagtgtctcacccttattaaccgagctagtcttcacatcaaagtcaagtcgttccaatccaagtttaatctctgcgacttcaaaggacttatgtgtccgtgtagaatcctcaaagaagagattggaaacaatcggatggtcttcatagggaagctgggctccatttttaaactcaattcctcgcttgatcaatttcattacttgatcgacagtgaggtcttccatggacaccacatggttcaatgcttgttgattttctgacatggctactcctttaactttctaagcttcttcagtaatcagaactctgtcttggtcatcaagttctgtcatctctacgatgatttcttcagaacgactggttgggatattttttccaacgtaatctggacggattggcaattctctatgtccacgatcgactagaactgctaaactcacacgcgcaggacgaccatgaccgacaatattatcaatagcagcacggatggtacgacctgtatagagcacatcatccaccaagataacttcgcggtctgtcacatcgacagaaaccaaagaagtatcttctccacttttaacatcatcacggaaaggtttagtatccaattccacaacaggaactgaaagattttctaactgcttcaaacgttcttggattcggtgggcaataaagacaccacgagttttaataccagccaagacgatcttattcaaatctttgttgcgttcgataatctcataagtaatacgcgtaatcgctcgtttgacggtcaattcgtctacaacttcttttgttttcatgacaaacctccaaaaagaaaagtctccttaaacaaggagacttgaaatttatagccaagcgagccctactgcacacagtatagacttcacccttctactttatcgcgctccttgcctgcctcacgggacaggtttaaaggaatatttagttatcatttactatagcacaaagcatgcttaaaatcaagcaaaaagtttcaatgtagcatcttacaaattgctaaaatcatataattgtgggtactggtcacactctggattttttggatggcaaatggctcttccaaaataaatcatggcctgatgggcagctaaccactgctcaggcggcaagatatccatgacccgcttttccacctcaagtggcgtcgctgattttttgacaatatcgtggtgtttgcaaatacgctccacatgagtatccactgcaaaggctggaattccaaatcctacactcatgacaacattggctgtcttgcgaccaacacctgccaaactctccaattcttcacgtgtctgagggacttgaccatcaaaatcgtctagtaactgttgggcacattttttaaggaatttagctttattccgatacaatcccaagcgagaaatatgtgaagcaatctcactctctgtcgctacagacatagcttggggtgttggaaaggcaacaaagagacctggtgtggccttatttaccgctgcatctgtcgtctgggctgataacatgaccgcaaccaggagttcaaaatgattggtaaaatcaagactaggcttggcatctgggaagagggcaatgatttcttctagcacctttcgtgctcgtttttttgacaagaccattattcatctccgtcaaatagtccttgtaagccagcaaaaggactgttttcttctttctttactgctttttgagcttggtattcttcctctgtcatgatttgccagtcatttcctgagataaatccttgaccagcttcttcttcagccgtcaagaccttgataggaatgtttagcaggatattgtctgatacactctcagcaaggtcaagctccccattttcgatgggcaagaccaagtcatcatctaaaacttcttgatctagctggttagttgcgccttccatgaaaacttccgtgactggataagattcaactaactcaactggctccatactgcgactcgacgcaagaacaatggtataagatagttgataatctaagaaatacatacggtcttcatattgtactttcccaactgcaaggatatcttttacatctaaaatttcttgattacgtgcacgcaggtcatcaactaaatctaacgtttgttcaaagttcaaaccttcagactgcttacgaatttcttgaatatttaatttcatacttcctccataaagatttactctcttgattataccatgaaaaggctacaaatcagcacaccaaactttgtaattaaaattcaaaattttaacatatttactatgatagttttattttttagtgctatactatagggaaagagtacatcagatcaaggaggatgctcacatggaagacaagaaactcattcaactcctatccaagttaaataaaagctaccaaaactgtaaacagggtacggcagatgatattcgactacaagagctgctaaacactactatgcaagagctcaaaaaaacggaacagttgaacaacagtatcttaattgatcttgagaaattttaccaacctaccagtcttctgattggactgggtagcctaaaactaaacgatcaagcacgcactgcttggcgaaactatgataaattccattacgatcatgtcaaacacgtactaagtctctatggacctgtttttgaattttagagcatagaatttccagttttctgttgacaaaatttccttaaaggtataatataaagatactaatactcggaggtaagggagacatgaacaactaagtctatcaaataaagaacctttatttagtagatcttgtttttgtctctttttgtgtgctcttttatgctctttttctggcatgttaatagagtttttttgacatagactttgggctctactaggtaaagtagagctttttgttatgcactatgaacattctagaaagggaaatcatatgataaaaatcaatcatctaaccatcacacaaaacaaagatttacgagatcttgtatctgacctaaccatgaccatccaagacggggaaaaggttgctattattggtgaagaaggaaatggcaaatcaaccttacttaaaattttaatgggggaagctttgtctgatttcactatcaagggaaacatccaatctgactatcagtcactggcctacattcctcaaaaagtccctgaggacctaaaaaagaaaactttacacgactacttctttttagattctattgatttagactacagtatcctctatcgtttggcggaggaattgcattttgatagcaatcgtttcgcaagtgaccaagagattggcaatctatcagggggcgaagctttgaaaattcagcttatccatgagttagccaaaccctttgagattctatttttagatgaaccttcaaatgacctagaccttgagacagttgattggctaaaaggccagattcaaaagaccaggcaaaccgttattttcatttcccatgatgaagactttctttctgaaacggcagacactattgttcacttgcgactggtcaaacaccgtaaagaagcggaaacgctagtagagcatttagactatgatagctatagtgagcagagaaaggctaattttgccaaacaaagtcagcaagctgctaacaaccaaagagcctacgataaaaccatggaaaaacatcggagagttaagcaaaatgtagaaactgcgcttcgagctaccaaagatagtactgccggtcgcctattggctaaaaagatgaaaactgtcctctcacaagaaaaacgctacgaaaaggcagctcagtccatgactcaaaagccacttgaagaggaacaaatccaacttttcttttcagacatccaaccattaccagcttctaaagtcttagtccaactggaaaaagaaaatttgtccattgacgaccgagttttggttcaaaaactacaactaactgtccgtggccaagaaaaaatcggtattatcgggccaaatggtgttgggaaatcaactctgttagccaagttacagagacttctgaatgataaaagagagatttcacttggttttatgccacaagattaccacaaaaaactgcaattggatttatccccaatagcctatctcagtaaaactggggaaaaagaggaactacagaaaatccaatctcacctagctagtctcaatttcagttatccagaaatgcagcatcaaattcgctccttatctggcggacaacagggaaaactcctgcttttggatttagtcctgcgcaaaccaaactttctcctgctggatgaacccacacgaaacttttctcccacttctcaaccccaaatcagaaaactctttgctacctatccaggcggtctcatcactgtttcgcatgaccgtcgtttcttaaaagaagtctgctcgatcatctatcgcatgacagaacacggtttgaagctagttaatttagaagatttataaatttgcaacatagcaaaaatccagagacgacctctggattcttttacatctgttttaaacgttcaatccgttctgagataggtgggtgggtataaaagagtttttggaaccccccacctttcttaggatcattgatataaagggcactgctagcatcatcgacgtggcgactcataggtttgctattgtccaacttatctagggcattaatcattccctggggattgcgagtcagctcgacactagatgcatctgccagaaattccctctgacgagaaatagcgagctgaaccaaggttgcagcgagaggtgccagtacaatagctagtagggaaaccactagcataatgatttcaagaccatttccatctcggtcatcatcacttcgtctgcgacctgctccaccccaccacatcatacgacctgccatactagaaagcatggtgatagcactagcaagggcaactgcaatagtcgaaatacggatatcataattacgaatatgactgacttcatgtcccataacagcttctagttcttcacgattcatgatagctagtagacctgaagtcgcagcaacagccgcattttgaggattagaacctgtcgcaaaggcatttaaggctggatcatcaatgatgaaaacacggggcataggaatctgagcgaccagagccatatcttccactacatggtagaggtctggtgccgtttgctcatccacctcacgcgctccattcatggacatgacaatctctgtcgattgaaaaatcatagacaaagcgtagataaagccgataatcagtgcaataaccaaaccaccaagtccagatcttataaagagataaccaaccgcataaccaacaagagctaagagtaggaaaaataccagcaacaaaatccaggtttttcgtttattgcttgcaatttgatcaaacaacatcttagtcacctaaaccgctaaaatcaactttaggaaccgacttttcctcttcaggtgtttgaaggaaatctgccgctttaaatccaaacattccagcgataatattgctcgggaaagtttctaattttacattgtagttgctgacaacactgttatagagttgacgagagtaagaaattttattttctgtgtttgtcaactcctcttgcaatttaacaaagttagcactagctttcaaatctggatagctttctgcaactgcaaaaatacctgaaacctgacgagtgagggcatcactggctttcatagcttctgctggtgaagtcgctgccgccacttggttacgtagttctgccaccttttcaagggtagaaccttcatatttggcataaccttttacagtctcaatcaagtttggcaagaggtcattgcgacgtttcaactgaacatcaatctgactccaagcctccttggtttgcatacgatttttaaccaaaccgttatagctaacaatcacaaaaataacaataagagcgataactccaagaataatccaagtcataatataagtcctttctgcttttagattagtaccagtatatcaaattttctatgattgtggtaaaataagatgatactaaagaaggaaataactatgaaaccaaaaacattttacaacttgcttgccgagcagaatcttccactttcggaccagcaaaaagaacaatttgaacgttattttgagctcttggtcgagtggaatgagaagattaatttgacggcgattacggacaaggaagaagtttatctcaaacatttttacgattcgattgcacccattcttcaaggtttgattcccaatgaaactatcaaacttcttgatatcggggctggggcaggatttcctagtctaccaatgaaaattctctatccggagttagatgtgaccattattgattcactcaataagcgcatcaacttcctacaactcttggctcaagaactggatttgaacggagttcatttctaccacggacgtgccgaagattttgcccaagacaagaacttccgtgctcaatatgattttgtaacagctcgtgcggttgcccgtatgcaggtcctatctgaattgactattccctaccttaaggttggtggcaaactattagcactcaaggctagcaatgcgcctgaggaattattagaagctaagaatgccctcaatctcctttttagtaaggtcgaagacaatctcagtacgccctaccgaatagagatccgcgctatatcacagtggtagaaaagaaaaaagaaacaccaaataaatatccacgtaaggctggtatgccaaataaacgcccactttaaattttttagtaaacaaatgtttacaaaatcagcctcgctcttttatttctaggctcgggaaaaaatgatttacaaaatcagcctcgctcttttatttctaggctcgggaaaaaatgatttacaaaatcatttttttctgctatactatcctaagcaaaggtttttaatgtcatcccgtgaggtgacgaagacgcagaaatatttaaaactctttaaaatctaaattttaaagaagtcttactctgagggcctattgctgtaaaataatgggctcttttttgatgcccaaaagtgaggtttatatgaaacaagaatcaactgttgatttgttac

SEQ ID NO: 107 - DNA, 6405 bp; double-stranded, linear
agaaaaatctgctttacagaaaataaaaataataggagaaaatctatgtcagatttgaaaaaatacgaaggtgtcattccagccttctacgcatgttatgatgatcaaggagaagtaagcccagaacgtacgcgtgccttggttcaatacttcattgataaaggtgttcaaggtctttatgtcaatggttcttctggtgaatgtatctaccaaagcgttgaagatcgcaagttgattttggaagaagtcatggcggtagcaaaggtaaattgaccattattgcccatgttgcttgcaataatactaaagatagtatggaacttgctcgccatgctgaaagcttgggagtagatgctattgcaacgattccaccaatttatttccgcttgccagaatactcagttgccaaatactggaacgatatcagttctgcagctccaaacacagactacgtgatttacaacattcctcaattggcaggggttgctttgactccaagcctttacacagaaatgttgaaaaatcctcgtgttatcggtgtgaagaactcttctatgccagttcaagatatccaaacctttgtcagccttggtggagaagaccatatcgtctttaatggtcctgatgagcagttcctaggaggacgcctcatgggggctagggctggtatcggtggtacttatggtgctatgccagaactcttcttgaaactcaatcagttgattgcggataaggacctagaaacagcgcgtgaattgcagtatgctatcaacgcaatcattggtaaactcacttctgctcatggaaatatgtacggtgtcatcaaagaagtcttgaaaatcaatgaaggcttgaatattggatctgttcgttcaccattgacaccagtgactgaagaagatcgtccagttgtagaagcggctgctgccttgattcgtgaaaccaaggagcgcttcctctaatctaaaaggaggtatttatgacatattacgttgcaattgatatcggtggaaccaacatcaagtatggtttggttgatcaagaggggcaacttcttgaatcgcatgaaatgccaactgaggcgcataagggtggacctcatatcttacaaaagaccaaagatatcgtagctagttatttagaaaaaggcccagtagcaggtgttgccatatcttctgctgggatggtggatccggataagggtgagattttctatgctgggccgcaaatccctaactacgcaggcacccagttcaaaaaggaaatcgaagaaagctttactattccttgtgagattgaaaatgatgtcaactgtgcaggtcttgctgaggcagtatctggttcaggcaagggagcaagtgtgacactttgcttgaccattggaaccggtatcggtggttgcttgattatggataggaaagtcttccatggttttagcaattcagcctgtgaagtcgggtatatgcatatgcaggatggagcttttcaagacttggcttctacaacagctttagtgaaatatgtagctgaagcccatggagaagatgttgatcagtggaatggccgtagaattttcaaagaagccactgaaggaaacaaaatctgcatggaaggtattgaccgtatggttgactatctaggaaaaggtctggcaaatatttgctacgttgccaatccagaagtggttattcttggtggtggtatcatggggcaagaggctatcctcaaacctaagatccgtacagccttgaaagaggctttggtaccaagtttagcagaaaaaacacgattagaatttgcccatcaccaaaatacagcagggatgttgggtgcatattatcattttaagacaaaacaatcctagtttggctcagccaaactaggattttcttacacgtttttgtctacgatagccgttgagttttttattttcccagtagctattaaagattttttccttgctttcgcgattgatttccaaaaagtaggcataaatcaaatcgataaagaagagcataggaagttgagcggatattcgttggatataggagggttggctgtgggtggctacaagaacagtctctgtataggtctggctatctttattgggaacacttgtaaagagtacagtctttgcccccatctccttagcatctaatagactatctaaaatagaaggagttgagcctgaaagtgagaagcccagtactagacaattttcatccatgatgctggttgtccaggcaaagccgtcttggtctgtcaaagcttcgcagaccacacctagtcgcataaaacgtaatttcatttcacgggcgacgaggccagaactccctgttccaaagaagtagatacgctcagcatcttcgattagctgggcaattcgttctagttggatttcgtcaatcaagtcttgtgtttgttccctcatattgctataacttctgaggactcgtttggtcagtggactgtgcttggagacttggttggcttgattttctgcctgatgttggtattggaaaataaattctcggtagccagtaaagccacactttttagcaaagcgggtcaaagcagcttgagaaatatgtaatttttgggtgacttgttgagaagataaatcatctgtaatcgtttcagcttgcaaaaaatagcgagcgatttcttgttctaggtctgtcatttcttcaaaatgtgaatcaatgatagttgcgatatctggtttgtccatagggaaagctcctttacatgagtcatactggaagactagatcagagaatagtcacacttcattataacacataatataaggatagataaataaaaacgcatctctgttttaaaaacgaaaaaatcgaaaaagcttctctcttttccataattttctactcaaattgtggtacaattaagagtaagattttaagttagaaatgagactgatttgtatgagaaaatttaacagccattcgattccgattcggcttaatttattgttttcaatcgtcattttactctttatgaccattattggtcgtttgttgtatatgcaggttttgaacaaggatttttacgaaaaaaagctagcttcagctagtcagaccaagattacaagcagttcagcccgtggggaaatttatgatgctagtggaaaacctttggtagaaaatacgttaaagcaggttgtttcctttacgcgtagcaataaaatgacggctacagacttaaaagaaacagctaaaaagttactgacttatgtgagcatcagttctccaaatttgacagaacgccagctggcggattactatttggctgatcctgaaatctataaaaaaatagtggaagctctcccaagtgagaaacgcttggattcagatggcaatcgtctatccgaatcagaactgtataacaatgcggtcgatagtgtacaaacgagtcaactaaactatacagaggatgaaaagaaagaaatctatctttttagtcagttaaatgctgttggaaactttgcgacaggaaccattgcgacagatcctctaaatgattctcaggtggctgttattgcctctatttcaaaggagatgcctggcattagtatttctacttcttgggatagaaaggttttggaaacttccctttcttctatagttgggagtgtatccagtgaaaaagctggtctcccagcggaagaagcagaagcctatcttaaaaaaggctattctctaaatgaccgtgtaggaacctcctatttggaaaagcaatatgaagagaccttacaaggaaaacgctcggtaaaagaaatccatctggataaatatggcaatatggaaagcgtggatacaattgaggaaggtagtaagggaaacaatatcaaactgaccattgatttggctttccaagatagcgtggatgctttactgaaaagttatttcaattctgagctagaaaatggtggagccaagtattctgaaggtgtctatgcagtcgcccttaacccaaaaacaggtgcggttttgtctatgtcagggattaaacatgacttgaaaacgggagagttgacgcctgattccttgggaacggtaaccaatgtctttgttccaggttcggttgtcaaggcggcgaccatcagctcaggttgggaaaatggagtcttgtcaggaaaccagaccttgacagaccagtccattgtcttccaaggttcagctcccatcaattcttggtatactcaggcttacggttcattccctatcacagcggtccaagctctggagtattcatcaaatacctatatggtccaaacagccttaggtcttatggggcaaacctatcaacccaatatgtttgtcggcaccagcaatctagagtctgctatggagaaactgcgttcaacctttggcgaatatggcttgggtactgcgacaggaattgacctaccagatgaatctactggatttgttcccaaagagtatagctttgctaattacattactaatgcctttgggcagtttgataactatacgccgatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggtgccttggtatccattagcggaaaaacaggtacagccgaaagctatgtggcagatggtcagcaagcaaccaataccaatgcggtggcctatgccccatctgataatccccaaatcgctgtcgcagtggtctttcctcataataccaatctaacaaatggtgtaggaccttccattgcgcgtgacattatcaatctgtatcaaaaataccatccaatgaattagaaaggaaattatgctttatccaacacctattgccaagttgattgacagttattctaagttaccaggtatcgggattaagacggctacgcgtctggccttttatacgattgggatgtctgctgatgatgtcaatgaatttgcaaaaaatctcctttctgctaagagagaattgacatattgttctatttgtggacgtttgacagacgacgatccttgttctatctgtactgatccgactcgtgaccagacaacaattttagttcttgaggatagtagagatgtggcagccatggaaaatatccaagaataccatggactctatcatgtccttcatggcctcatttctcctatgaatggtatcagtccggacgatatcaatctcaagagccttatgactcgtcttatggatagtgaggtttcagaagtgattgtggcgactaatgctacagcggatggtgaagcgacttccatgtatctttcacgtttgctcaagccggctggtatcaaggttacgcgtctagcacgaggtctcgctgtgggagcggacattgagtatgcggacgaagtgacactcttacgagccattgaaaatcggacagagttgtaagtgtaggcaaatttacgaactccattcatttataaaaaatcaaagaggctgaaaatcgttcctatcggcctctttttgtatagtgtgatgagtaggctcaggttcaagttttaaaaaaccaagcaaatatgatatactaaagagcgagtattctagtagaattaggacaaataatatgaaacaaacgattattcttttatatggtggacggagtgcggaacgcgaagtctctgtcctttcagctgagagtgtcatgcgtgcggtcgattacgaccgtttcacagtcaagactttctttatcagtcagtcaggtgactttatcaaaacacaggaatttagtcatgctccggggcaagaagaccgtctcatgaccaatgaaaccattgattgggataagaaagttgcaccaagtgctatctacgaagaaggtgcagtggtctttccagtccttcacgggccaatgggagaagatggctctgttcaaggattcttggaagttttgaaaatgccttacgttggttgcaacattttgtcatcaagtcttgccatggataaaatcacgactaagcgtgttctggaatctgctggtattgcccaagttccttatgtggctatcgttgaaggcgatgatgtgactgctaaaatcgctgaagtggaagaaaaattggcttatccagtcttcactaagccgtcaaacatggggtctagtgtcggtatttctaagtctgaaaaccaagaagaactccgtcaagccttaaaacttgccttccgatatgacagccgtgtcttggttgagcaaggagtgaatgc

SEQ ID NO: 108 - DNA, 11309 bp; double-stranded, linear
cgagctcgggtaccgggattttaaggagtttgatatgtataacctattattaaccattttattagtattatctgttgtgattgtgattgcaattttcatgcaaccaaccaaaaaccaatccagcaatgtatttgatgccagttcaggtgatttgtttgaacgcagtaaagctcgcggttttgaagctgtaatgcagcgtttgacagggattttagtctttttctggctagccattgccttagcattgacggtattatcaagtagataagaaaataatgggcaggactaggtctttgcctctttttatttttaaaggatgtttgagaaggttttacagtaaaagaaaattaaaaaatctagaaagaaaatatgaaagatagaataaaagaatatttacaagacaagggaaaggtgactgttaatgatttggctcaggctttgggaaaagacagttccaaggattttcgtgagttgattaaaaccttgtccttaatggaaagaaagcaccaaattcgttttgaagaagatggtagtctgacattagaaattaagaaaaaacatgagattaccctcaaggggatttttcatgcccataaaaatggctttggctttgttagtctggaaggcgaggaggacgacctttttgtagggaaaaatgatgtcaactatgctattgatggtgataccgtcgaggtagtgattaagaaagtcgctgaccgcaataagggaacagcagcagaagccaaaattattgatatcctagaacacagtttgacaacagttgtcgggcaaatcgttctggatcaggaaaaacctaagtatgctggctatattcgttcaaaaaatcagaaaatcagtcaaccgatttatgttaagaaaccagccctaaaattagaaggaacagaagttctcaaagtctttatcgataaatacccaagcaagaaacatgatttctttgtcgcgagtgttctcgatgtagtgggacactcaacggatgtcggaattgatgttcttgaggtcttggaatcaatggacattgtatccgagtttccagaagctgttgttaaggaagcagaaagtgtgcctgatgctccgtctcaaaaggatatggaaggtcgtctggatctaagagatgaaattacctttaccattgacggtgcggatgccaaggacttggacgatgcagtgcatatcaaggctctgaaaaatggcaatctggagtttggggttcacatcgcagatgtttcttattatgtgaccgaggggtctgcccttgacaaggaagcccttaaccgtgcgacttctgtttacgtgacagaccgagtggtgccaatgcttccagaacgactatcaaatggcatctgctctctcaatccccaagttgaccgcctgacccagtctgctattatggagattgataaacatggtcgtgtggtcaactataccattacacaaacagttatcaagaccagttttcgtatgacctatagcgatgtcaatgatatcctagctggcgatgaagaaaagagaaaagaatatcataaaattgtatcaagtatcgaactcatggccaagcttcatgaaactttagaaaacatgcgtgtgaaacgtggagctctcaattttgataccaatgaagcgaagattttagtggataaacaaggtaagcctgttgatatcgttcttcggcagcgtggtattgccgagcggatgattgagtcttttatgttgatggctaatgaaacagttgccgaacatttcagcaagttggatttgccttttatctatcgaattcacgaggagcctaaggctgaaaaggttcagaagtttattgattatgcttcgagttttggcttgcgcatttatggaactgccagtgagattagtcaggaggcacttcaagacatcatgcgtgctgttgagggagaaccttatgcagatgtattgtccatgatgcttcttcgctctatgcagcaggctcgttattcggagcacaatcacggccactatggactagctgctgactattatactcactttaccagtccaattcgtcgttatccagaccttcttgttcaccgtatgattcgggattacggccgttctaaggaaatagcagagcattttgaacaagtgattccagagattgcgacccagtcttccaaccgtgaacgtcgtgccatagaagctgagcgtgaagtcgaagccatgaaaaaggctgagtatatggaagaatacgtgggtgaagagtatgatgcagttgtatcaagtattgtcaaattcggtctctttgtcgaattgccaaacacagttgaaggcttgattcacatcactaatctgcctgaattttatcatttcaatgagcgtgatttgactcttcgtggagaaaaatcaggtatcactttccgagtgggtcagcagatccgtatccgtgttgaaagagcggataaaatgactggagagattgatttttcattcgtacctagtgagtttgatgtgattgaaaaaggcttgaaacagtctagtcgtagtggcagagggcgtgattcaaatcgtcgttcggataagaaggaagacaagagaaaatcaggacgctcaaatgataagcgtaagcattcacaaaaagacaagaagaaaaaaggaaagaaacctttttacaaggaagtagctaagaaaggagccaagcatggcaaagggcgagggaaaggtcgtcgcacaaaataaaaaggcacgccacgactatacaatcgtagatacgctagaggcagggatggtcctgactggaactgaaatcaagagtgtacgagctgctcgaattaatctcaaggatggctttgctcaagtgaaaaatggagaagtttggctgagcaatgttcatatcgcgccttacgaagagggcaatatctggaaccaggaaccagaacgtcgtcgtaaactcctgctccataaaaagcaaattcaaaaattggaacaagagatcaaagggacaggaatgaccttagttccccttaaggtctatataaaagatggctacgctaagcttcttttaggacttgccaaagggaagcatgactatgacaaacgggagtctatcaaacgtcgtgagcaaaatcgagatatcgcgcgtgtgatgaaagctgttaatcagcgataaaaagaggaattgaaaatggaaaaattagttgcctataaacgcatgcctttgtggaataaacaaacaatgcctgaagctgttcagcaaaagcacaatacaaaagttgggacttgggggaaaattactgtcttgaagggagctctcaagtttattgaattgacagaagaaggggaagttctagctgaacacctctttgaagcaggggcagacaatccaatggcccaacctcaagcctggcaccgagtggaagctgccacagatgatgtggaatggtacttggaattttattgtaaacctgaggattattttgctaaaaaatacaataccaatcctgttcattcagaggtcctagaggccatgcagacagtgaaacaagggaaagctttggatttgggttgtggtcaggggcgtaattctctttttctagcccagcaagattttgatgtgacggctgtagatcaaaatggactagctcttgaaatcttgcaaagcattgtggagcaggaagatttggacatgcctgttggcctttacgatatcaattcagctagcattgaacaagaatatgattttatcgtttcaacagttgttctcatgtttctacaagcggaccgcattccagctattattcaaaatatgcaggagaaaaccagtgttggtggttacaaccttatcgtttgtgccatggacacggaggattatccttgctcggttaacttcccattcacctttaaagaaggagaactggcagactattacaaggattgggaattggttaagtacaatgaaaatccaggccatttgcaccgtcgcgatgagaatggcaatcgtattcaactacgctttgcgaccttactagctaagaaaatcaagtaaacacacatgaagattaggaattttcctgatcttttttcttttttacgaatgatatagaaaaggagggaattcatgtttgttgcgagagatgctaggggagaattggtaaatgtgttagaggataaacttgagaagcaagcatacacctgcccagcttgtggaggccagctccatttgcgtcaaggaccaagtgtacggacgcattttgcccataaatccttaaaagactgtgattttttctttgaaaatgaaagtccagaacacctggccaataaggaatccctctatcactggttgaaaaaagagacaaaggttcaattagagtacccgctttcagaacttaaacagattgcggatgtatttgtaaatggcaatctagctctagaagttcagtgtagtcccttgcctcagaaagtccttaaagagcgaagtgagggctatcgtagtcagggttaccaagtactgtggttgctgggtcaaaaactgtggctcaaggagcgtttgactcgtctacagcaaggttttctttatttcagtcaaaacatgggcttttatgtttgggaattagacaaggaaaaacaagttttaagactcaaatacctgatttaccaggatctccgcggtaaactccattatcaaatcaaggaattttcctatggtcaaggtagtttattggaaatattgcgtcttccctataagagacaaaaaatatctcattttacagtttctgaggacaaggacatctgtcgctatatccggcaacaactttattatcaaaatctcttttggatgaaagaacaagcagaagcctatcaaaagggagaaaatatcctgacttatggactgaaagaatggtatccacaaattcgaccaatagtgggcaaatttttccagattgaacaagacttgactagctattatcagcacttttatacctattaccaaaaaaatcctcaaaatgattggcaaaagctttatccaccagccttttatcagcaatatttcttgaaaaatatggtagaatagaaaggatggaggaatctaatggtattacaaagaaatgaaataaatgaaaaagatacatgggatctatcaacgatctacccaactgaccaggcttgggaagaagccttaaaagatttaacagaacaattggagacagtagcccagtatgaaggccatctcttggatagtgcggataacctactagaaatcactgaattttctcttgaaatggaacgccagatagagaagctttacgcttatgctcatatgaagaatgaccaggatacacgtgaagctaagtatcaagagtactatgccaaggccatgacactctacagccagttagaccaagccttttcattctatgagcctgaatttatggagattagcgaaaagcagtatgctgactttttagaagctcaaccaaagctgcaggtttatcaacactattttgacaagcttttgcaaggcaaggatcacgttctttcacaacgtgaagaagaattattggctggagctggagaaatctttggttcagcaagtgaaaccttcgctatcttggacaatgcggatattgtgttcccttatgtcctagacgatgatggtaaagaagttcagctatctcatgggacttacacacgtttgatggagtctaaaaaacgtgaggttcgccgtggtgcctatcaagctctttatgcgacttacgaacaattccaacacacctatgccaaaaccttgcaaaccaatgttaaggtgcaaaattaccgtgctaaagttcgtaactacaagagtgctcgtcatgcagccctcgcagcgaattttgttccagaaagtgtttatgacaatttggtagcagcagttcgcaagcatttgccactcttacatcgctatcttgagcttcgttcaaaaatcttggggatttcagatctcaagatgtacgatgtctacacaccgctttcatctgttgaatacagttttacctaccaagaagccttgaaaaaagcagaagatgctttggcagtcttgggtgaggattacttgagccgtgttaaacgtgccttcagcgagcgttggattgatgtttacgaaaatcaaggcaagcgttcaggtgcctactctggtggttcttatgataccaatgcctttatgcttctcaactggcaagacaatctggacaatctctttactcttgttcatgaaacaggtcacagtatgcattcaagctatactcgtgaaactcagccttatgtttacggggattactctatctttttggctgagattgcctcaactaccaatgaaaatatcttgacggagaaattattggaagaagtggaagacgacgcaacacgctttgctattctcaataacttcctagatggtttccgtggaacagttttccgccaaactcaatttgctgagtttgaacacgccattcaccaagcagatcaaaatggggaggtcttgacaagcgatttcctaaataaactctacgcagacttgaaccaagagtattatggtttgagtaaggaagacaatcctgaaatccaatacgagtgggctcgcattccacacttctactataactactatgtatatcaatattcaactggctttgcggccgcctcagccttggctgaaaaaattgtccatggtagtcaagaagaccgtgaccgctatatcgactacctcaaggcaggtaagtcggactatccacttaatgtcatgagaaaagctggtgttgatatggagaaggaagactacctcaacgatgcctttgcagtctttgaacgccgtttaaatgagtttgaagcccttgttgaaaaattaggattggcataaaatggttgaatcgtatagtaagaatgctaaccataacatgcgtcgtcctgtcgtcaaagaagaaattgtagacttgatgcgtcagcgtcaaaagcaggtcacaggtttcttgaaagaattggaagactttgcccgcaaggaaaatattcctattattccccatgaaacggttgcttatttccgttttcttatggaaaccatgcagcctaaaaatattctggaaattgggacggctatcggtttttcagctctcttgatggctgaacatgcgccaaatgctaagattacaactattgatcgtaatccagaaatgattggttttgccaaggaaaattttgcccagtttgacagtcgcaagcaaatcactctcctagagggagatgcggtggatgtcttatctacactgacagagtcttatgatttcgtctttatggattctgccaagtctaaatacatcgtctttctgccagaaatcctcaaacatttggaagttggtggtgtggttgtcttggatgatatttttcaaggtggtgatgttgccaaggatattatggaagtccgtcgtggtcagcgaaccatttatcgaggccttcaaaaattatttgatgcaaccttagacaatccagaactcaccgcaacattagtgcctttaggagatggtattctcatgcttcgtaaaaatgtagcagatgttcaactgtctgaaagcgaatgattttcagaaaaatttaagaaaaaatagtaaaatagatagagtaacacttatctcaaaggagtagacatgaagaaaaaattattggcaggtgccatcacactattatcagtagcaactttagcagcttgttcgaaagggtcagaaggtgcagaccttatcagcatgaaaggggatgtcattacagaacatcaattttatgagcaagtgaaaagcaacccttcagcccaacaagtcttgttaaatatgaccatccaaaaagtttttgaaaaacaatatggctcagagcttgatgataaagaggttgatgatactattgccgaagaaaaaaaacaatatggcgaaaactaccaacgtgtcttgtcacaagcaggtatgactcttgaaacacgtaaagctcaaattcgtacaagtaaattagttgagttggcagttaagaaggtagcagaagctgaattgacagatgaagcctataagaaagcctttgatgagtacactccagatgtaacggctcaaatcatccgtcttaataatgaagataaggccaaagaagttctcgaaaaagccaaggcagaaggtgctgattttgctcaattagccaaagataattcaactgatgaaaaaacaaaagaaaatggtggagaaattacctttgattctgcttcaacagaagtacctgagcaagtcaaaaaagccgctttcgctttagatgtggatggtgtttctgatgtgattacagcaactggcacacaagcctacagtagccaatattacattgtaaaactcactaagaaaacagaaaaatcatctaatattgatgactacaaagaaaaattaaaaactgttatcttgactcaaaaacaaaatgattcaacatttgttcaaagcattatcggaaaagaattgcaagcagccaatatcaaggttaaggaccaagccttccaaaatatctttacccaatatatcggtggtggagattcaagctcaagcagtagtacatcaaacgaatagtccaaatcaatgagtcagggaaaaaactcgacttcaggaaaaaatgaagcaaacattcccacaataaaacgcatagtacaaggtttgtactgccccccaaaaagttagacaattaatttatccgaaggatttagttctgtattgcacagagctaagtccttttagttttatcttaattctcttattgttgtaataatcaatatagtctataatggctcgttccaattgattaagtgatttaaatgttttctcatagccataaaacatttcggattttaaaatgccaaagaaagattccatcctaccgttgtcttggctgttgcccttacgtgacatggatgcttgaattcccttactctctaggaagcgatgataagaatcgtgttgatattgccagccttggtcactatggagaatcgtattctcgtagtgcttctctttgaatgcctgttccaacattaacgatcaatcaatttaatcatgtacctaagattagaattgtttatcccaaatttatttgaaagcttctctaagctatatccttgttttctaagttcatagatctgaactttatcatcataagttaatttcataataaaaacaccccaaaagttagattttttctgtctaacttttggggtgtagttcatgtacacctgatatgatgcgttttataattttaaagactttttgaccagcctcatttttttaacttgatactcagtgaaaagcaaagattaaactaggaagctagctgtaggctgctcaaagaacagctttgaggttgtagataaaacttgtgaggtcaccaacatatataatgtgaagctgacgtggtttgaatagattttagaagagtatgagtctggaagttttaatggataatgcaagattccatagaatgggtaagctagagttcttatgtgaagagtttgggcataaacttttaccttttcctccctactcatcttagtatagaaaagtgaatctgaaatagtacataactgcttctaaaacattcttataaattgatttaaattctcaaatcatattattcagttcttatttcattttgttctacaatcctgttgagaagacacgtgttcatatcaaaaaggtattggcaagttgcaatacctttttacgaggctctgttgtcttatttttgtttcaactgactatatctcctatggttctagttcagaaggctaggctataattatgattgataagaagtatcattccaagtattgggagtgaatgtttcaaaatcatgggtttctataatggtcaggctggcatttgctagaccgccatctttacgaagaagtggttctttatagcctaggagagtacgaagactggcagtaagattggcgccgtgtccgacaattagaatacgttcagctggactatcttttaatgatttgataaattggatggtccgttgagttgtactatagagggattcggctccgaacattcgagtgtcaaattgagcaagatttgaacgaaaagcctggatttgttgcgggtaaatagcttccaaggttgcaattttcaaaccttctaacttcccaagttgccattcacggagattaggaacgatttctaaagaacagggggtatagagttgactttggataatctcagcagatttgaccgctcgaggtaaatcacttgaataaatctgatcaaaaggaatttccttgagatactgaccaagtcgttttagggtttcaatggattcaggaagaagaggagaatcaccactagcaccttgaaaacgaccttcttggttccagagggtacgaccgtggcggacaaagtagagtttcattacttgatgtcctccaaaatatctacaaagtctgcctttacaaagctagccaagtcttgtggcgcgacgataatgctgtgtccgacttcgcctgcagagacaatcatttgatccaaatctagagcaattttatcgataaaaatgggataattgtgtttctgacgaattccgacaggattattggctccatgaatgtaaccagttgttttttctaagtccttttgtggaatcatgctcacttttttattgccagaaattttagctagtttcttttcagacaagtgctgagtgatagggacaattccgataatcggtccggtcttgtctcccaaaagcgccaaggttttgaaaatctgatctcgttcataaccttgaggaagctctccttctagggcattgatttgaatcccctgatgagggatagctgctttagataggatttgttccaccaatgtttttttgattttaactttttttgccattatttatatttatcctccaattgactcatccaaataccaagccagattcccagcgcaaagaagaaggcgatgatgacataaccgacaagtgaaagtcctgtgtattggatactttcagcgtttcctgcatttggaattaagatcaaaagggtacttgataggacgataccgatgatgaaatgatagacgaactgtttacggagttcttctagttctccgtccgtccaagcgtaggccacttcttctttcttgcctttacctttggacatcttgtaaagaggtgggagggcaatatagacatgacctgcctcgactagcggacgcatgtaacggtagaaaaatgtcaagagcaaggtctggatatgggcaccgtcggtatccgcatcg

SEQ ID NO: 109 - DNA, 5548 bp; double-stranded, linear
ccatagtctaacaagtctttgtaaaggtttatccctgattcatgtaaagattgtgtaaagaatcaaaaaaagccacttttgaaaaatggctgctcctaaaaatagctttaaaaattattagtcctgtgcgaaagattggttaggaagaaaaatcgtgaagcaactgcctctgccaagctgactcgtcaccgtgacttggccacctaataattgactgagttctttgacaatggcaaggccaagaccagtgccaccagtttgtctgcttcgacctttattaactcggtaaaaacgttcaaaaatacgatcctgctctaattgactaataccaatccctgtatctgatacagaaatcttaatgccttcgttcaccttttgggtcttgacctcaatttttcccccttgttcagtgtaacggatggcattggataaaagattgagtaagatttgggaaagtaattgactatctgatacgagggtgacatcatctggcacctgcacctttagctgtaaatccttcttcttgagctgaggttgcaagctttgagtcaaatcctgtacaaattctgccaaagaaagggtcgtccattgtataggcatttgttgagccttagataaggtaagaagatgctcaacaatatgctcaagacgcaaactttctttgtaaataatgtctagaaagtcatccttgagcgcttcttcttcagctgacatccccttaatggtttcagcaaagcccttaatcgaagtaactggtgtcctcaattcatgggaggcatttgagacaaaggctaaatttaacttttcataagttctaatcgttgttaaatcatatagcaagacgagcacagcttccacagattgggtggggctaaaaacgggaactgctgtcacttctaaaatcaagtcaccctcatgaaacccacttacttcttgttttaaccttgttttttgatcaaaggcttggtgaactaaattccgaatatccatccgtttgaggtcatcaagtgaacttatgtcgccgtccacatcgggaaaataatgaggcagagagcgactggataataacatctgaccttgagcggaaactaaaaacgtccccatggttaggtgcgacagaagaacctccattgtttcggctagatccttgtattgctgatcctgttgggagactttggtttttaggccagacacatactgagccaaagactttaagtcttcttgccctttttctaaaaagtattcactactggtcaagagaggttggtgcaaggtctcaaaagcaacttcccatttccaaaggcaaaagagccagtagccacctagtcccaaagaaagggctagaagaaagagaccgatgcctttactgatccaagttaatgccatccctgcaatcagaatgaggctaacacttagattgactagccaaaattgaaggtagcgtttcatctataactccttgaacttataaccataaccccgaatggttcgaataaattgaggggctttaggattgtcttcaattttttccctcaacttaccaatatgaacgtccaccaaacgtgtttcctgcccaaagtcatacccccagatacgttccaaaagacgctctctagtcagtgtcatgttgggatgtttcataagatagagcaagagttcaaattcttttggggtcaaactcagtaacttattcgccttgtagacttcatgacgctcagggtatactttcaaggtcccaaatagccaagaatcgtcagcgatattatctgaatcatctccttcttgttctcctttagttcgcctgaggacagccttgacacgcgccagcaattctctagggctaaaaggcttggtcaggtagtcatcagcccctaattccaaggccaaaaccttatcaaattcatcacttttcgcagaaaccatcataattggagttttgacgcctttggctctcagccgcttacaaacttccatgccatctaattgtggtaacatgatatcaagcaagataaaatcaaagggttctgtttctgccaaagctaaggccttccgtccatttgtcaccaattgagtagaaaagccttccttacttaaatggtagtcaagcaatttcagaatgtgttcttcatcatccactaataagacttgttttgtcatctattatctcctattggtaacattataacacaattatcagaaatcctaacattgctaaatcagattaaatttgcctatcaagactagtatctggtcaaacgctcaatcatctccttgtgctctggataggtcgccagtagatctaccctttcaaataattcaaaatcctcaaattcaaaaccaggagcaacaagacaagaaaccagagcatcatccttatcaactgttgatccccaaatagtgcccttaggaacacagtagtgaagttgttgccctttggatatgtccaggcctaaagtgactgcttcgtagtgaccatctgctgtaatcatgtgaacagtaagtggggatcctgcatgaaaataccagatttcatctgctgtcaatcggtgaaaatgtgaaggattcgtttcttctaataagaaataaatactggtataaagcgcccttcccttaccagcaaggtttatagtgtctgaagctttttttgtttgtctaaaatagccaccttcaatatggggagctaactctagagttcttatcaagtcttctttatccgtcggagccaatgggttgaagtaactcttgttcaaagtggttttacgatttcaagaactcctctcagttctgaggacacggtaatgattgatgcgacggaagtacaaatcaatcgccctaaaaaaagaattagcgaatgattctggtaaaaaaaatgccacgctatgaaggctcaagcgattgtcacaagtcaagggagaattgtttctttggatatcgctgtgaactattgtcatgatatgaagttgttcaaaatgagtcgcagaaatatcggacaagctggtaaaatcttggctgacagtggttatcaagggctcatgaagatatatcctcaagcacaaactccacgtaaatccagcaaactcaagccactaacagttgaagataaagcctataaccatgcgctatccaaggagagaagcaaggttgagaacatctttgccaaagtaaaaacgtttaaaatgatttcaacaacctatcgaaatcatcgtaaacacttcggattacgaatgaatttgattgctggcattatcaatcatgaactaggattctagttttgcaggaagtctattatttggttaggtgaattagtgaagcgtttaggcaagtgtctctggttacgacgtcatggactctaaatcgattatatttaggggtcatgactagtgaagcagttagctagttcgcatataagcggctagcgtctaacaattaggaactttagttccaataactttaagattacgacgttttaggacataaatcgatcatatttatgtcctaaaactagtgaagcgcctagccaaagtccgaataggatttggcgttagttacttagattgctttgcaatcaagtaactttggcgatttacatcttctctggcgcttctactccaagcaagcgaagggcttctttgagaacgactgcggttgcgtagctgagggctagacggctgtcgcgttctgggctttcatccaagatacgtgtatgtgcatagtatttgttaaaggattgagccaggctaattgcaaatttagcaatgatagaaggttcaaagttatctgccgcacggttgataatacgtgggaagtcttgaatgagtttaatgatttcccagctttcagtatcattcaagctatagttgccagctgtttctggtttgaaatcggctttgcgtaagatagattggatacgagcgtaggcatattgaacgtaaggtccagtttcaccctcgaaggataccatagcctctaggtcgaagtcgtatccatttgtacggtcggttttgaggtcatagaatttaatggctccaatcccaacagcatgtgctacttggtctttgttttctagttcaggatttttagcctcgatttggaccttggcacggctaacagcctctgcaacagtaggctctagcaagatgacattccctttacgagtagagagtttcttcccttcttttgtaaccaaaccaaaaggaacgtgagtaatgtcgtcactccagtcgtagcccatctcttgcaagacagctttgagctgtttaaagtgggcagattgttcttgaccaacgacatagatagatttagcaaattggtattcgtttttacggtagagggctgcagccaagtcacgtgtgatatagagagttgcaccatcagacttcttgatgagggctggatgttcaattccatatttctcaagattcacaacttgggcaccttctgattcaagaagtagtcctttttcagaaagaatgtctacaactgcatccatcttatcattgtagaaggcttctccgttatagctgtcaaattcaaccttcaattcattgtaaaggcggttaaattccactaaactttcatcgcggaaccattgccaaagagcgagagcttcctcatctccattttcaagtttacggaaccattcgcgcgcttcttcatccaagctagggtcattttcagcttcagcgttgatgcggacatagagtttaaggagttcatcgattggatgagcttttacagcttcttcgtcgccccattttttgtaggcaacaatcaacatcccaaattgtttaccccagtctcccaaatggttgaccttgaccgtttgataaccgattttttggaaaatatgtgacaagctatctccgataacagttgaacgcaggtggccaatagaaaatggtttagcgatattcggactagacatgtcgataacaacattttcttgtttaccaatattttggtcagcatagtgttctttttcagtggtaacagcttgcaatacttgagcagaaatggcagatttatcaaggaaaaagttaacgtaaggtcctgttgcgacaactttttcaaaggcttggctgttcattttttcagccagttcagccgcaatcatttgtggtgctttacgttcgacttttgcaagagaaaaagcagggaaagcaatgtctcccatttctgagtttttaggggtttccagtaactttaaaatagcctcttggtccaggctatcaatgatgctagataattcgctagcaatcaattcttttgtattcattaagagctcctttttggacttttctactattttatcacaattttaaagaaagaagaaaaaatttttgaaatctcctgtttttttggtataatatggttataaatatagttataaatatgcacgcaagaggattttatgagaaaaagagatcgtcatcagttaataaaaaaaatgattactgaggagaaattaagtacacaaaaagaaattcaagatcggttggaggcgcacaatgtttgtgtgacgcagacaaccttgtctcgtgatttgcgg

SEQ ID NO: 110 - DNA, 3132 bp; double-stranded, linear
tacccggtagtcttagcagacacatctagctctgaagatgctttaaacatctctgataaagaaaaagtagcagaaaataaagagaaacatgaaaatatccatagtgctatggaaacttcacaggattttaaagagaagaaaacagcagtcattaaggaaaaagaagttgttagtaaaaatcctgtgatagacaataacactagcaatgaagaagcaaaaatcaaagaagaaaattccaataaatcccaaggagattatacggactcatttgtgaataaaaacacagaaaatcccaaaaaagaagataaagttgtctatattgctgaatttaaagataaagaatctggagaaaaagcaatcaaggaactatccagtcttaagaatacaaaagttttatatacttatgatagaatttttaacggtagtgccatagaaacaactccagataacttggacaaaattaaacaaatagaaggtatttcatcggttgaaagggcacaaaaagtccaacccatgatgaatcatgccagaaaggaaattggagttgaggaagctattgattacctaaagtctatcaatgctccgtttgggaaaaattttgatggtagaggtatggtcatttcaaatatcgatactggaacagattatagacataaggctatgagaatcgatgatgatgccaaagcctcaatgagatttaaaaaagaagacttaaaaggcactgataaaaattattggttgagtgataaaatccctcatgcgttcaattattataatggtggcaaaatcactgtagaaaaatatgatgatggaagggattattttgacccacatgggatgcatattgcagggattcttgctggaaatgatactgaacaagacatcaaaaactttaacggcatagatggaattgcacctaatgcacaaattttctcttacaaaatgtattctgacgcaggatctgggtttgcgggtgatgaaacaatgtttcatgctattgaagattctatcaaacacaacgttgatgttgtttcggtatcatctggttttacaggaacaggtcttgtaggtgagaaatattggcaagctattcgggcattaagaaaagcaggcattccaatggttgtcgctacgggtaactatgcgacttctgcttcaagttcttcatgggatttagtagcaaataatcatctgaaaatgaccgacactggaaatgtaacacgaactgcagcacatgaagatgcgatagcggtcgcttctgctaaaaatcaaacagttgagtttgataaagttaacataggtggagaaagttttaaatacagaaatataggggcctttttcgataagagtaaaatcacaacaaatgaagatggaacaaaagctcctagtaaattaaaatttgtatatataggcaaggggcaagaccaagatttgataggtttggatcttaggggcaaaattgcagtaatggatagaatttatacaaaggatttaaaaaatgcttttaaaaaagctatggataagggtgcacgcgccattatggttgtaaatactgtaaattactacaatagagataattggacagagcttccagctatgggatatgaagcggatgaaggtactaaaagtcaagtgttttcaatttcaggagatgatggtgtaaagctatggaacatgattaatcctgataaaaaaactgaagtcaaaagaaataataaagaagattttaaagataaattggagcaatactatccaattgatatggaaagttttaattccaacaaaccgaatgtaggtgacgaaaaagagattgactttaagtttgcacctgacacagacaaagaactctataaagaagatatcatcgttccagcaggatctacatcttgggggccaagaatagatttacttttaaaacccgatgtttcagcacctggtaaaaatattaaatccacgcttaatgttattaatggcaaatcaacttatggctatatgtcaggaactagtatggcgactccaatcgtggcagcttctactgttttgattagaccgaaattaaaggaaatgcttgaaagacctgtattgaaaaatcttaagggagatgacaaaatagatcttacaagtcttacaaaaattgccctacaaaatactgcgcgacctatgatggatgcaacttcttggaaagaaaaaagtcaatactttgcatcacctagacaacagggagcaggcctaattaatgtggccaatgctttgagaaatgaagttgtagcaactttcaaaaacactgattctaaaggtttggtaaactcatatggttccatttctcttaaagaaataaaaggtgataaaaaatactttacaatcaagcttcacaatacatcaaacagacctttgacttttaaagtttcagcatcagcgataactacagattctctaactgacagattaaaacttgatgaaacatataaagatgaaaaatctccagatggtaagcaaattgttccagaaattcacccagaaaaagtcaaaggagcaaatatcacatttgagcatgatactttcactataggcgcaaattctagctttgatttgaatgcggttataaatgttggagaggccaaaaacaaaaataaatttgtagaatcatttattcattttgagtcagtggaagcgatggaagctctaaactccagcgggaagaaaataaacttccaaccttctttgtcgatgcctctaatgggatttgctgggaattggaaccacgaaccaatccttgataaatgggcttgggaagaagggtcaagatcaaaaacactgggaggttatgatgatgatggtaaaccgaaaattccaggaaccttaaataagggaattggtggagaacatggtatagataaatttaatccagcaggagttatacaaaatagaaaagataaaaatacaacatccctggatcaaaatccagaattatttgctttcaataacgaagggatcaacgctccatcatcaagtggttctaagattgctaacatttatcctttagattcaaatggaaatcctcaagatgctcaacttgaaagaggattaacaccttctccacttgtattaagaagtgcagaagaaggattgatt

SEQ ID NO: 111 - DNA, 14672 bp; double-stranded, linear
cgagatttctttaaatgaactacgtgaaatctacccatcatccagatctggatattctctcctatctataagtaaagttttaggagattttaatataagttctcatgcttttaaagcttcggtaagagatttaaaaccgctcagtttcccactcatttgcttctgggagagttctcattttattattcttgaaaaaattagtaaaaacaagttttatattttagatcctgcaaaaggcaggcagagaatgtcaataagtgaatttgaaaggcattattcaaatatcattttaacatttaaaaagttagatagctttatgtctcgtaaagataataagaagtcgcctgttttaaagtatttttttaagtataggaataagctagggattttattttttgtaacagcattattgtatgtaatacaatcattagtacctatagctaatagatacataattgacacgaatttcaaggacgattcgtattcgtctagaatgttatttactatattatttatatttactgtttcattctcactaatgtatttattaagacagatatatgttgcatccttaaaatatataatggataaagagattagctatgattttatgaaacatttgatatatttaccttacagtttttatgaaaaacgtactttaggggatatactttttagagctaactctattgtttatataagagaaatactatcaaataattttatagcagctatacttgatttgttaatgattgtggtttatgctgtggttttatttagcttttctaagtacatggtaatctttttaatatcactaagtctagctctatctattgtaatgtatccaatcataaaaatctcaaaaaatttaattgataaaaatataaaagaaaaggttaatgttcaaaatattacttccgaagtaatttctaaaaatagtgatattaagctaactggagaagaggaattttggattaacaaatgggataattttaatacaaaacagctcatcataggtcgaaaacttgatatacatttatcaattgttagtagtataacgaatgttttacaaattattctccctgttttgacccttattgtaggtgtaaatataaaaacattcgaacaattgacgttaggacaaattgtagcaataagtacagtctcaccatactttatttctcctataatttctttaagtgataactatatacaattaatgttattaaagggatattttttaagaatagaggatgtgtttaatactaaatccgaattaattccagaaagagtcagtcaagatataaaatttgataaaaaaatagaattaaaagatatttggtataaatatggattatttgatgattatgttttgaaaggaataaatgttactattaaaaaaggagaaactgttgctattgttggagaatcaggttcaggtaagagtacattagctaaaattttattaggtttattagaacctaatattggttcaatagaagttgatggagtagaaaaagaagaaattggtcaaacattgtatagaaagatttttggagcagtgttacaaaattcaaccctaagttatggtaccttaagagagaatttgacatttggacactttgtttcagatgaagaattaatgacaaatctaaattcaattggtcttagcaatgtagttaaatctttacctcttggattagagacaatcatcgctgaagaaggtaataacttttctggagggcagcagcaaatgatacttttagctcgttgtcttttgtcgaaaccttcggtagttgttttggacgaagcaacaagtagtttagataatttatctcaacaaattacaacttcttacttaagtgaaatcggtaccactaagattttaattgcccatcgactagatactatcaagtctgcagataagatcttagtaatgcataatggtgaaattgtagagattgggacccatagagaacttcttgaactaggaggcatttataagcaattgtattcaaataattagtttttgattaaaagggtaaatttatgaagattatgaaaaaaaaatattggactttagcgatattattcttttgtttgttcaataattctgttactgctcaagaaatacctaaaaatcttgatggcaatataactcacactcagactagcgaaagtttttctgaatctgatgaaaaacaggttgactattctaataaaaatcaagaagaagtagaccaaaataaatttcgtattcaaatcgataagacagaattatttgtaacaacagataaacatttagaaaaaaactgttgtaaattggaacttgaaccacaaataaataacgatattgttaactctgaaagtaataatttactaggcgaagataatttagataataaaattaaggaaaatgtttctcatctagataatagaggaggaaatatagagcatgacaaagataacttagaatcgtcgattgtaagaaaatatgaatgggatatagataaagttactggtggaggcgaaagttataaattatattctaaaagtaattctaaagtttcaattgctattttagattcaggagtcgatttacaaaatactggattactgaaaaatctttcaaatcactcaaaaaactatgtccccaataaaggatatttaggaaaagaggagggagaggaaggaataatatcagatattcaagatagattaggtcatggtacggctgttgtagctcaaattgtaggggatgacaatattaatggagtaaatcctcacgttaatattaacgtctatagaatatttggtaagtcgtcagctagtccagattggattgtaaaagcaatttttgatgctgtagatgatggcaatgatattatcaatcttagtactggacaatatttaatgattgatggagaatatgaggacggaacaaatgattttgaaacatttttgaagtataaaaaggctattgattacgcgaatcaaaaaggagtaattatagtagctgcattagggaatgactccctaaatgtatcaaatcagtcagatttattgaaacttattagttcacgcaaaaaagtaagaaaaccaggattagtagttgatgttccaagttatttctcatctacaatttcggtcggaggcatagatcgcttaggtaatttatcagattttagcaataaaggggattctgatgcaatatatgcgcctgcaggctcaacattatctctttcagaattaggacttaataactttattaatgcagaaaaatataaagaagattggattttttcggcaacactaggaggatatacgtatctttatggaaactcatttgctgctcctaaagtttctggtgcgattgcaatgattattgataaatacaaattaaaagatcagccctataattatatgtttgtaaaaaaattctggaagaaacattaccagtaaaaaatggtataaaagtgttaaatataccaaacgtattgagatatgatttgaatatgttacaattagaatataaaaatgaacaaagttgggatagtttcatagataatgttaatttaattgagttggaagagagaattcaaactactattggaattaaacaaataaacacacacaatattattactattgcccgagaagggtactctcaaaattatttacctaacacttcagaaaatacatataattcattacaagtcagtttagttggagtattactactttttataagtatggtaaatattttatgggctaaaaaaagtaaatgaaaataaaatttggagccctctgaaaaagtaagtcctacagttcaactaaaatgagtcaaaagatgaatcaccttgatgtaggggagtttgtcttattgctgcctgaacacctccgttcagaggaagaacattataaatctgtttttgaagacgacttaaccagtcgcatatctagtcaagatgaacgacagcaaatgactgctacggtaggttatttagaatcaggtcaggatcgttttgtgtataatacgacccctatttcttaccagcagtttttgaaagatccaatcatcattgttataacaccccaatcaactggtccacagtccattttgttttggatagacgcagtacagaactacgttctctttaatcaattgtctgatgcccaggagcttatccagagacaaggcattgaaaattgggtctcagaaatgcaaacaggttaccacaactacatcacattattggataatatccagagggaacgttgggtaatgctagcaggagctgtgcttgggattgcaacttcaatcttgttgtttaacactatgaataggctctactttgaagaatttagacgtgccatttttatcaaacgcattgcaggtctcaggttcttagaaatccatcgcacttatctctttgctcaactgggtgtgtttttactgggatttgttgcgagtgtatttcttcaggtagagataggagttgctttcttagtcttgttactctttactggtctatctcttttacagttacatgtccaaatgcagaaagaaaacaagatgtccatgcttgttttgaagggaggttaatatgattgaacttaaacaggtgagtaaatcttttggagaacgagagttattttcgaatctttcaatgacatttgaggctggaaaagtctatgccttaattggttcaagtggtagcggaaaaacaaccttgatgaacatgattgggaaattagaaccttatgatgggacgattttttaccgaggtaaagacttggccaattataaatcaagtgattttttccgtcacgaattgggctacctcttccagaactttggcttaattgaaaaccaaagtattgaagaaaaccttaagctaggtctcattggtcaaaagttgagtcggtcggaacagcggttgaggcagaagcaggctttagaacaggtcggcctggtttatcttgacctagataagcgcatctttgagttatcgggcggagaatcgcaacgggttgccttggcaaaaattatcttaaagaatccaccctttattctggcagatgagccaacagcttcaatagacccagcaacctctcagttgattatggagattttgctatctcttcgagatgataataggctaatcattatcgcaacacataatccggcaatttgggagatggctgatgaagtgttcacgatggatcatctgaaataaaaatccttgtttttaattgcacgatgagttactgaaatattatcatgaatcaagaattggagttaatttagaattgtacttaatttagaattgtactttattaatattgaggtaactttttcttgataaaggaagaaataatggagaggaagttagaatgaaaaaattcgacaattatattattgagaagccttgcgattctaattcagataaactgcaaaaaatcttaataattgaaagtttggtagatgatattttgcaattttctctcagaatcaataatagtgtaggagagattttcctcctacaaccgttttaaaagaaaactatctttattccatgttattttgaggaagatattgtgaaagtcaaagatgatgataaagttgagtggaatttgttagaatttcaaaaatttagagcatttttggcttagtaatctgtgttgaaggctcaaaacctatggtaaaaaagtagctttgaaaacgtattgcctccaaagatttagttaaataatgatttaacacaaaaagaaattattgaagttctggaaagatgttgtttcagtattgagaaaaggtgggaaaaacttgcgattttcacagagaaaggaagaaaaagtatagaaatatagtcaattgaaacaagaacaggataaaagaaccttttgtgccatatttttctcctttcgctttacaattggattgaacacctttattgtatcgcgtttggagtttttttggtataaccttcgacgcacacccgcatagcgggtgttttttttgtctcgcacctaacggagcgagacaaactaatagtcacttaatcaaaaaacgcaccatatcaaaaactaaaaagtttgatatcatgcgtcatgtcttaaactaattgactatactttctattcaaatgagcttttaaccaattgattgagccaatccactcttaaaaccaaagagcaatttctcgcttagctgactcttctgaatctgaaccatgtacaacattttggataatctcattttctccagcagcttttgcaaaatcacctcgaatagtgcctggtaaagcttcttctggacgagttgcacccatcatggtccgccaagtttcgattactttgggaccagaaatgacacccacaagaactggacctgaagtcatgaattcacgaatcggtgggtaaaaactctgaccaaccaagtcctgatagtgctggtcaatcaactcttctgaaacctgtgaacgaaactccaatttttcgattgtaaatccacgttgttcgatgcgctttaacacttcacccactagccctctttttacaccatctggtttgatgataaagaatgtttgttccatacccgtctcctttgtcagcttctttcttttattttaccacatttcgtggaaaaatggagaaagttttcagaagagagaatgagagaaccctcgggttctctcattctctcttattctactgtttcttccacagtttcaacggcagtatccacaactacttctgttgtttcttcatttccttcttcctctactggaggattaaggtattcttcttcgttgacagcatgtggttcaaggttacggtaacgggccataccagtaccagctgggatgatcttaccgatgataacattttctttaagtccaaggagatggtctttcttaccacggatagctgcgtcagtaaggacacgagttgtttcctggaaggaagccgctgacaagaaactgtttgtttcaagtgaggctttggtaattcccataaggactgggcgacctgtcgctggaactccacctgcgataaggacatctttgttggcatctgtaaagtcattgatatccatgagggtacccatgagaagatctgtatcacctggatccatgacacggactttacggatcatttgacgaaccattacctcgatgtgtttgtcaccgatttctaccccttggctacggtaaactttttgtacttcaccgagaaggtacgtttcaactgacaagacatcacgaactgcaaggagacgttttggttggatagaaccttctgtcagagcagcaccacgcgctacttggcccccaacttcgacacgcatacgagctgtaaatggaacgacatattcaccttcgccagtttcacccttaacaaagactttcttggtacgagttgatgcatcttcttcgatagcagtaacttgtcctttaacctctgtaataaccgcttcccctttaggattgcgggcttcaaagatttcttggacacgaggaagaccctgagtgatatcggtatttgaggcaaccccacctgtgtggaaggtacgcattgtaagctgtgtaccaggttccccgatagattgggcagcgattgtaccaactgcttcaccaacttcaaccgcatcaccagtcgccaagttgataccgtaacagtgacggcagacaccgtgacgagtgttacatgtaaatacagaacggatagtcacttcttccacaccagcattgacaatttcacgcgccttgtcttctgtaatcaattcatttggaccaataatcactgcaccagtttctggatgtttaacagttttcttagtgtaacgaccgttgagacgctcttcgagagactcgatcatctcttttccttctgcgatagaacggatcaagagaccacggtcagttccacagtcgtcctcacggatgataacgtcttgggcaacgtcgaccaaacgacgagtcaagtaacctgagtcggctgtcttaagggccgtatcggtcatacctttacgagcaccgtgagttgagaagaacatttccaataccgacaaaccttcgcggaagtttgaaaggattggcaattccatgatacgtccattcggagcagccatcagaccacgcataccggcaagctgtgagaagtttgagatgttaccacgggctccagagtccatcatcataacgattgggttcttaggatcttggttagcaatcaagcgtttctcaagtttttcacgggcagcacgccattcagctgtaacagcattgtaacgctcgtcgtctgtgatcataccacgacggaattgtttggtgatttgttcgacacgtttgtgtgattcttcaatgatttcagccttgtcatcaacgactgggatatcggcaatacccactgtcaatcctgcaagagttgagtggtggtaaccgaggttcttcatgcggtcaagtagggcagaagtttctgtcgtacggaaacgtttgaagatttcagcgatgatatttccaaggtttttcttcttgaatggagggttgagctcaagattgctgatagcttccttgatatctccaccaagtggcaagaagtatttagctggaacaccttctgtcaagttggcattgtttggttcttgcaagtatggtagcccctctggcatgatatcgttgaagagaattttaccaactgttgtaagcaagaccttatgtctttgctcttctgtccaaggcttgttgaggctgtctgttgcgataccaacacgtgagtggaggtgaacataaccattgcggtaagccataaccgcttcgtcacggtctttgaagaccattccttcaccttcgcgaccagcttcttccatggtcaagtagtagttacccaaaaccatgtcctgagatggagtaactaccggtttcccatctttcgggttcaagatgtgctcagcagctagcatgaggatacgagcttctgcttgtgcttcttctgaaagtggtacgtggatggccatttggtccccgtcaaagtcagcattgtaggcttcacagacaagtgggtgcaagcgaagagccttaccatcaatcaagactggctcgaaggcttggatacccaaacggtgaagggtcggtgcgcggttcaaaagcactgggtgttctttaatcacttcttcaaggatatcccagatacgctcatctccgcgttccaccaagcgtttagctgctttgacgttttgcacgatatcacgggcaacgatttcacgcatgacaaatggtttaaagagttcaatcgccatttcacgcggcacaccacattggtacatcttaagagttggaccaacggcgataactgaacgtcctgagaagtcaacacgtttaccgagcaagttttgacggaagcgtccttgtttacctttaagcatgtggctcaatgatttcaatggacggctacctggtcctgtgattggacgaccacgacgaccattgtcaatcaaagcgtcaactgcttcttgaagcatacgcttctcattttgaacgatgatacctggtgcatttaactcaagcaaacgagccaaacggttgttacggttgataacacggcggtaaaggtcattcaagtcagatgaggcaaaacggccaccatccaactgcaacattggacgaagatctggtgggataaccggaaggatgttaagaatcatccattcaggtttgtttccagacttgtaaaaggcatccaaaacatccaaacgacggatggctttgacacgcttttgtccagtagctgttttcaattcttctttgagttcagcaatttctttttcaagatctacttgcttcaaaaggtcttggatggcttccgcacccatcttggcaacaaatgaaccataaccatattcacgcaagcgctctcggtattcgcgctctgtcatgatagacttgtgctcaagtggtgtatccttaggatcaatcaccacataagccgcaaagtagataacttcctcgagggcacgagggctcatatcaagggtcaagcccatacggcttggaatccccttgaagtaccagatgtgagatacaggagctttcaattcgatatgtcccatacgctcacgacgaactttcgtacgcgttacttcaaccccacagcggtcacaaacaattcctctgtaacgaatgcgtttgtacttaccacaagcacattcccagtcttttgtaggaccaaagatcacttcatcaaagagtccttcacgttctggtttcaaggtacgataattgattgtttcaggttttttgacttctccataagaccatgaacggactttacttggagaagctagggtgatttgcatacttttaaaacgatttacatcaaccactatttcttccctttctattctaagtgaactgcttattcttgttcagcagcttcttctgttgcttccgcttttgttgctttctcagcttcttcagcttcaaaggctgctttagcctcttgggctgctttttcgcgggctttttcaaggtcatctacgtggatgacatcttcgtccattccttcatccaagtcgcgaagttccacttcttggtcatcttcgtctaggacacgcatgtcaagaccaagagattgcaattctttgacaagaactcggaaggattctggaacacctggttttggaattggtttgccttttgtaatagcttcataggctttcaaacgtccgttgatatcgtccgacttgtaagtcaagatttcttgaaggacatttgacgcaccgtaggcttcaagagcccaaacctccatctcaccgaaacgttgtccaccaaactgagccttacctccgagtggttgttgggtaacagttgagtatggtccgactgaacgcgcgtgcaatttatcatcaaccatgtggtggagtttgatcatgtacatgactccgacagaaacacggttatcaaacggttcaccagtacgtccatcgtaaaggatcgttttggcatcgctatccatacctgcttctttaacagttgaccaaagatcttcagaacttgctccatcaaagactggtgtagcgatgtgaataccaagagtacgagctgccataccaaggtgaagctccataacctgaccgatattcatacgtgatggtaccccaagtgggttcaacatgatgtcgactggagttccgtctggaaggtaaggcatgtcttctacaggaacgatacgagagacaacccctttgtttccgtgacgtccggccattttatctccgaccttaatcttacgtttttgagcgatgtaaacacgaaccaacatgttaacacctgattgcaactcatctccatttacacgtgtaaagatcttaacatcacgaacgacaccatcggcaccgtgtggtacacgaagagaagtatcacgcacttcacgagacttgtctccaaagatagcgtgcaagagacgttcttcagctgaaagatctttctcacccttaggtgttactttacctacaagaatatcaccttctttaacctcagcaccaatacggataatccccatttcgtcaaggtctttgagggcatcttcaccaacgtttggaatttcgcgagtgatttcttcaggcccaagctttgtatcgcgcgtttctgattcgtattcttcaaggtgaacagatgtgtagacatcgtccttcaccaagcgttcgctcatgataacggcatcctcgaagttgtaaccttcccaagtcatgtaggcaacgattgggttttgtccaagcgccatttctccattttccatagaaggtccgtcagcgatgaaatcgcctttttcaacgacatcaccaacttttacgagagtgcgttggttgtaagcagtacctgagtttgaacgacggaatttttggatgtggtaaacatccaatgaaccatcttcacgacgaacttctaccttgtcagcatctgcgtaagtaactttaccatcatactgagcaatcacagccgcaccagaatcgtgggctgcttggtattccataccagtaccaacgtaaggtgcctgaggattaatcaatggcacagcctgacgttgcatattggctcccatgagggcacggttggagtcatcgttttccaagaaaggaatacatgctgtcgcaacggcaactacctgttttggtgaaacgtccatgtagtcaacaatattagctggatactcttggttgaccccttggtgacgtcccatgacaatcttctcagcaaaggttccatcttcattcagacgagagttagcctgagctacagtatattcatcttcttcatcagctgtcaaccaaacaatttcgttcgtgacaacacctgtttcacggtcaaccttacggtatggtgtttgaacaaaaccatatttgttcaagtgtccataagatgacaagttattgatcaaaccgatgttaggtccttcaggtgtctcgattggacacatacgaccatagtgagtgtagtgcacgtcacgtacttcatatccagcacggtcacgagtcaaaccaccaggtcctaaggctgacaaacggcgtttgtgagacaactcagaaagcgggttgtgttggtccatgaactgtgacaactgtgatgaaccaaagaattctttaactgcagctgttacaggacggatattgataatttgttgtggtgtcaagacttcattgtcctgaacagacatacgttcacggacattacgttccatacgagaaagtcccaaacgtacttggttggcaagcaattcaccaaccgcacggatacgacgatttccaaggtggtcgatatcatctacacggccaagtccttcagccaagttgaggaagtagctcatctcagcaaggatatctgcaggagtcaccgtacgaaccttgtcatctgggttagcattaccaatgatcgttacgacgcgatctggatcagttggagcaataaccttgaatttttgaagaacaacaggctcagtcacaacggctgcatcgtttgggatgtagacaatcttgttcaagtcgccatccaaatggctttcaatgctttcaatcacgctacgagtcataatcgtaccagcttctaccaagatttctccagtttcagggtctaccaatggctctgcaatggtttggttgagcaaacgtgttttaacattgagttttttattgattttgtaacgaccaactgctgccaagtcataacgacgtgggtcaaagaagcgagctacaagcaagctacgtgagctttcagccgtcttaggctcacctggacgaaggcgttcgtaaatttctttcaaggcttcgtctgtacgagagtccattggattcttgtggatatctttttcaacagtgttgcgaaccaattcgctgtcaccaaagatatcaaagatttcatcatcacctgagaaaccaagagcacgaaccaaggttgtaaatggaatcttacgagtacggtcgatacgagtgtaggtgatatcttttgagtcgctttcaagttccaaccaagctccacggttagggataacagttgaaccatagcccaccttaccatttttgtctactttgtcgttaaagtaaacacctggtgagcggaccaactgagaaacgataatacgttcaccaccattgatgatgaaagtacccatttctgtcatgattgggaaatcaccaaagaaaacttcttgggtcttgatttcgcttgtttctttattgatcaaacggaaggttacaaaaattggtgctgagtagctagcatcgtggatacgagcttcttctagcgtatattttggttccttgatttcatatccaacaaattccaactccattgtgtctgtgaagtttgaaattggcaatacatcttcaaacacttccttaagaccgtggtctaggaaagctttgaatgagtcagtttgaatttcaatcaaatttggtaagtcaagaacttctttgattcttgaaaaactacgacgggtacgatgtttcccgtattgaacgtcatgtcctgccaagatgattctcctttgtaaataagttccaagccttgtcaatcaggcttttctaatcgtcatatggttgtaaaccccttatcaccgtgtcctcttgacgaattttcagaatctttaagcctctgttacaaatgctcaaaatcttgaaaaaaagcacaaaaagagcagctaaatctgactttttcagaagatttaactgctgtgagccttgtctggacaatatttcagacaaaacctacgacaaatgattacccatattataccctatttagctagatttttcaaggggtttcagtaggtttttggtaaattttttcccatagaaaacttggcatcacattcgaatcacgctatggtacaaaaaactgaaaaaactattgactgaaaatcattttcaaggtataataataaacgttaaggcggtatagccaagtggtaaggcacggctctgcaaaagcttgatcgtcggttcaaatccgtctaccgccttctataacttgatttatcaggtttcaaatgaacagaaagcccaatttgaagggctttttttattttccctcgaataaatacgtataactttaaaaacttttggagcgagtttgtggcagagttctttccatggcataattcccttttgaaatcag

SEQ ID NO: 112 - DNA, 7902 bp; double-stranded, linear
aggagactattcaagcccaaattgagtagcccagcaaagactgtatagactgtgatacgtttttcatagccattggtaaagagaatttgggaaccaagaatggtatctaaggccaggataatcgtacgaaaagcgaagagagaggtcaagatgccgcctccgatatatttttcactaccgtaaagtaggatggcatttggtcctaaaaccatgagtccaaaactcagtggaatgataaagaagttaaagattcgactacctctattaaccagagaaacataggcttctttgtctcctttccccagatagtaactgagacgaggcacactcactccaattgcacctgttacaaccccagctataacggtcacaattcgctgagctatggtatagtaactaacgttgacatcaatccctgttttaacgaggaagaggcgatctaaaaaagtgaagagcatattggcattggcaaagactaacatggctgtcagagggagaaagagtggtttaaaatcacttaggtgaattttaacaagtttgatgtctcttttaatccaaaaataactaatcaggtagttaatcagcgtcgataaactcatcacaagtgtatagacaacaatatcgtgttcatttttaacaaataagaaaatagagaccagcatcaggatacggatgaaggcagttttgtaaaagagaaaactgtaattttccagagcttcattgacccattcgattgaaaaaatctgggcaatgagttgaatccccataacaaggtagacctttttgacgattggattatcagtaaagaagagaggataggctaggatatagacagcagtggtcaaaatcgtacaagcgatgcacaaataaaaaagactagaaaaggttctgttaagatcttttttgttatccttgacattactgatagcccttaaaccgtagttatagacaccataagttgcaaagggcaagaaaaatgacaaaatagtgtcgactgagttgaagtaaccatagtcagttcggtccaagacacgcgcgacataggttccagttaggatgggaaaaataatattcaagacacgaattcccatgtaagatagagcatttaattttatacttttcattcaatttacctcgtttttcattatatcataaagttagctaataagaaatgaagggcagtaagtcaagtaatcactttgaagtttcaaatcttaagttttaagttttctttaaggaaagtatattattctgaaggactctaaaatttcgcagccatttattagtaattgctacagaattcctagtcattactagaaatggactagtttctttgaataatagaactgcataattctcctattctagaaggggaggaccagtatttcttttatgataggactagattgtggtataatagagagaataagtttttttagtaagacaaaggagaaaatagatgatttatgcaggaattcttgccggtggaactggcacacgcatggggatcagtaacttgccaaaacaatttttagagctaggtgatcgacctattttgattcatacaattgaaaaatttgtcttggagccaagtattgaaaaaattgtagttggtgttcatggagactgggtttctcatgcagaagatcttgtagataaatatcttcctctttataaggaacgtatcatcattacaaagggtggtgctgaccgcaatacaagtattaagaacatcattgaagccattgatgcttatcgtccgcttactccagaggatatcgttgttacccacgattctgttcgtccatttattacacttcgcatgattcaggacaatatccaacttgcccaaaatcatgacgcagtggacacagtggtagaagcggttgatactatcgttgaaagtaccaatggtcaatttattacagatattccaaatcgtgctcacctttatcaaggacaaacacctcaaacattccgttgcaaggacttcatggacctttatggatctctttctgatgaagagaaggaaatcttgacagatgcatgtaaaatctttgtgatcaaaggaaaagatgtggctttggccaaaggtgaatactcaaatctgaagattacaaccgtaacagatttgaagattgcaaaaagtatgattgagaaagactagtaaaatgattaatcaaatttatcaactaactaagcctaagtttatcaatgtcaaatatcaggaagaggctattgaccaagagaatcatatccttatccgtcccaactacatggctgtctgtcatgcggatcagcgttactatcagggaaaacgtgatcccaagattttgaataaaaagcttccaatggcaatgattcacgagtcatgtggaaccgtcatttctgacccgaccggaacctacgaggttggtcaaaaagttgtcatgattcccaatcagtctcctatgcagagtgatgaagaattctatgaaaactacatgacagggacccatttcttgtctagtggatttgatggctttatgagagagtttgtttctctccctaaagatcgtgtggtggcttatgatgctattgaagatacggttgcagccattacagagtttgtcagtgtgggcatgcacgctatgaatcgtctattgactcttgctcatagcaagcgggagcggatcgccgttattggagatggaagtttagcttttgtggttgccaatattatcaactatactttgccagaagcagagattgtggttattggtcgtcattgggaaaagttggaactcttctcatttgccaaagaatgctatattacggataatattcctgaagatttggcctttgaccatgcttttgaatgttgtggtggtgatggtactggaccagctattaatgacttgattcgctacattcgtcctcagggaacgattctcatgatgggagttagcgaatataaagtcaatctcaatactcgcgatgccttagaaaagggcttgattttggttgggtcatctcgttctggtcgcattgattttgaaaatgctatccaaatgatggaagtcaagaaatttgccaatcgtcttaaaaatatcctttatctagaagaacctgtaagagaaattaaagatattcatcgtgtctttgcaaccgatttaaacacagcctttaaaacagtgtttaagtgggaagtataagtactggaggttaattgtggagaaaatcattaaagaaaaaatttcttccttacttagtcaagaagaggaagtcctcagtgttgaacaactgggtggaatgaccaatcaaaactatttggccaaaacaacaaataagcaatacattgttaaattctttggtaaagggacagaaaagcttatcaatcgacaagatgaaaagtacaatcttgaactactaaaggatttaggcttagatgtaaaaaattatctttttgatattgaagctggtatcaaagtaaatgagtatatcgaatctgcgattacgcttgattcaacgtcaatcaagaccaagttcgacaaaattactccaatattacaaactattcatacgtctgctaaggaattaagaggagaatttgctccttttgaagaaatcaaaaaatacgaatccttgattgaagaacaaattccttatgccaactatgaatctgttagaaatgcagtcttctccttagagaaaagactggctgacttaggtgttgacagaaaatcttgtcatatcgatttggtgcctgaaaactttatcgaatcacctcaaggacgactttatttgattgactgggaatattcatcaatgaatgatccaatgtgggatttggctgccctctttttagagtctgaattcacttcccaagaggaagaaactttcttatctcactatgagagtgaccaaacaccggtttctcatgaaaagattgctatttataaaattttacaagatactatttggagtctatggactgtctataaggaagagcaaggtgaagattttggtgactatggtgtgaatcgttaccaaagagctattaaaggtttggcttcttatggaggttcagatgaaaagtaaaaacggagttccttttggccttctctcaggtattttctggggcttgggtctaacggttagtgcttatatcttttcgatttttacagatttgtcaccctttgtggtggctgcaactcatgattttttgagcatctttatcttactagcttttctcttggtaaaagaagggaaagttcgcctctcaattttcttaaatattcgcaatgtcagtgttatcatcggagccttgctagcaggccctatcggtatgcaggccaatctttatgcagttaagtatatcggaagttctttagcttcatctgtatcggctatttaccctgcgatttcagttctattggctttcttctttttgaagcacaagatttcgaaaaatactgtatttgggattgtcttgattattggagggattattgctcagacctataaggttgaacaggttaattctttctacattgggattctttgtgctttggtttgtgctattgcatggggaagtgagagtgttcttagctcttttgccatggaaagtgaattgagtgaaatcgaagccctcttaatccgtcaagtaacttcgttcttgtcctatcttgtgattgtgctcttctctcatcagtcatttactgcagtagccaatggacaattgctaggtctcatgattgtttttgcagcctttgatatgatttcctacttggcttattatatcgctatcaatcgcttgcaaccagccaaggctacaggcttgaacgtgagctatgtagtatggacggtcttgtttgcagttgttttcttgggtgcaccgctagatatgctgaccattatgacgtcacttgtcgtcattgctggagtttatattattattaaagaataaaggagattcgtgtgaaagccattatcttagcagcgggattgggaactcgcttgcgtcctatgactgaaaatacccctaaagccttggttcaggttaatcaaaaacctttgattgagtaccaaattgagtttctcaaagaaaaaggaatcaatgacatcatcatcattgttggttatcttaaagaacaattcgattacttgaaagagaaatacggtgttcgtctcgttttcaatgataaatacgctgactacaataacttttactctctctatcttgtaaaagaagaattggccaacagctatgttattgatgctgacaattatctctttaaaaatatgttccgcaatgatttgacacgttcgacttattttagtgtttatcgtgaagattgtaccaacgaatggttcttggtttatggagatgactacaaggttcaagacattattgttgatagcaaggcaggtcgcatccttagtggtgtatccttctgggatgctccaactgcagaaaagattgtcagctttatcgacaaggcttatgtaagtggtgaatttgttgatctctattgggacaatatggttaaggataatatcaaagagctagatgtctatgttgaagaattagaaggcaatagcatttatgagatcgatagtgtccaagactatcgtaaattagaagaaattcttaaaaacgaaaattaaagattccaacatctgacaaaatagtcggatgttttttgattttttacgaacttttacgaatagatagatgagtagaaaaagaaatggagttatttatgaaaatcacaaactatgaaatctataagttaaaaaaatcaggtttgaccaatcaacagattttgaaagtgctagaatacggtgaaaatgttgatcaggagcttttgttgggtgatattgcagatatctcaggttgccgtaatccagccgtttttatggaacgttattttcagatagacgatgcgcatttgtcgaaagagtttcaaaaatttccatctttctctattttagatgactgttatccttgggatttgagtgaaatatatgatgcgcctgtacttttattttacaagggaaatcttgacctcctgaaattcccgaaggtagcggtcgtgggcagtcgtgcttgtagcaaacagggagctaagtcagttgaaaaagtcattcaaggcttggaaaatgaactggttattgtcagtggtctggccaagggcattgacacagcagctcatatggcagctcttcagaatggcggaaaaaccattgcagtgattggaacaggactggatgtgttttatcctaaagccaataaacgcttgcaagactacatcggcaatgaccatctggttctaagtgaatatggacctggtgaacaacctctgaaatttcattttcctgcccgtaatcgcatcattgctggactttgtcgtggtgtgattgtagcagaggctaagatgcgttcaggtagtctcattacgtgtgagcgagcaatggaagaaggacgcgatgtctttgctattcctggtagcattttagatggactatcagacggttgccatcatttgattcaagaaggagcaaaattggtcaccagtgggcaagatgttcttgcggaatttgaattttaaaaatgacctaagctagaattctaagaaaaaatcaattttaagagaaaatgaacccaacatttccataataaaacgcatattagcaagtttttaacacttgataatatgcgttttttctaagtggattagtagagtagaggatttttctcatataatactcttcgaaaatctcttcaaactacgtcagcttccatctgcaacctcaaaacagtattttgagcgacttcgtcagtcttatctacaacctcaaagcagtgctttgagcaacctgtggctagcttcctagtttgcgctttgattttcattgagtataagggaaagtatagtgaattgaaataagatgtgaacaactctatcaggaaagtcaaattaatttatagaaatattttagcagccaaggtgtactgttatagattcaattacactataatttagtgtaattgagaaaggagaaatgattgtgattgatgttggctaggttatgttcaatgattcctaccgtctcaaatcttgtcagtaaggaaaaataaattcttcaaaagtagagattacaaggcttgtttaagaaagaattcaaagaccttgacaaataaaaataaaatggttattataaaaaatggtctgaaatagatgatgatacttttcgaaaatctcttcaaatacgtcagctcagctttgccttgctgtgttttgagcaagctacggttagcttccgagtttgattttcatttactagaaatgaaactgatgagagatatcagtagacatttgagtcaggatattatggaaaatgataaaaagagctcgtgagattggcatatcagactactaaagtattgagtttgttaggattttagcgactagttagctgggaaaggaagatatttgtgacaaataataaactgtattcgttgatagaatttagaaataaaatatatgaagaattagaactttccagaagtgatttagcgattttactatgtgccatgcttatcgcctctatcggattaaatatggattcgactcccgtgattattggagccatgttaatctctcctttgatgacacctattctgggagtggggctctctctagctatatttgattttaaattgttaagaaaatcttttaaaatattagctattcaaattcttgccagtctaatagcttcaacactttatttttatctttctcccatttcgtatgctagttcggagattgttgctagaacctctccgactatttgggatgttctcattgcttttgtaggagggatagcaggtatcattggtgctaggaaaaaagagac

SEQ ID NO: 113 - DNA, 18627 bp; double-stranded, linear
gaagttgaaatggccagctgatgagcaatatcggtcatagaaatcttctcaatcaacttttgcgcaattttttggttgataatacgaggaatttggtgatttttcttgacgatagaagtttcagcgaccatcatttttgaacagtgatagcacttgaaacgacgctttctaagtagaattctagtaggcataccagttgtctcaaggtaaggaatcttagacggtttttgaaagtcatatttcttcaattggtttccgcactcagggcaagatggggcgtcgtagtccagtttggcgatgatttccttgtgtgtatctttattgatgatgtctaaaatctggatattagggtctttaatgtctagtaattttgtgataaaatgtaattgttccatatgaatctttctaatgagttgtttggtcgcttttcattataggtcatatgggactttttttctacaataaaataggctccataatatctataagggatttacccactacaaatattatagagccaaaaatcctttgtttactaaacaagggatttttcttttgtctctgctccttttttgatataatagttctatgttaaaatcagaaaaacaatcacgttatcaaatgttaaatgaagaattgtccttcctattggaaggcgaaaccaatgttttggctaatctttccaacgccagtgctctcataaaatcacgttttcctaataccgtatttgcaggcttttatttgttcgatggaaaggaattggttttaggccccttccaaggaggtgtttcctgcatccgtattgcactaggcaagggtgtttgtggtgaggcagctcactttcaggaaactgttattgttggagatgtgacgacctatctcaactatatttcttgtgatagtctagctaaaagtgaaattgtggtgccgatgatgaagaatggtcagttacttggagttctggatctggattcttcagagattgaggattacgatgctatggatcgagattatttggaacaatttgtcgctattttgcttgaaaagacagcatgggactttacgatgtttgaggaaaaatcttaatgtatcaagcactttatcgaaaatatagaagtcaaaacttctcccagttagttggtcaagaagttgtggctaagactcttaaacaagcggtggagcaagagaaaataagtcacgcttatcttttttctggtcctcgtggaacgggaaaaaccagtgttgctaaaatctttgccaaggctatgaactgtcccaatcaagtgggtggcgaaccttgcaataactgctatatttgtcaagcagtgacggacggtagtttagaagatgtcattgaaatggatgcagcttctaataatggggtagatgaaattcgcgaaattcgtgataaatctacctatgcgcctagccttgctcgttataaggtttatatcatagatgaggttcacatgctgtctacaggggcttttaatgccctcctaaagacgctggaagaaccaacacagaatgtagtctttattttggccactactgaattgcacaagattcctgctactattctatcccgtgtgcaacgttttgagtttaaatcaattaagacacaggatattaaggaacatattcactatatcttagaaaaagaaaatatcagttctgaaccagaggctgtggaaatcattgccagacgggcggaaggtggaatgcgggacgccttgtctattttggatcaagccctgagtttgacacagggaaatgagctgacgactgctatctctgaagaaattactggcaccattagcctatcagccttggatgattatgtggcggccttgtctcaacaggatgttcccaaagctttgtcttgcttgaatcttctttttgacaatggtaagagcatgactcgttttgtgaccgatcttttgcactatttaagagacttgttaattgttcaaacagggggagcaaatactcatcatagttcagtctttgtagaaaatttggcacttcctcaaaaaaatctgtttgaaatgattcgcttagcaacagtgagtttagcagatattaagtctagtttgcaacccaagatttatgctgaaatgatgaccgtccgtttggcggaaatcaagtccgaaccagctctatcaggagcggttgaaaatgaaattgctacgctgagacaggaagttgcccgtctcaaacaagagctttctaatgtaggtgcggttcctaaacaagttgcaccagctcctagtcgaccagctacgggcaaaacagtctatcgtgtcgatcgcaataaagtgcaatctatcttacaagaggccgtcgaaaatcctgatttagcacgtcaaaatttaattcgtttgcagaatgcctggggagaggtaattgaaagtctaggtgggccggacaaggctctgctagttggttctcaaccggttgctgccaatgaacaccatgctattcttgcttttgagtctaacttcaatgctggtcaaactatgaaacgagacaatctcaataccatgtttggtaatatcctcagtcaggcggcaggtttttcacctgagattttagctatttccatggaggaatggaaagaagttcgcgcagccttttcagccaaagccaaatcttctcaaactgaaaaagaagtagaagaaagcctgattccagaaggatttgaatttttggctgataaagtgaaggtagaggaagactaaagaaagatttcatgatacaataagtttatgaataaacaacaatttattattatggcgctgtttacagctgctgagacctattttttcaatgaagcctggatgactggccgctatattatggcagccttttgggcaattttactctttagaaatttccgagtcagttatgtgatgggcaaaatcgttgatgtcatcgatcagcattttaataggaaagactagccctcagcttccagacaaaatcaaagccttttaggcttttttttgttatactagaaaagtatatttatagaatttttgctctatttctggggaaatcagacgtttttctagtaagtactgtaaaagttttgaaaaagaaaggaactatcatgtcagtattagagatcaaagatcttcacgttgagattgaaggaaaagaaattttaaaaggggttaacctgaccctgaaaacaggagaaattgccgctatcatgggaccaaatggtacaggtaaatcgactctttctgccgctatcatgggaaatccaaactatgaagtaactaaaggtgaagttttgtttgatggcgtaaacatccttgagttggaagtggatgagcgtgcgcgtatgggacttttccttgctatgcaatacccatcagaaatccctggaattaccaatgctgagtttcttcgtgccgctatgaatgcgggtaaagaagatgatgagaagatttcagttcgtgagtttattactaagctagatgaaaaaatggaattgctcaacatgaaagaagaaatggcagagcgttacctcaacgaaggcttctctggtggtgagaaaaaacgcaatgaaattcttcaacttttgatgttggagccaacatttgctcttttggacgagattgactcaggtcttgatattgacgctcttaaagttgtgtctaaaggtgtcaatgccatgcgtggtgaaggttttggtgctatgatcatcactcactaccaacgtcttttgaactatatcacacctgatgtggtacacgtgatgatggaaggtcgtgttgtcctttctggtggtccagaattggctgcgcgtttggaacgtgaaggatacgcaaaattagctgaagaacttggctacgactacaaggaagaattgtaattccctcgtatcttttaggagaagtaaatgactagagaaaatattaaacttttttcagaaatgcacgctgaaccaagctggttggctgatctccgtcaaaaagcttttgacaagattgagactttggaattaccagttattgagtgtgtcaaattccaccgttggaatctgggtgatggaacgattacagaaaatgagccatcagcaaatgttccagatttcacagctttagatcatcacttgaagttggtgcaagtaggaactcaaactgttttcgaacaaactccagttgagttagctgaacagggtgttgtcttcacagactttcactcagctttagaagaaattccagagctgatcgaagaattcttcatgtcatctgttaagtatgatgatgacaagttggcggcttaccacacagcttactttaacagtggtgctgtactctatattccagataacgtagaaatcacagagccaattgaaggaattttctaccaagatagcgatagcaatgtgccgtttaacaagcatattatgattatcgttggtaaaaattctaagattagttatctggagcgtttagagtcacgcggtgaaggaagtgacaaagcaactgccaatatcacagtggaagtgattgcacgttctggtgcgcaagtcaagtttgctgctatcgaccgtctaggtgaaaacgtcactgcctacattagccgtcgtggtaaattaggcaacgatgcaagtattgactgggctatcggtgtcatgaacgaaggaaatgtcgttgctgattttgatagtgacttgattggtaatggtagccatgctgacctcaaggttgtagctctttcaagtggtcgtcaggtacaagggattgatactcgtgtaactaactatggctgcaactcaatcggaaacattctacaacatggggttatccttgaaaaagcaactttgactttcaatggtatcggccacatcatcaagggtgctaagggagcagatgcgcaacaagagagccgtgttctcatgctttcagaccaagcgcgttcagatgctaacccaattcttttgattgatgaaaatgacgtaactgcaggccatgcagcctctattggtcaggtagatccagaagatatgtactacctcatgagtcgtggcttggataaggcaactgcagagcgtttggttgttcgtggtttccttggatctgttatcgtggagattccagtcaaggaagttcgtgatgaaatgattgcaactatcgaagagaaattgtcaaaacgctaaggggcagcctatgttagatgtagaagcgattcgcaaggattttccaattttagatcagattgtcaatgatgaacctctggtctatctggacaatgctgcgacgacacaaaaaccactagtagttctgaaagctattaacagctactatgagcaggacaatgccaatgttcaccgtggtgtccataccttagcggaacgagcgacagcttcttatgaagctgctcgtgaaaccattcgtaagtttattaatgcaggctctacaaaggaagttctctttaccagaggaacgacaaccagccttaactgggtggcacgctttgctgaggaaattctcactgagggagaccaggtcttgatttcagtaatggaacaccattctaatatcattccatggcaggaagcttgtcgaaagactggagcagagcttgtctatgtctatcttaaagacggtgccttggatatggaggatttgcgagctaaattgactgataaggttaaatttgtttccctagctcatgcctccaatgttcttggtgtggtcaatccgatcaaggaaatcactcaattagcccaccaagttggggcaattatggtagtggatggtgctcaatctacacctcatatgaagattgatgtccaggacttggatctggactttttcgccttttcgggtcacaagatggctggtccgactggtatcggtgtcctttacggcaaagaaaagtatcttgagcaaatgtctccagtagaatttggcggcgagatgattgattttgtctacgagcaatttgctagttggaaggaattgccttggaaatttgaggctggaacgccaaatatggcaggagctattggacttgcgactgcagttgattatctggaaaagattggtatggatgccgttgaagctcatgaacaggaattgattgcgtacgtctatccaaaactgcaggcaattgagggattgaccatttacggttctcaggatttggctcaacgttcgggtgttattgcctttaacctaggtgatctccatcctcacgatcttgcgacggctctggattatgaaggagtggctgttcgtgctggtcaccattgtgcgcaacccttgcttcagtatttggaagtcccagcaacagctcgtgcaagtttttatatctacaataccaaggcagattgcgacaaactagtcgatgccctacaaaagacaaaggagtttttcaatggcactttctaaactagatagcctttatatggcagtggtagcagaccattcgaaaaatccacatcaccaagggaagttagaagatgctgagcaaatcagtctcaacaatccgacttgtggggatgtcatcaacctctctgtcaagtttgatgcagaggaccgtttggaagatattgcttttctaaattcaggatgcacgatttcaactgcttctgctagtatgatgacagatgccgttttaggaaaaaccaaacaagaaattttagaactggcgactattttttctgaaatggttcaagggcaaaaagatgagcgtcaagaccaacttggagacgcggcattcttgtcaggtgttgccaaattccctcaaagaatcaagtgtgcaaccctagcttggaatgcccttaagaaaacaattgaaaatcaagaaaaacagtaagacaagtttcttttgtcttatgaattattagaaatgaagaaagaaaggatactatggctgaagaaagagtagaaccaaaaccaattgaccttggtgaatataaatttggtttccatgacgatgtagagcctgtcttatcgacaggaaaaggactcaacgaaggtgttattcgtgaattatctgctgctaagggtgagcctgagtggatgttggagttccgtttgaagtcttatgaaaccttcaaaaaaatgcccatgcaaacttggggagcagacttgtcagagattgactttgatgacttaatctactaccaaaaaccatctgacaaaccagcccgttcttgggatgatgtacctgaaaagattaaagaaacctttgaacgtatcgggattccagaagctgaacgtgcttatttagcaggggcttctgcccagtacgagtcagaagtggtttaccacaacatgaaggaagagttccaaaaattaggtattatctttacagatacagattccgcactcaaggaatacccagacttatttaaacaatactttgcgaagttggtaccgccgacagataacaagttggcagccctcaactcagcagtatggtcgggtggaacttttatctacgtgccaaaaggtgtcaaggtagatattccacttcaaacttatttccgtatcaataacgaaaatataggtcagttcgaacgtaccttgattatcgttgatgagggagcaagcgtctactacgtagaaggatgtacagcaccaacatattcaagcaatagcttacacgctgccattgtagaaatttttgctttggacggagcttatatgcgttatacaactatccaaaactggtctgataacgtctataacttggtaacaaagcgtgctaaggctcaaaaggatgccactgttgagtggattgatggaaacttgggtgccaaaacgactatgaaatatccatctgtttaccttgatggagaaggagcgcgtggtaccatgctctctatcgcctttgctaatgcagggcaacaccaagacacgggtgctaagatgattcacaatgctccacataccagctcgtctattgtgtctaaatccatcgctaaaggtggaggaaaggttgactaccgtggacaagtcacctttaacaagaactctaagaaatctgtttcccacattgaatgtgataccattatcatggatgacttgtcagcatcagatactattccatttaatgaaattcacaactcgcaagtggctttggaacacgaagccaaagtatctaagatttcagaagagcaattgtattatctcatgagccgtggattgtcagaatctgaggcaactgaaatgattgtcatgggatttgtagaaccctttacaaaagaacttccaatggaatacgcagttgagctgaaccgcttgattagctatgaaatggagggatcagttggataaaatttgattttatactcttcgaaaatctcttcaaaccacgtcagcatcgccttaccgtatgtatggttwctgattcgtcagtttcatctacaacctcaaaacagtgttttgagcaactgcggctagcttcctagtttgttctttgattttgagtattagatttactcaaaatcaaggattttgaagatgaacttgtatcaaaaaatcgcggtttaaaatcgcgattttttataatttctcgttaacaaagcggacaaactgattccaccaaacttttaagaagaaggctttttcaattttcttgtctgctaccatttcgaaactagggcgctctgtggtgatgtaaccttgaccaatcaagtccttgtcttcataagtcaaatggccaaccactgttccagcttcaagtggtgctgggattgctttggaatcaggtgtgaattgaacagattgggaagattgattcccaacacgttcgattagatagatatcctctggagccactgcagttactgtatcttcttttccatcttgtacaggggctttgctatcttgataggcatcgccttgttgaacgattttgcgaagtgtaaatgtagaagaaatataatccattagggaagatgtagctgtaaatcgagcgtaaggattattgtcttgatgatctgcatttaaaacaactgtgatgactctcatgcctttttcgacagtagtaccaacaaaagactctccagccttatctgttgttcctgtttttagcccatcaaaaccaccacggtaagcaggcataccttctaacatgtagttggttgaagtgattgtcatcccagcaaaagtagaagaaggttttttggtgatttctaagacttgtgggtattttttgatgaggttgcgagcaacgatagcgacatcataagcactaagcttattttcctcatcttttttagaacctgggtaaatgttatcccctagagtttcattgttaagacctgtcgtattgacaacagtggcatcctgaattccccattccaagagttttgcccgcatcatatcgacgaaatctttttctgagccagcaattttctcagctagggcaatagcggcgctgttggcactagataccagagttgcttcaagcaactcttcgacagtataattacgggcctccataggaatattactggcttcagaatttgtcgtcaattgataaggataatcagaaatatctacaggagtggagagggtaatacttccgttttccaaagcttcatagaccagataaacagtaatcaattttgttatggaagcaatttcgacaggttgcgttgcatccttctcatagagaattttaccagtatttgcctcaacagcaatcgcatgtttagcggcaatggtaaaatcttgagcaacagcagtagaagcaccccctaaaagagagacagttaacaaagttaaaaatatttttttcatagtagtcttattctatcataaagaaaaaaaatattcttgctttaataattcatctgttaagctttttgaaaatatggtaaaataaagtaagggaggtaactcatgtttcgtagaaataaattatttttttggaccacagaaattttactcttaaccatcatcttttacctatggagacagatggggtctttgattaacccttttgttagcgtgcttaatacaattatgattccatttttattagggggctttttttattatttgacaaaccctattgttactttcttaaataaagtctgtaaactcaatcgtttgcttggtattttaattaccttgtgtactttggtctggggaatggtcataggtgttgtctatctcttacctattttgattaatcagttatctagtttgattatatctagtcaaactatttatagtcgagtacaagacttaatcatagacttatctaattatcctgcgctccagaatttggatgtagaagctacaattcagcagttaaacttatcctatgttgatattcttcaaaatatcctaaatagcgtatcaaatagtgtggggagcgtcttgtcagctcttatcagtactgttttgattttgattatgactccagtttttttggtttatttcttattagatggacataaattcttgcccatgcttgaaagaacgattctaaagagggatcgcttgcatattgcaggcttattaaagaatttaaatgcgacgattgctcgctatattagtggagtttcgattgacgcaatcattataggttgtttggcttatattggctatagtattattggtttaaaatatgctttagtttttgccattttttctggtgtagccaatttaattccttatgtggggccaagtattggtttgattcctatgatcatcgcaaatatattcactgatccccatagactgctgattgcagtgatttatatgcttgttgttcagcaggtagatggcaatatcttatatcctcgaatcgtaggaagtgttatgaaggttcatccaatcacgattttagttttacttttgttgtcaagcaatatctatggtgtagttggaatgattgtcgcagtgccaacctattctatcttgaaagaaatttctaagttcttatcccatttgtatgaaaatcataaaataatgaaagaacgagaaagagaattagctaagtaaaagtcaggagaaccctgatttttctttactggaagtggcctttagattagaagactgaaaataagttaaagtcttaaactaattttcacagctaagaatagtagaagttaatctgataaaaatcgaaaaaaccagtggaattctgtgtcagggtaagttccactggttttcatagtctattaaagttcgaatgaaacctatttatagtagattgaaactagaatagtacacctctaattctaaaacattgttagaaatcgatttgactgtcctgatctattcgttctattcttatttcattttactatattttggtgcaataagtgaaaagtagtccgaataatataaggattgattttatagtttttaaactcaaatgaattgaaataaagagagtacgaaaattctcatctgaaagtattttagaataattctcttcgtgaatttcttcaaaacagatagcttcatcttaggtatgtgatttctttttgcatttttgagttagataaggtataatgattttattgtcttttggggtcgttacggattcgacaggcattatgaggcatattttgcgactcgtgtggcgacgtaaacgctcagttaaatataactgcaaaaaataacacttcttacgctctagctgcctaaaaaccagcaggcgtgacccgatttggattgctcgtgttcaatgacaggtcttattattagcgagatacgattaagccttgtctagcggtttgataagagattgatagactcgcagtttctagacttgagttatgtgtcgaggggctgttaaaataatacataacctatggttgtagacaaatatgttggcaggtgtttggacgtgggttcgactcccaccggctccattattcctttgcattcttttgcattccttggtaaaacgttgttaaatcaacgttttttatttttatctttggtattcctttgcattcttttgctaaaaagggagtcacaaacagaccctattttaaaaaaggatagaaaaaaggatacaacatttgtcgcatcctaaaaataatcttttttcgacggaagacatgggattcgaacccacgcacgctattacacgcctaccgcgtttccaacacggcctcttaagcctcttgagtaatcttccaatacttactcaaatagtctaccataaaggctcttatcttgcaataaaaattctagaaataagaaaaatgatagattttgaaagaaaatgataaaaaatgcttgacttcgaaagaaagtatgatagaatgaatagtgtaaacgataacaggaggtgattcagtgttaaaaacagaacgtaaacaactaattttagaggagttaaatcaacatcatgtagtttctctagaaaaattagttagtttgctagaaacgtcagaatcaacggttcgaagagacttggatgagttggaagcggaaaacaagcttcgtcgtgtgcatggtggagcagaactcccctactccttacaggaagaagaaaccattcaagaaaaatctgtcaaaaaccttcaagaaaagaaattgctggctcagaaagcagcctctctcattaaagaaaaagatgtcatctttatcgatgctggaacaacaactgcttttttgattcatgaattggtcaataagaatgttacagttgtgaccaactccattcaccatgccgctcagttggttgaaaagcagawtccaactgtcatggttggaggaaacgtcaagacggcgacagatgctagtatcgggggcgttgctcttaaccagattaaccaattgcactttgaccgtgcctttatcggaataaatggtgttgacgatggctattatacgactcctgatatggaggagggagctgtgaaaagagctattttggagaatgccaagcagacctacgtcttggtggattcgtcaaaaattggacaaacttgctttgccaaggtagccccactcaaacgcgctatcgttatcactagtcaagggcatgagctcttgcaggttattaaggagaaaacggaggtaatagaagtatgatttatacagtcacactcaatccatccattgactatatcgttcgtttggaccaagtcaaagttggtagtgtcaatcgtatggacagtgatgataagtttgctggtgggaaaggaatcaatgtcagccgtgtcttgaaacgtttgaatataccaaatacagcgacgggatttatcggtggctttactggtaaatttatcacagatactttagcagaggaagaaatcgagacacgttttgtccaggtggcagaagatactcgtatcaatgttaaaatcaaagcagaccaagaaacagaaatcaacggaacgggtccaactgttgaatcggttcagctagaagaattgaaagctattttatctagtctgacagcagaagatacagttgtctttgcaggttcaagtgctaaaaatctaggcaatgttatctataaggatttgatttccttgacgcgccagactggtgcgcaagtggtctgtgactttgaaggacagaccttaattgatagtttggactaccagcctcttcttgtaaaaccaaacaatcatgaacttggagcgatttttggggttaaactcgaaagtttagatgaaattgagaaatacgctcgtgagttactggctaagggtgctcaaaatgttattatctctatggctggtgatggtgcccttcttgtcacatctgagggagcttacttcgctaaaccaatcaaaggaacagtcaaaaattcagttggagctggtgattctatggttgctggattcacaggtgaatttgtcaaatcaaaagacgtagtagaagccttcaaatggggagtggcttgcggaacggcaactaccttctcagatgacttggcaacggcggaatttattaaagaaacatatggaaaagttgaggtagaaaaacgatgaaaattcaagacctattgagaaaagatgtcatgttgctagatttgcaggcaactgaaaaaacagctgtcatcgacgagatgattaaaaatttgacagaccacggttatgtaacagattttgaaacatttaaagaaggaattttggcgcgtgaagctttgacttctactggtttgggtgatggaatcgcaatgcctcacagcaaaaacgctgctgtcaaagaagcgacagttctatttgctaagtcaaataagggtgttgactacgagagcttggatggacaagcaactgacctcttcttcatgattgcagctccagaaggtgccaatgatactcacttggcagccttggcagaattgtctcaatacttgatgaaagacggttttgcagacaaacttcgtcaagcaacatctgcagaccaagttatcgaactttttgaccaagcttcagaaaaaactgaggaacttgttcaagcacctgctaatgactctggtgactttatcgtagctgttacagcttgtacaacaggtattgcccacacttacatggcccaagaagcccttcaaaaagtagctgctgaaatgggggttggtatcaaggtcgaaaccaacggtgctagcggtgttggaaatcaactaactgcagaagatatccgtaaggctaaagctattatcattgcagcagacaaggccgttgaaatggatcgatttgatggaaaaccattgatcaatcgtccagttgctgacggtatccgtaagacagaagagctaattaacttggctctttcaggagatactgaagtctaccgtgccgctaatggtgccaaagctgcaacagcctctaacgaaaaacaaagccttggtggtgccttgtacaaacacttgatgagtggtgtatctcaaatgttaccattcgttatcggtggtggtatcatgattgcccttgccttcttgattgacggtgctttgggtgttccaaatgaaaaccttggcaatcttggttcttaccatgagttagcttctatgttcatgaaaattggtggagctgcctttggtttgatgcttccagtctttgcgggttatgttgcctactctattgctgaaaaaccgggtttggtagcaggtttcgtggctggtgctattgccaaagaaggttttgcctttggtaaaattccttatgccgcaggtggtgaagcaacttcaactcttgcaggtgtctcatctggtttcctaggtgcccttgttggtggatttatcgcaggtgccttggttcttgccatcaagaaatacgttaaagttcctcgttcactcgaaggtgctaaatcaatccttctattgccacttcttggaacaatcttgacaggatttgttatgctagctgtgaatatcccaatggctgcaatcaacactgctatgaatgacttcctaggcggtcttggaggaggttcagctgtccttcttggtatcgtccttggtggaatgatggctgttgacatgggtggaccagttaataaagcagcttatgtctttggtacaggtacgcttgcagcaactgtttcttcaggtggttctgtagccatggcagcagttatggctggaggaatggtgccaccacttgcaatctttgtcgcaactcttcttttcaaagataaatttactaaggaagaacgtaactctggtttgacaaacatcatcatgggcttgtcatttatcactgagggagcgattccatttggtgccgctgacccagctcgtgcgattccaagcttcatccttggttcagcagtagcaggtggactcgttggtcttactggtatcaaactcatggcgccacacggaggaatcttcgttatcgcccttacttcaaatgctctcctttacctcgtttctgtcttggtaggagcaatcgtaagtggtgtggtttatggttacctacgcaaaccacaagcataaaaaatagaaaaatgaaaagattggaccgtttggtgcagtctttttctcttcccgaaatgcctgtgaaatatggtataatagaagaatggcaaacaagaatacaagtacaacaagacggagaccgtctaaagcagaactggaaagaaaagaagcgattcaacgaatgttgatttcgttaggaattgcgattttattgattttcgcagccttcaaattaggggctgcaggtataaccctttataatttaattcgcttgctagtgggtagcctagcttatctggcgatattcggcctattaatctatctcttctttttcaagtggatacgaaaacaggaaggactcttatctggctttttcaccatatttgctggcttactcttgatttttgaggcctacttggtttggaaatatggtttggacaagtccgttctaaaagggaccatggctcaggttgtgacagatctgactggttttcgaacgactagctttgctggagggggcttgatcggggtcgctctttatattccaacagcctttctcttttcaaatatcggaacttactttattggttctatcttgattttagtgggttctctcctagtcagcccttggtctgtttacgatattgctgaatttttcagtagaggctttgccaaatggtgggaagggcacgagcgtcgaaaagaggaacgctttgtcaaacaagaagaaaaagctcgccaaaaggctgagaaagaggctagattagaacaagaagagactgaaaaagccttactcgatttgcctcctgttgatatggaaacgggtgaaattctgacagaggaagctgttcaaaatcttccacctattccagaagaaaagtgggtggaaccagaaatcatcctgcctcaagctgaacttaaattccctgaacaggaagatgactcagatgacgaagatgttcaggtcgatttttcagccaaagaagcccttgaatacaaacttccaagcttacaactctttgcaccagataaaccaaaagatcagtctaaagagaagaaaattgtcagagaaaatatcaaaatcttagaagcaacctttgctagctttggtattaaggtaacagttgaacgggccgaaattgggccatcagtgaccaagtatgaagtcaagccggctgttggtgtaagggtcaaccgcatttccaatctatcagatgacctcgctctagccttggctgccaaagatgtccggattgaagcaccaatccctgggaaatccctaatcggaattgaagtgcccaactccgatattgccactgtatctttccgagaactatgggaacaatcgcaaacgaaagcagaaaatttcttggaaattcctttagggaaggctgttaatggaaccgcaagagcttttgacctttctaaaatgccccacttgctagttgcaggttcaacgggttcagggaagtcagtagcagttaacggcattattgctagcattctcatgaaggcgagaccagatcaagttaaatttatgatggtcgatcccaagatggttgagttatctgtttacaatgatattccccacctcttgattccagtcgtgaccaatccacgcaaagccagcaaggctctgcaaaaggttgtggatgaaatggaaaaccgttatgaactctttgccaaggtgggagttcggaatattgcaggttttaatgccaaggtagaagagttcaattcccagtctgagtacaagcaaattccgctaccattcattgtcgtgattgtggatgagttggctgacctcatgatggtggccagcaaggaagtggaagatgctatcatccgtcttgggcagaaggcgcgtgctgcaggtatccacatgattcttgcaactcagcgtccatctgttgatgtcatctctggtttgattaaggccaatgttccatctcgtgtagcatttgcggtttcatcaggaacagactcccgtacgattttggatgaaaatggagcagaaaaacttcttggtcgaggagacatgctctttaaaccgattgatgaaaatcatccagttcgtctccaaggctcctttatctcggatgacgatgttgagcgcattgtgaacttcatcaagactcaggcagatgcagactacgatgagagttttgatccaggtgaggtttctgaaaatgaaggagaattttcggatggagatgctggtggtgatccgctttttgaagaagctaagtctttggttatcgaaacacagaaagccagtgcgtctatgattcagcgtcgtttatcagttggatttaaccgtgcgacccgtctcatggaagaactggagatagcaggtgtcatcggtccagctgaaggtaccaaacctcgaaaagtgttacaacaataaaaaaatagcttctttccaagtttggagggaagctattttagtggctattgattgcttttattttctgaagttggcgcattggactgtttttcgttttcagtagcaggtttacttgaagcaggagtagaagagtcctgagttgctgttttctgatcttcttttttctcttccttgacgctagattttggtgtttcctcttgctgtgttttttcttgactagtgttagtctctttagttggactggtgttttccttaggggattccttttggatttctttgacaatggttgtcgtctggcttgtcgtaggttcttttttaatatttttgttattatccaaggcgtt

SEQ ID NO: 114 - DNA, 2560 bp; double-stranded, linear
taaaatacgttaccttgcttctgcacgttcagcaggtaagtcattgaaatttaaagatcaagatattacaattgaagaaacgactgaaacagcttttgaaggagttgatattgctctcttttcagcaggtagttctacatcagctaagtatgcaccatacgcagtaaaagctggcgtggtagtagtagataatacatcttatttccgtcaaaatccagatgttcctttggttgttccagaggtcaatgctcatgcacttgatgctcacaacggaatcattgcctgccctaattgttcaacaattcaaatgatggtggctcttgagccggttcgccaaaaatggggcttggaccgtatcattgtttcaacttatcaagccgtttcaggtgctggtatgggagcaattcttgagacacaacgtgaacttcgtgaagtcttgaatgatggtgtgaaaccacgtgatttgcatgcggaaatcttgccttcaggtggtgacaagaaacattatcctatcgcctttaacgctcttccacaaattgatgttttcactgataatgattacacgtacgaagagatgaagatgaccaaggaaactaagaaaattatggaagatgatagcattgcagtatctgcaacatgtgtgcgtattccagtcttgtcagctcactctgagtctgtttatatcgaaacaaaagaagtggctccaatcgaagaagtaaaagcagctatcgcagccttcccaggtgctgttcttgaagatgatgtagctcatcaaatctatcctcaagctatcaatgcagttggttcgcgtgatacctttgttggtcgtatccgtaaagacttggatgcagaaaaaggaattcacatgtgggttgtttcagataaccttctcaaaggtgctgcttggaactcagttcagattgctgaaactcttcatgaacgtggattggttcgtccaacagccgaattgaaatttgaattaaaatagtcatatcgtttaggagttcagatgaactccttctttgaaatagagaggtgttttcgtgtcttatcaagatttaaaaaaatgtaaaatcattacagcctttattacccccttccatgaggatggttccattaactttgatgctattccagccttgattgagcatttattggcccatcatacggatggaattcttctcgcaggaacgactgctgagagtccaactttgacccacgatgaggagttggagttgtttgcggctgtacaaaaggttgtcaatggacgcgttcctttgattgcgggtgtaggtactaatgatacgcgtgactctattgagtttgtcaaagaagtagcggaatttggtggtttcgcagctgggcttgctattgttccttactacaacaaaccttctcaagaagggatgtatcagcactttaagactattgcagatgcttctgacctaccaattattatctataacattccagggcgtgtagttgtcgaattgactccagaaaccatgcttcgcttggctgaccatccaaatattatcggtgtcaaagaatgtactagcttggctaatatggcttacttgattgagcacaagcctgaagagttcttgatttatacaggtgaggatggagatgctttccatgccatgaaccttggggcggatggggttatttctgttgcctctcatacaaatggggatgaaatgcacgagatgtttactgcgattgcagaaagcgatatgaagaaagccgcagcaattcagcgtaaattcattcctaaggttaatgctctcttctcttatccaagtcctgctccagttaaggcaattcttaactatatgggatttgaagctggacccactcgtctacctcttgttccagcaccagaagaagatgccaaacgcattatcaaggttgtcgtagatggcgactacgaagcaactaaggcaactgtaacaggggtcttaagaccagattactaataaagacaataaaatccggctctttgtcaactgtagtgggttgaagtcagctaagctcgagaaaggacaaattttgtcctttcttttttgatattcagagcgataaaaatccgttttttgaagttttcaaagttccgaaaaccaaaggcattgcgcttgataagtttgatgagattattggtcgcttccaatttggcgtttgaatagggtagttgaagggtgttgacgattttctttttgtcctttagaaaggttttaaagacagtctgaaaaataggatgaacctgcttcagattgtcctcaatgagtccgaaaaatttctccggttccttattctgaaagtgaaacagcaagagttgatagagctgatagtgatgtttcaagttttgtgaatagctcaaaagcttgtttaaaatctctttattggttaagtgcatacgaaaagtaggacgataaaatcgcttatcactcagtttacggctatcctgttgaatgagtttccagtagcgcttgatagccttgtattcgggattttcgatgaaactgattcatgatttggacacgcacacgactcatagcac

SEQ ID NO: 115 - DNA, 11303 bp; double-stranded, linear
tattggatttcccttgcaatcagtttatgggacaagcacccggcagcgcagaggaaatcaacgccttctgtagcctacattttcaaaccaccttcccacgttttgccaagattaaggtcaacggtaaggaagcagaccctctctatgtctggttacaagaccagaaatccggcccactaggaaaacgagtcgaatggaatttcgctaagtttctcatcggtcgagatgggcaagtctttgaacgcttttcttcaaaaacagacccaaaacaaattgaagaggcgatacaaactctactataattcacaatctcactatgattaggtttcctttaacctgatgaatagtgagattttttgatgggctttgacttaaatagaaaaacaccccatgatatgaaacatgaagtgttgtaaagtctatgttgtaggtgcttatttcacaatttcaatgtgaccagtgataacgaataccatacagaatcttcatatacactaaacaaatgactttctaattatttcaattagttttggctagtaaatatcatttccaacaaacgccctctcaattccttatcctgatgatgcaagatattcattaagtcatgagagtttttcgcattgatgaattgatttaacaatctatcttttaattcatatggaagagaagctgtctttagtagtctaaaaacttcgtcatttaaagatgtccttttattatctttccattcaaatttagctgtatcattcttatttggcaattcaattatagacacattcgttcctttaaaatgaattctatgttttctattgcttggaacgatactagaatctccttgtaatgctaactctaccattcccatttcccaatcgattgataatcttgttttatatctttgaccattttgatcttcaagcatttcaaaagaatgttgttttcctgggaatacataccaatctacaacttcaggtaaatcaacacccatacctatctcagaaccaaccaagggaatgattgcaccactttttgcaaacacaggcgtagtcgagatgtccctataaacacttaacttcacaccacctgtgtattttttctctgaaaagaagtcataccattcaccttcagggaaccatacatctacttttgcagattggaatgtcaaatccatcttttctacaatgggagccaccatcagttctgttccaaaaaagtattggtttggaacattatagctctcatcattctctggatagaaataatagattggactgattaatggggcaccttcctcatgtgtctgtacattcatggtatatagatagggaatcatctgatgtctcaaacgaaggtatttcttcataatcttagatgttgtttctgaaaaaaaccaaggttctttactattaaaaggacttctagaactatgtaatcgagtaatcggactaaaaacaccaaactgtagccatctagtttgtagctcttcgtcataatcccccaacatatgtccaccgatatcatgactccaccaactataaccgatattagatgctgtcgctgtaaaatagggttgaaatcttaaggaattccaactaataatagtatcccctgaaaaaccaacagggtagcggtgactaccaggacctgcatatcttgataaaatcaaaccaccttctgcatttttacaactatcctgatagtgataatggtttaaaagccaaagtggatctagcataccttgtgtcccttgttgccagtcaatccaccaaaaatctactccctgcttttctagttcataatgaacatctttaaagtaggcttccctaaaagagggattaaaaaaatcaaaaatagcaggttcttctagttctacatttaaccccaaccgttttgcgatttgaggataagcttcttcataagcccgtatcccatcagcaggatggacatttaaggagagttttagctttctatcatgaagttgttgcaataactgttctggatttggtattaagtttctattccaactatatcctgtccagccacttccaaagcgagctggaatgtcagttatatgccaatccatatctaacacaccgatagataatggaattttctctgtttcaaatctgtctattaaatccaagtattcatccgacgtataaggccaatatctactccaccaattgcctaaagcatatcttggcaacaagggtgttgaaccagtcaaatggtaaaaatctctgattgctcctctataatcatgcccataggcaaagaaatacaggtcaatttgattttctctctcaatataaccagattgttcatcccaaataaatccttgagaatcatccaataaggctataccatttcggctaataattccatcttctaacgagattgctccatctgccttatccagagtccgagctgttccttttaacgtttcaatagattcaccaaaataccagcgactaccatatacggcaaaatttccttttaattctataaataaattttcggcgttaaattctcctttattaaagtgcagatgaaaatagtccgtcataatatctagtacgtttgatgtctcgatataatctaacgaaatttggccaaaatctctattatagataagttgtgtcgttctatcctcaaaacttccagtttgagagtattctaaccttactagcttgtctgttaatacagagattcgataaaactctcccttaaaaattttcaatttgttttcctccttttatggtagcataaaaacagaacgcaccatttttgatgcgtttttcattattctgaatgcaatgttctatctgttatatctatgacaaataatagtcaattgaaaaaatgcagtggacaaaatatcttttaacaaaccaagagtttattaaagagttatcacttttcaacttttctaagcttatgcagttgtgaaacaaactacttttaaactattaactaagataggattgataaataatttcaaactcttactagcaatcatacgatattcaagctcacgtgcttttttccttcctgcttatttcttagaactgaagaacccggatcggtatataaattatccggatcaacatagtcataagattcataacagttgcgcttcattaagtcatccccagagcaagagcttcatctcgtaatttttcaacatcactaaccgtaggtcgccatccttcaatcatatttgtacttaaagcataccaaacactcttaaaaacggatcggttttcaaaagctattcccatgattgtcatcttttctttatctatatctaaggacatatgctacctcctttagatacattataccatgtttctctgtagcttttaaaaattttattttgtttgtcatatctaagttttcagcacgcttatcctattttataagcctcaaacccaaatataaaacgcattctttttgcttttttactattgtatcgtattctacgataacatactttactttattgtttttttaaataacagcagttccctgtttatcaactattcgaactactttctattttgcttcataccctacatagcgaaaaaatatgaaaaagcagagaagaatatcttaaaaagacctcttcactgctaatattaacactcattatttaaactatatggattctatcatcgagtatacttttttacttattagataccttgctcttctttcaccaatttttgatcatatacacggatgaatggaagatagactaggaatgctgcaaatgcacatactagagcaactaatacagctcgaagatctgctgtccctaagaaagctccaatccctactggagttggccatggaacctgtgcgataattggcttaataaagtttagagaattcgctacgtaataaatagtagcagtaaccattggtgctaaaataaatggtatagccaaggctggattatagataataggtaatccaaaaattaatggttcattaatattaaataaggctggaactacagatgctcgtcctattgctttaagctgttcagatttagaggcaaaagcaatatataaacatagtcctaaagttgcaccagaaccacctgcaattacaaacatattagaaaattcacctgcaacagcgaagtgcccgccagcagcattttcagccatgttagcaagagcaattggactaacaaatgcaaaaacaatgttcgcaccgtggatacctacaatccaaagtagttgagtcaatagataaataatcattaaaccaatccacgaattagtcagattggatacaaaaccaaatggaattgcaatgactttaaaaatatctgttcccattgctacaagaagaccgttgataaagataacaacaaatgcaacaacaaatcccggaaccaaagcggtaaatccacgagaaactccttctggaacagcttcaggcattttaataacccaattatgtttaacacacatacgataaataagaacagtcacaattgccataatgattgcggtaaaaatccctgttgtcccaaaacgtgcgactacatttcccattgcccatccatctgcaattactgcaccttcttttagacttgtcacagtcttcatcattccaccatcaaaaatgatttgcggtactgtcatgacaaaagccatcaaggcaagcaaggcaccattaagaggattcatattgagttcttcttcctctgcataaatttttgtcaattcatatgcaagtgatagaacgaaataaagagatagagaacccatagtcgcatagtttgcaaccatgtaaagtgatgtgaatttatcaaatgaagcagagaaaatatctgccacaattggccaaaatgagaaagcttgtggcaaaatactgaataccaaaaacattgatcctacaatagtaaatggtacagcagccatacctgcagccgtgatagcacgtactactttaaactgagcaagtttgcccattggtcccataacatggttttcaagaaaaccaaacaacccgttttgttgatccataaatagacctccttaataaaacataataatttttactttctaaagactagtttcaaatacaaattatactagatcaggattataaactaagtgagttcttttccaattggacaaattgttgataagccttatctgttcgtttataaatttttttaattcttctaatgtctaacaaactcagaactaaacctaatagaagaactacaaaaacaaataaacgtgctacttggttattttcaaaaatcggaaaaagattcttaaaccaacttgtccaagttaaaacaagtaatcctattgaaataagcatttgtattctaacaaacattagtgttattcccaacttttctttcctatttccataaagtttaaattgttcaacagttgctaaaatagaaaatactatgagcataatggggaaaataataataggcgagggactaataaactgactcaaaagccaataaatattcccaaaaaagaagagtgctattgaataacgtagaagaagatatcgattgaaaaaagtattagttagagccatctctcgacgttgttgttcaatcttttgtcgttcttttttatccatatcatttcctccttatataacaacacatatttagttaactttcttataaagagctaacatttcctttgctacttctaataatgtcatagtggtcattaaatgatcttgagcatgtaccatgataatttcaattttaatttccactccacttgcgtattcttgcaagagtttggtttgtgcatgatgcgcttcaagaattatctcatttgattgatttaatttactttctgcatcatcaaaactaccttctctcatttttgcaaatgcttcatgtatttctgaccttgcatttcccgaatgcaggataatttcaaatgctgcaacctgcagttcctcttgattcatataaacctcctattttatcttctcaaatatgttaataaaatcttcaaagttattgcaagatattagctgattttgcaattcatcattctctgtcagagagactatctttttagtcacagttgccaaaccttcgttcccatatattgatggagatagaagaaatactagctggacatgtgaactttgattatcccagagtaacgaatctttacaaattgcaaccgaaacctttccctctgtaccaaagggctgaataggatgcggaactgcaattttttcagaaaaaacaactgaacttaattcttcgcgctgtttaattccataaagtaaagattgttcaaactcatttgattcaccaacagataaactctcaaccatcttttcaagtaaatttaccttgtctgattcagtacatattaaaaagttttctttactaaaatactgtctaaagccgttgttttcaaatttgttaatctttgatgattgtacataactagaaacttgcatctaatccatagcttttctaatcatttccatctcatcactcttaagaaacacactaactttaaaaactgggatttgaaaatatagatttgataaatcaatagctgacactataaaatctattcctttaagtttttcttgattcaattcatagtagcctattacatcaacaacttctactcgcttcccaaactccgtttccaaacgatttcttaacatttgggctgcaccaaatcctgttgcacaaatagcaagaatattaaacttagtactctctttgctacgttccatagcagctaaaaagtgaagacttacatatgctacttcatcatctgatattgtccactccaagaacttgtccatatttgcaagaatttctctagtcataaagaatatatcactataattctgtttaatttcatctaccaaagggttatttaaggtaatccggctttctaaacgtacttgtagtgtcattagatgagttatcaatccttcaattagttggaaatctgaagaaaagttatacatatcatctaatcctaaattctgaaatgttttaaataaagatttttttaaaacttcttcagaaatattcttctgatttttttgacattgttgactcttagctaacaaatgcaaagtaatgtagtctatttcctgaactggaaattcctgatttgttacttctcttactttagaaagaattctttgggcaacctttctctctattgcatcatcagtcatctgacagtctatattttttatttcaaatccggattttaaacgaatcacagacaatgctatgtgaactactaaattctgtagtacaaaatcagatagttttaggttggcctcttggcattcatccaaaacaattctagcaaattcttctaatggaacagtttgatcaaaaaagttaaattttacatagcaatgtattgttttaaaaaattgattctctaggaaataatttatgataaaacgtcgtttatcacgttcctcgcctgagacataaactcctttattcgccctactctcaatggacaaattatactctgataacatcactcgtatctttctgaaatcatgagataatgttgaacgactaacgtaaagttcatcagctaaatcatcaaaaagaactggaacttgctcaaataataatttatttaagataaatactaaacgatcatcaccttttgaaaccgcagttttcgtatagtcttcttccagttcataagtttgtctaaactcctggtaagcgccttgattctcaaaaaatatttgatacccttgaccttgttttgaaatcaaccggactccttgaataatcattgtcttctcaattaatttcagtacattacggacagttctatctgaacaggataaatattctgccagttctttgcttgtaacaaaacgttccttattttttattaaaaattgaaggatatctttctctttaatgtttaacacattcattccctcctaaaacgtatgttttcatatattgaagcatattatacacttaaatcagtttatatcaaactcaaaacaatttatcttaacctaaatatttattgacatttcatgtgttcatcaaatattctcaagaatcaaattagccattttttcaattcccattggaataggaatataggcttgaggaggtatttgtacaactggttttcctgctttagaaccagcctcttcaaattgcttaaagtacatttttgtttgaggactgacaagatacaaatcaaaagctgctgctgcgatagctttccctccttcagtagcactaatagcatcaactacaatatctttcccttttccttttagaaactctgttgttttctgtgccataagtgatgaagacattcctgctgcacaaataattaaagcttttgccataatattttctccttttcttaaatccaatcaaagctgtgctaagttggcttatttgttatctatttttattataaaataaagcgtttccaatgacaattccctcattttcctaaatgatatggaaaaaaattatttatacttcaatttataaaataaaattattcctgagagtagaaatgaaacactatttgctaaaatcaaaggcaagtctcctatacgaataccatgagcaagccacaatgcaataccaataacttgcataacatacatacctagagcaatagatcctgtgtcctttgtcttaactacacgaaaaacttgtggtaaaaatgcaaatgttgttaaaattgctgcaatacttccaatcatatgtcacctcaatatgctaaacaaactgagaataatctcagtttgtttatactattctactgattcaccgttagatgaaataacttccttataccagccaaaagattttttcggggaacgattataacttcccttcccattatcatctttatctacataaataaagccataacgtttccgcatttcaccggtaccagctgaaaccaaatcaatacatccccatggagtataacccattaaatcaacaccatcttcaactacagcctttttcatttcacgaatatgggcacctagatattcaattctataatcatcatgtaccataccatctgctgcaacttgatctatagctccaaaaccattttcaacaataaagagtggtaagtgatagtggtctgtaaaccaatttaacgcataacgcaaaccttctggatcaatttgccactcccattcagaagccttaacataattatttttcactaaatcttctgtttcaagataatcaaaataaggattattttcacgatgagagtcgatagcaaaggacatatagtaactgaaaccaatgtaatctacagtcccaccaagtaaatcttctttatcctgggcagtaaaatcaactgaaataccttttcgttcccaatacttgaaaatatgctcaggatatttacctaaaacatgcacatcagcaaaataataacgcttctgcatagctttcattgccattaagatatccttaggattgcaagtaactggataaattggacacatcgcaatcatacaacctatttgaaaatctggattaatctcatgaccaatttttacagctcgtgcagaagcaactaattcgtaatgtgctgcttgatacataattgcttctctattatcaccttcctcatatacaatacctgagttagtaaatggtgcaaaatcttcctgataattcgcttgattattgatttcattgaaagtcatccaatatttaaccttatctttgtaacgtttaaatacgacttctgcaaaacgagcaaagaaatcaatcaatttcctatttttccaaccaccatattcggtcactaagtgataaggcatttcaaaatgagatagagtgatgacaggttcaataccattctttaagcattcatcaaaaagattatcataaaactgtaatccttcttcattcggctctaactcatcaccttttggaaagatacgtgtccatgcaatagaggtacggaagcacttgaatcccatttcagcaaaaagtgctatatcttctttataacggtgataaaaatctatcgcctcatgatttggataatatttaccctctaaaactcccaaagtaatttcacgagctactccatgacgaccagcagtcataacatcagcaacactaattcccttgccaccttcttgccatccaccttcaagttgatgagcagcaacagcaccaccccataaaaatccatctttaaaagtagtcatcttttttcctcctgactttgatactcttattataaaccttaaaccaaaagatgaaaacgcattctttttccttattgttaaggaaagaagtaatttttaatggaaatagaacaatatcttcttgtattctcgtaatgatatctttacgattttcaatactttcaaactacaaaaactctcacaataattctaattccctgtgtctataaacgacttatcgctttctggcatcccagaatcatcttctatataacgttcaacttgcatctgcaagtgatatttttttcttaaatctaagattttctgcattgtctttgattgataatgtttatctaaagtttcttgatttatccactgatcaataaggagaatagttccctctttttcaattggtaaaaaatattcgtatttcaagttacctttttgatttctaatttctttaacaaggccactatcaagcatttctcttgcaaactttattgcactatctccatcacctttataatatacatgaatagtcaatgtcatcttatatcctccaaaatcatccttcaattttaaaaaaacaagtttagatgaggatctaaacttgttttttatgaactaattatctaacgtttcgccattactttcaatcacttctttataccaataaaatgattttttcttatagcgatttatagtcaattgaaacaagagcaggacaaaagagcctcataaaaggtattgcaacttggtaatacctttttgaggtgctttttgatatgagcccatgttttctcaataggattgtactcaggtgagtagggaggaagaggtaaaagtttatacccaaactcttcacacaagagttctagcttccccattctatggaatcttgcattatccataataataaccgatggtgtggttaatgttggtaagagaaacttctgaaaccaagcttcaaaaaagtcgctcgtcatcgtctcttcgtaagtcattggagcgattaactcaccatttgttagacctgcaaccaaagaaatcctctgatatcttcttccagatacttt

SEQ ID NO: 116 - DNA, 3112 bp; double-stranded, linear
ccttagatttccacttgccagaggaattgattgcccaaacgccccttgaaaaacgtgatgcctccaaactcctcatcgtcaaccgtgagacaggagaaatgcaagataaacatttccactctattattgatatgctggaacctggtgatgcccttgtcatgaacgacacccgagttctccctgcccgcctctatggtcaaaaagtggagacaggaggtcatgtggaacttctcctccttaagaacactagtggagacgagtgggaagttctggctaaacctgccaaacgcctcaaggtcggtactcgtatcagctttggtgatggccgcctcagcgctgtcgttacagaagaattgacccacgggggacgcattgtccgctttgaataccaaggaattttcctagaagtcttggaaagtctgggagaaatgcctctgccaccttatatccacgaaaaattagatgaccgtgaacgttatcaaaccgtctacgccaaggaaagtggctctgctgcagcaccgactgctggtcttcacttcaccaaagaactgctggcagaaatccaagctaagggtgttcatctagtctatctgactctccatgtcggactcggaacctttagacctgtttctgtggataatctggacgaacacgaaatgcactcagagttctatcaactttctgaggaagctgctgccacccttcgctctgtcaaaaaaaatggtggtcgtgtcatcgctgtcggaaccacttctatccgcaccttggaaactattggttccaagtttgatgggcaaatccaagcagattctggttggaccaatatctttatcaaacctgggtatgagtggaaggtcgtggatgccttctcaaccaacttccacctgccaaaatcaactctggtcatgttggtttctgcctttgcaggccgtgaattagtcttagatgcctaccaccattccatccaagaacactaccgcttcttcagttttggtgacgccatgtttatttattgagaaagaatttctctaaatcttctaataccaataaatcgctaagatattatttcaaagaacatctacaattgaaactctagctagctgtagaagaggcctagtacattgaaattaaaatgcttccccctagcttcgaaaatattgccatagattgcgttgactctccaaattgattcatctatattttatttcagcttcctatactttcttcgctgtttgtaaatcaaaatgcaagacacatgagtagcaccatatttgttactcttatctgtcctctcaagagactattatgagttatttcagaatcattcactactttgaccctgactctccttagtctcaaaatcaaagacttatactcttcaaaaatctcttcaaaccgcgtcaacgtcaccttggattatatatgtgatctgacttcgtcagttctatctacaacctcaaagcagtactttgagcaacctgcgactagttttctagtttgctctttgattttcattgagtattaaacaaaaagtgaacaaatctgaattctaatgtacagaagactaggcttgttcacttttttatagtcgctataagatgaccttatctatagctttttatatataattatatattcagacatactattatcaattttgtcgcagggaggaatctgttaacgcacccattcaccattatcattgactctatagccatctatacttgtattgaccgctaactcacccgatgtatttacataataccatttaccaccaacttggaaccattgattgactttcatagaaccgttgctgttgaggtagtaccatgaactattaacttgtacccaacctgttgccatggaaccatcagtattataaaaataccacataccattttcttgtttccagtctgttgttggagcaactgctttagctggttctactgctacatctgttccttggttagatgtaacagatacaggatacgaaggaatagatgattgctcaggaacaacaactttttcaggttctctcgtccctctccttatacgtctttttaccatctctttagtaatttgacgagaagtagtttcttcaattgttccatcacgttcatctacagtatagattgtagtaagagtaatttaccaatttctcctacttcttctacttcttgacttttatcaagagttgggccatcgagatattctgtttcgattggaatttcttggacaagaacttggggcttggttctttttttaacaactcttgtttgagagtcttttttttgacttaaagtactctcagttacttgtccactctttccatctacattataagttatcgttgtaactgttttcccattctttcctagagtaatctcttgctcctgtcctgcagaaaggtcattgtctgcttcatatttagtagcaaatggaacaagaacttcttcaaccttgcttttagctggaactttgataactgtatccgtggcttcttttctatcaacagtaacctgttcggtaacataaccagtctctggattaacatcgtaggtccttgtcgtagttacatagccatcctctccatcaattgtaacaggattttcactacggtcttttgtttcatctttttcataacgaattcgcgtacttgaaattttcttggttactaccttaggtttagtcgctacttttacaataatatccccattgtcagcgtcatcatactctattccctcttctttatctctagtatcatctctgacatattgaatcccatcagcagcatgaacaaaacttgtattcagattcctcctaaaaataaagttagcccgattaccgcagaaccaaaaatctttccgagtttacgtattgcatagcgcttattagtattagattttgccattacatcctacttctagtatagcatcttttctatcaaacgttaaacaatatacgttatatataaaatagacttagaatgatatattgattattgaactaacactttaactatatcgtaatcaatctcatatataaaggattgcagacatcttatctaaatacatgcgaatatatttagatacaaacattccaacttgataat

SEQ ID NO: 117 - DNA, 4327 bp; double-stranded, linear
cccaaaaatctcttcaaaccacgtcagcttcgccttgccgtagtatggttactgacttcgtcagttctatccacaacctcaaaacagtgttttgagcatcatgcggctagcttcttagtttgctctttgattttcattgagtataaaaacagatgagtttctgttttctttttatggactataaatgttcagctgaaactactttcaaggacattattatataaaagaattttttgaaactaaaatctactatattacactatattgaaagcgttttaaaaatgaggtataataaatttactaacgcttataaaaagtgatagaatctatttttatgtatatttaaagatagattgctgtaaaaatagtagtagctatgcgaaataacagatagagagaagggattgaagcttagaaaaggggaataatatgatatttaaggcattcaagacaaaaaagcagagaaaaagacaagttgaactacttttgacagtttttttcgacagttttctgattgatttatttcttcacttatttgggattgtcccctttaagctggataagattctgattgtgagcttgattatatttcccattatttctacaagtatttatgcttatgaaaagctatttgaaaaagtgttcgataaggattgagcaggaagtatggtgtaaatagcataggctgatgtccatcatttgcttataaagagatattttagtttaattgcagcggtgtcctggtagataaactagattggcaggagtctgattggagaaaggagaggggaaaattggcaccaatttgagatagtttgtttagttcatttttgtcatttaaatgaactgtagtaaaagaaagttaataaaagacaaactaagtgcattttctggagtaaatgtcttatttcagaaatcgggatatagatatagagaggatcagtatgaatcggagtgttcaagaacgtaagtgtcgttatagcattaggaaactatcggtaggagcggtttctatgattgtaggagcagtggtatttggaacgtctcctgttttagctcaagaaggggcaagtgagcaacctctggcaaatgaaactcaactttcgggggagagctcaaccctaactgatacagaaaagagccagccttcttcagagactgaactttctggcaataagcaagaacaagaaaggaaagataagcaagaagaaaaaattccaagagattactatgcacgagatttggaaaatgtcgaaacagtgatagaaaaagaagatgttgaaaccaatgcttcaaatggtcagagagttgatttatcaagtgaactagataaactaaagaaacttgaaaacgcaacagttcacatggagtttaagccagatgccaaggccccagcattctataatctcttttctgtgtcaagtgctactaaaaaagatgagtacttcactatggcagtttacaataatactgctactctagaggggcgtggttcggatgggaaacagttttacaataattacaacgatgcacccttaaaagttaaaccaggtcagtggaattctgtgactttcacagttgaaaaaccgacagcagaactacctaaaggccgagtgcgcctctacgtaaacggggtattatctcgaacaagtctgagatctggcaatttcattaaagatatgccagatgtaacgcatgtgcaaatcggagcaaccaagcgtgccaacaatacggtttgggggtcaaatctacagattcggaatctcactgtgtataatcgtgctttaacaccagaagaggtacaaaaacgtagtcaactttttaaacgctcagatttagaaaaaaaactacctgaaggagcggctttaacagagaaaacggacatattcgaaagcgggcgtaacggtaacccaaataaagatggaatcaagagttatcgtattccagcacttctcaagacagataaaggaactttgatcgcaggtgcagatgaacgccgtctccattcgagtgactggggtgatatcggtatggtcatcagacgtagtgaagataatggtaaaacttggggtgaccgagtaaccattaccaacttacgtgacaatccaaaagcttctgacccatcgatcggttcaccagtgaatatcgatatggtgttggttcaagatcctgaaaccaaacgaatcttttctatctatgacatgttcccagaagggaagggaatctttggaatgtcttcacaaaaagaagaagcctacaaaaaaatcgatggaaaaacctatcaaatcctctaccgtgaaggagaaaagggagcttataccattcgagaaaatggtactgtctatacaccagatggtaaggcgacagactatcgcgttgttgtagatcctgttaaaccagcctatagcgacaagggtgatctatacaagggtgaccaattactaggaaatatctacttcacaacaaacaaaacttctccatttagaattgccaaggatagctatctatggatgtcctacagtgatgacgacgggaagacatggtcagctcctcaagatattactccgatggtcaaagccgattggatgaaattcttgggtgtaggtcctggaacaggaattgtacttcggaatgggcctcacaagggacggattttgataccggtttatacgactaataatgtatctcacttagatggctcgcaatcttctcgtgtcatctattcagatgatcatggaaaaacttggcatgctggagaagcggtcaacgataaccgtcaggtagacggtcaaaagatccactcttctacgatgaacaatagacgtgcgcaaaatacagaatcaacggtggtacaactaaacaatggagatgttaaactctttatgcgtggtttgactggagatcttcaggttgctacaagtaaagacggaggagtgacttgggagaaggatatcaaacgttatccacaggttaaagatgtctatgttcaaatgtctgctatccatacgatgcacgaaggaaaagaatacatcatcctcagtaatgcaggtggaccgaaacgtgaaaatgggatggtccacttggcacgtgtcgaagaaaatggtgagttgacttggctcaaacacaatccaattcaaaaaggagagtttgcctataattcgctccaagaattaggaaatggggagtatggcatcttgtatgaacatactgaaaaaggacaaaatgcctataccctatcatttagaaaatttaattgggaatttttgagcaaaaatctgatttctcctaccgaagcgaactagagagatgggcaaaggagagatgggcaaaggagttattggcttggagttcgactcagaagtattggtcaacaaggctccaacccttcaattggcaaatggtaaaacagcgactttcctaacccagtatgatagcaagaccttgttgtttgcagtagataaggaagatatcggacaggaaattattggtatagctaaaggaagcatcgaaagtatgcataatcttcctgtaaatctagcaggtgccagagttcctggcggagtaaatggtagcaaagcagcggtgcatgaagttccagaatttacagggggagttaatggtacagagccagctgttcatgaaatcgcagagtataagggatctgattcgcttgtaactcttactacaaaaaaagattatacttacaaagctcctcttgctcagcaggcacttcctgaaacaggaaacaaggagagtgacctcctagcttcactaggactaacagctttcttccttggtctgtttacgctagggaaaaagagagaacaataagagaagaattctaaacatttgattttgtaaaaatggctctttgtcaactgtagtgggttgaagtcagctaagctcgagaaaggacaaattttgtcctttcttttttgatattcagagcgataaaaatccgttttttgaagttttcaaagttccgaaaaccaaaggcattgcgcttgataagtttgatgagattattggtcgcttccaatttggcgttagaatagtgtagttgaagggcgttgacgattttctctttgtcctttagaaaggttttaaagacagtctgaaaaagaggatgaacctgctttagattgtcctcaatgagtccgaaaaatttctccggttccttattctgaaagtgaaacagcaagagttgatagagctgatagtgatgtttcaagtcttgtgaatagctcaaaagcttgtttaaaatctctttattggttaaatgcatacgaaaagtagggcgataaaaatgtttatcgctgagtttacg

SEQ ID NO: 118 - DNA, 3521 bp; double-stranded, linear
ctctggccctgccactccaacgttttgtcagggtgcttttttcataaaggagttcttatgttagatatcaaacgtattcgtacagattttgaagctgtcgcagaaaaattagctacacgtggtgtagatgctgctgtcttgaatgaaatgaaagaaatcgatgctaaacgtcgtaacatcttggtcaaggttgaaactctcaaagcagaacgtaacacagtttctgctgagattgcccaagctaagcgcaacaaggaaaatacagatgacaagattgctgccatgcaaaatctatctgctgaggttaaagccttggatgctgaattggcagaaatcgatgctaaattgacagaatttacaacgactcttccaaatatcccagctgacagcgttcctgttggggctgacgaagacgacaatgtggaagttcgccgttggggtactccacgcgagtttgacttcgaacctaaagctcactgggatctcggtgaagaccttggtatccttgactgggaacgcggtggtaaggtaacaggcgctcgcttcctcttctataaaggcctcggtgctcgtttggaacgtgctatctacaactttatgttggatgaacatggaaaagaaggctatactgaagtcatcacaccttacatagtcaaccatgattctatgtttggtactggtcagtatccaaaatttaaggaagatacttttgaactcagcgataccaactttgtcttgattccaactgctgaagttcctctgacaaactactaccgtgatgaaatcttagacggcaaagatcttccaatctacttcactgccatgagtccgtcattccgttctgaggctggttctgccggtcgtgatacgcgtggcttgatccgtttgcaccaattccacaaggttgaaatggtcaaatttgccaaaccagaagaatcttacgaagaattggaaaaaatgacagccaacgctgaaaacattcttcaaaaactcaaccttccataccgtgtcgttgctctctctactggagatatgggcttctcagctgcgaagacttacgacttggaagtgtggattccagcacaaaacaattaccgtgaaatctcaagctgttcaaacacagaagatttccaagcccgtcgtgcccaaatccgttaccgtgatgaagcagatggcaaggtgaaactccttcataccttgaacggttctggacttgcagttggacgtacagtggctgcaattcttgaaaattaccaaaatgaagatggttctgtgaccatcccagaagcacttcgtccatacatgggtggagctgaagtcatcaaaccataaaaaataaggtttagctatttctagctagaccttttttcgtaaccaaatcagataagcacctagtacaaagaataaaatagttaggcatataatggtttcagccaataccaggtaatccagaaatggaagtttcaaaattccctgagccatcttgagcgaggtcgctgtgataatggttgggaaggtgagggctgagaaggctggttgaaaaccttgttttaaaatgttgggcagacgagttaaaacaaagaaaaagaaggattgagaagccaaaatcatgacaatcaagacccaagtcggcaggctggttcctcctactcgaactagagaagccaagagtagagagaaaggagcacagtagattccttcttgtccaagcaaggctagtgggagtggatgtttctttaaatcgctataaataaggggatagagatagaaggtcaagagaaaaccaaaactcaaggtcgcataggcaatttcgataatacctaccagaggataggtcaaggcagccactgctatccccacatagagaaccgtccagcttggagtggcatgaaccctccgccctggacaagcaaacttgatggtaaaaccagcaatcaaggtcaaatccaagagaaatgaaaaccaccaaatcccttgtgctaccaaaggaagataagagaatacgcgaaagacataggtcgataaaatcatcccagccataggaaaggttgccattcctgacaaaagagggggcttggtcaattcttgcttggtttctttccaattaaagagatgcagaattagaaagtaaatccataaaaccaaaccaatcagactaaaaagatgggatagaaccggcaacgtatctaaaataagatttccagctcctgccaaacctagcaaacaacctgaaaatactaaggggagttttttcatcctaacctccaataatcatgttagtttcagtataacataaaagcgcttaaatgaggatttaaaaaaacgagtccgcttatttcagacttcattttactcagatatgaattaggcataaggttgcaattctggattaattggtgtattagctaagttgttggcatagttacagaggattgctaggctgacaccaaaaaccacatccaaggcattttgttgagtgtagccagcttctaaaaactcagacaaggcttcatctcctacacgacccttggtattgataactgccaaggtaaacttagctagggtatccaatttaggatctgtttcaattggagtacgattgcgaagagcttgaatcaagtcatcattcatctggatttgtttgatggaaaaggctgtgtgacctgcgacacagaaggcacaaccattggtcacggctgccgtgatttgcaccacttcacgctcaacgggtgtcaggctgttgcgacggtggatagatgagacaatttggtaggcttctaaaacagtcggggcattggccaagagaccgattaggttgggaatatagccattgttgtctttttctactgtttcaagaatttctttcacttctgctggtgctgactctactgtatggatagtaaatgttgtcataagatacctcttttcttattattgacactaatattattggaaaatcttataaaatcctgattcctaagtttatctaagataaagctttattctctcataagattttcgttgttatattagtttatcacacttccaatcacttgtataatatatattatatatcaggctgataaaaattatttataggcaaaaaaatcacacgagctgtgtgattccattatttgtcaaaatactttttagtttcagcaataacgactggcgacaagaccaagagggcaatcaagtttggcagagccatcaaggcgttaacgatatctgcgataatccagaccatatccaactcgataaatcctcctaacaagaccatgagcacaaaaaccacacggtagagccagataaagcgaaccccaaagaggaactcaaaacagcgttctccgtaatagttccaacctagaatcgttgtaaaggcaaaaagtacaaggaagatggtcaagagagcaggcccaaagtgtgaaaagtttgttgagaaagctgactgagtcaaggcaaccccattcaagtcaccgctccaaactccagttaccaagatggtcaaaccagttagagta

SEQ ID NO: 119 - DNA, 1968 bp; double-stranded, linear
aacctgggcaagcaagctaaaagcaatgggacctggaatcctaatggcaactgccgctgttggaggttcccacattgtatcctcaactcaagctggcggttcttacggttggtctctacttctcttggtcatcttagccaatgtctttaaatatccatttttccgttttggtgctgaatacacagctgatactggaaagactttggttgaaggttatgccgaaaaaggaaaactctatctctggattttctttatcctcaatgtcttttcggctatggtcaacacggctggtgttgccattctgtgctcagctatcatcgccagtgccttcccaatgattggacttagcattactcagtggtccctcattctcgttgcaatcatttgggctatgctactctttggaggctacaaacttttagacggcatggtcaaatggattatgtctgccttaaccattgcgactgttcttgcagttatcattgcggcggtcaagcatccagaatacagttctgattttgtcgagaagacaccttggcaaatggcagctctgcccttcatcgtctccctcctaggatggatgccggctcctattgaaatttcagccatcaattcactttggtcagctgaaaagagaaagaccgtcaactttaacacagaagacgctctgtttgactttaacactggttatattggaacagctatcctagccgtcttctttgtggcactgggagcactgattcagtatcctacagggcaggcggttgaagctgcttcagccaaatacatctctcaattcgtgggcatgtatgcctctgttcttggcgaatggtcccgttacttgattacctttattgccttcctctgtatctttggaacagttataactgttatcgatggctattctcgcgttaatcaggaatctctccgactgctaatcagtcaaaaagaggacaatcgtaaatctttgaacatctggatgaccatcactgctatcatcggtatcgtcattatcaagttcttcgctggtcaggtttcaaccatgctccgctttgccatgattggctctttcctgacaacacctttctttgctcttttgaattacgccttggtaacgcgtgaaaacaaaaatcttccttcttggctcaaacaccttgccattgcgggattgattttcctctttgcttcgccatcttctttatctacgcactcgcaatcggaaaagcagggtaagggacaagcgcgagatgaagataaggtttcatttcaagagaaaattcagcaaatatttctatgataaaaagcataagaacaaggttttgaagacctgaacttatgcttttttacgttcttaaagactgtttatactcaaaaaacagttgaacaacttcaaccacctcttataagaactttatactattcgagaatctcttcaaaccacgtcagctctatctgcaacctcaaagctgtgctttgagcaacctgcgactagcttcctagtttgctctttgattttcattgagtattaattctccttttccaactcatacaaatctgcgataatagctgcgacatgtttgatatcttccagcatgcctcgcatttcaaagtcagccaatacagggaagccaaagcgttgactgtattgcttggctgttaggcagtattggttattaaagttacgatttcctgacccaaccacaccaaaacacttactagcattgttaccataggcaataaaatctcccaccggtgtcgtcaaaatctcaacatctccgttatccacgccattcccaccttcgagataggtcggcaaaaaagcgacatagggatggtccatttcatagaaatttttgccttccttgaccaaatccttgatatgaatcttttgaacctcaatccctttgtactgggacaagagatagtctttcaagcgcgtcacaaaactttcagtgttgccactcaagg

SEQ ID NO: 120 - DNA, 7172 bp; double-stranded, linear
ccgcattttttatcactagactcgagacatcttttgagtggctcttgctctctggtttaattttcttccttgctcaaggactcctgctatttctcttggtcgtccgactcaaacatcaattcgctgagatttatcctcaaatcaataaaaagattcgcttctactatttaggggttctcaccattgattttctattttttgttctcttagccttcattagttctcagcgtttttcatctcttatgccaatcatcactgcttgccattctactttttattatatgacagctgactacctaagagaaaactatccagacttttacgacaaacacatctctttatgggagtgtctctaaagaaaaggaggttttagcatgaaaaaaatcatcttcatcaaaaccattcaactccttgtcattgatggaatcatgctggcatttttgacatttaaaagggggcttacttgggactggattttgatttatagcggttggctcattttctttcatcctgtgctattgacctatctttcaaaccaactttgtgaccactttagttaactctattcccagattagaccgagattctggcgttttgctttacaaattctcctatgggatagcctgatgattctctccttggtgtctttaagtgatattccacttttccttcagggaactctcctcatcctaggacatctcatcccttcctatcgcatctgccaaagcctgaaaagagacttcccccaagcatatcaagaaccgatttctttttggagtattttatgatagatgagaaagaccaagccgactgggcttggtctttcttatctctttttagtatctaggataatggtaacaggtccattattaaccagctcaacctgcatatctgctccaaagatgcctgtctgaacgggcacttcttgcgctaatttttgattgaaagcatcatagaagtctgatgccatatcaggtttagctgcccctgtaaaggctggacgattgcctctcttagtatccgcaaagagggtaaactgagaaatagagaggatttctccttcaatatctttgacagacaggttcatcttgccttctgcgtctgaaaaaatccgcatattgaccagttttctcacagcatagtccaaatcttcctcttggtcctctggtccaacaccaaccagcaataaaagtccctgattgatttttccctgaatctggccttctatactcacttgggcttttttaacccgttggataatgattttcataatagcctttctagtaagagctaggacaactagccgttggtccgtttgacagagtaaacttctggcacactcttaattttatcgacaaccgtggtcagtgtagagaggttggcaataccgaaggacacatggatattagcaaacttcatatccttggttggttgggcattgaccgttgaaatattcttggttgtatttgaaagaacttgcagtacatcgttcaacagtcctgtacggttgagaccgtagatatcgatatgggccatatactccttatttgagctagggtactggtcttcccattccacatcaaggagacgttgctcgtagttttcttgggcacgcaggttcatacagtccacacggtgaatagccacaccacgacccttggtaatgtagccaacaatatcgtcaccaggcacggggttacaacacttagcaatccgcactaggagaccagaagcaccttcaataaccactcccccctcatgcttgaccttgagggtttctttattttcaaccttgacctcgccacctttgacaagctcctctgcctcagctttggccttggcacgctcttcctcacggcgttccttttcagtcagacggttaaagacggtaatcgcaccgatttccccaaaaccaatggccgcaaagagggagtcttctgtcttgtaactggtcttttgcagaacttgatccatgtggcgcttgtccataaatttatttgccacatagccattttcttggaactgagccatcagcatctcacgacccttgttgacagacaattccttatcttggtttttaaagaactggcgaatcttattgcgcgccttgctagtcttgaccatattgagccagtcacggctaggtccaaaggagttcgggttggcgataatttcaacctgatcccctgtctttaacttggttgtcagtggaaccatgcggccattgaccttggcaccagttgctttttcaccgaccttggtatggatttcgtaggcaaaatcaatcggtcctgaatctttgggaagggaacggacagctccatctggggtaaaaacgtaaatctcctcagccaaatagttttccttaacagagtccacaaattccttagcatcatcagcctggtcttggagctccatcatctccttgatccagttcattccaatagctgattccttgctgttaacttgcccctttatacctttcttataagcccagtgagccgcaaccccgtactcagccacctcgtgcatttccttggttcgaatctggaattcaatcggcccttttggtccataaacagtcgtatggatagactgataaccattggccttgcggttggcgatatagtctttgaagcgacctggcatcggtttccaaaattcatgcacgtaaccaagcatggcataaacatcactttgggtatctaaaatacaacgaatagcaatcagatcatagatttcctcaaaccgttttctcttgtcctgcattttgcggaaaattgagtaaatatgcttgggacgaccataaatcttccctttcaagtgacgttctgtcgtatactcctctaattttgtgactacctcatccaccaaggcctcacgctccctgcgcttttccttcatcatatgggtaatcttgtaaaactccgttggattgagataacggaaagacaagtcttctaattcccatttgacactggaaatccccaaacgatgggcaagcggggcatagatttccatggtttctttggaaatacgctcctgcttgtcttttcgaagatgtttcagggtccgcatattgtgcaagcggtcagacagtttgaccaaaataacgcggatgtcctcagacatggccatgagcatcttgcgatgattttccgctaattgctcctcgatcgatttgtactcgaccttgccaagcttggtaactccgtcaacaatcatccgcacatcaggaccaaactctctttccaaatcgtccaaagtcgcatctgtatcttccaccacatcatgcaagaatccacaagctactgttacagcatccagctttagcttagctaaaatacctgccacttggatagggtgaatgatataaggctcgcctgatttgcgatattgaccactgtggcattcaacagcatagaccaaggccttatggacaaaatgaacatcctcttccgttaaatattctttggttaaagcgacaacttcttcgcctgttaaattcacttctttcggcatctctactctccaattcttcctaccattttatcacttttttaagaatatgaaaactagattggaacagaataagaaaaaaataattcaaaattgcttgataattctgaattattggtccgtaatatactacgaagttagattttaaacttaggtgatagaaggagagatagaagaacggaaaccatattgtaacccaaagactttctgacttccccaattccattgaagatacgaaagataaacggtggaactcgtatcacatacactggtaccttgactggattttggaattaatactaaatgaaaatcaaagagcaaactaggaaactagccgcaggttactcaaagcaccgctttgaggttgcagataaagttgacgcggtttgaagagatttttgaagagtataaaaatcctcaagatactttcttctatcctttagtttataaggagaatacctatgaaaaaaactgctatttctatctttgctctcctaatgttaggagtttgctgcctgttcctattcagccagcaaagctataaaaaacagtcgttcaatactatgctaacgaccagaacctgcccagtaggataacttatagtgaatatagcgacaaatgagaagccaactacggtagcactctaaacatcacgtctatcaaacaagctaatgacggagtttatgcaacctatgaagggcaattgacacctttccaatattgataaattgataaccagcctgtcttcatctagtcatgctggtttttaagttcattttaaatccttacctattctccctaactgtgctatacttaatttatactcaatgaaaatcaaagagcaaactagaaagctagccgcaggctgttcaaagcactgctttgaggttgcagataaagttgacgcggtttgaagagattttcgaagagtattagtacattctttgagattggagctagtatgaaaatccataaaaccgtgaatcctgttgcctatgaaaatacctattatctagaaggcgaaaagcacctcatcgtcgtcgatcctggtagtcattgggaagccattcgtcagacaatcgagaagatcaacaaaccgatctgtgctattctcttgacccacgcccattatgaccatatcatgagtctggacttggttcgcgagacgtttggcaatcctcctgtctatatcgcagagagcgaagccagctggctctacactcctgtcgataatctctccggtctccctcgccacgatgatatggcagatgtggtcacaaaacctgcagaacacacctttgtctttcacgaagaataccaactagaggaatttcgttttaaggttctaccgaccccagggcactctatcggtggtgtttccctagtctttcctgatgctcatctagtcttgacgggagatgctctattccgcgaaactatcggacggaccgaccttccgactggtagcatggagcaactccttcatagtatccagacccaactcttcaccctaccaaactacgatgtctatccaggacatggtccagctactactatcgctcacgaaaaggccttcaatccctttttctagcaagatgatgacaatcgaaatttaagtaaactatccagcaaatctttctattacaaaaggcatcctatcaaggttttcacacatgattggatgccttttttctgatgactagattttttgcattaccaaataatcacgcgctcctctggtgaacgccacattccgtctccttctttgacatcataggttgtaaagaaatcgtcgaagtttggtacttgcacattgacacggagtttggctggtgcgtgcacatcgacgctagccaaaagtttcataaattctggtcgacctttcatgcgccagatgcgaccgaagttgtagaagaactcttctgctgagaagtctgcttctctcttagctgcttcaagcgctgctgcgattcctcccaagtcagccacgttttctgatacagtcaatttaccgttaatggttgctccataagaatcctgtccatcaaattggtcaatgactttttgtgttttctccttgaaggcagcatagtcgctctctgtccaccaatccttgaggctaccattttcgtcaaaggaagccccgttagtatcaaaggcgtgggaaatttcatgggcaatcactgccccaataccaccgtagttagcagaagatgactgatgcaagtcatagaaaggcgcctgtaaaatggccgctggaaagacaatcaggttcttctgaggattgtagtaggcattgaccatatgagcaggcatgccccattccttataatctacaggctggttccacttactccaactgtgcttgatttccacacgcgcaaaggctagagcattctcaaaaagactggcagtttcattcactaccttatccttgtaacgtgcaggcaattcttctggatagccaatataaggtttgatcacattgagcttcacgatagcctgtttacaggtttctggagtgagccagtcattcttaagcagacgctccttataaacatcaatcatggttgccacttttttctccacatccgccttggcttctggagagaacttctcacgggcgtaccaaagacccagggcttgcttgaaaggttcttgtgctagatgataagctgctttgaccttatcttttgcctctggaactccagaaagggcacggctgtaggcaccagacaaaacacggatatcctctgttaaatagctggttgaaagattgacaacactcaaaatcaaggttgctttaaggagagaccaggcttcctcactgtagaattgctctgctgcttgccagaaacgttcctcgtctacaataaccttgtctggtaattgcccaataactgctttgaagaagtcatccaaaggtagggcaggcgcgaatttcttgaaatcttcgtaagaatatggatgatagagtttagcatattctgaactttcttcattagagagcaccactgccgcaactcggcggtccaattcaagtcttttttctagcaagtcttcaatttcttcatcagagaaatcataagccttgaggagatttgcgctgctttctttccaaagagtcaagagctcttcgcgctgaggatgttcttctgcatagtaggtcgtatctggcaagattgtgcttggagcgctagcccatagaacattgattctagcatccataaagtctggcgatacaccaaaaggaaggaagtttggttttcctgcaagctcaaactctgctagtttagctgtaaaatccgcaaaagtctccaattcttggaattctttaaggagtggtaagacaggtgtgataccgtcagcttctctcttgtcaaaatcacgaactaggcggtggtatttgacaaagttttccaagatagcatcctcaggcacttcttcacctgctaaccacttgtctgttgtcgccagcatcaggtcttcaatttcctggtctaaatcaacaaaacctcctgtttgagacttatctgctgggatttcagctgtctgttgccattctccattgatagcatcataaaaatcatcttgataacgtgtcatcttgttctcgctttcatttgtatttgcatttatcttaacaaaaatcg

SEQ ID NO: 121 - DNA, 4518 bp; double-stranded, linear
cgggaagttatgcgatctagacttcgttcctgtacagctactttctcaggtggtcttgttgtttgtatgagtttgtttagagaggatctttctatgtctttctttcttatttttgttttatatgcttttctgatttcttatctaatttatggttatttcagactaaaaaggaaataccgagtagatgaatagcaaggttctaggtcttcagattgatttttagcactcttgataaaagagtgctaattttttgagtttttgtcttgacattctcttctaagggtgtataatagaatcatgagttagcacttggatgcattgagtgctaattgatcagacagagaggagtgatgagatggttacagagcgtcagcaggatattttaaatctgattattgacatctttaccaaaacgcacgaacctgtcggatcaaaagccttgcaagagtctattaactctagcagtgcaaccattcgtaatgacatggcggaactagaaaaacaagggttgcttgagaaggctcatacttcaagtggtcggatgccaagtgttgctggttttcagtactatgtgaaacactcactggattttgaccggctggctgaaaatgaggtatatgagattgtcaaagcctttgatcaggaattcttcaaattggaggatattctgcaagaggctgctaacttactaacagacctgagtggctgtacggtagtggcactggatgttgagccgagcaggcaacgtttgacagcctttgatatcgttgttttggggcaacatacagccttggcggtatttaccctagacgagtcgcgaacggttactagtcagtttctgattccaaggaacttcttgcaggaggatttgctgaaactgaagagcatcattcaggaacgtttcctcggtcacaccgttttagatattcactacaagattcggacggagattccgcagattatccagcgttactttacaacaacggataatgtcatcgatctctttgaacacatctttaaggaaatgttcaacgaaaacattgtgatggcgggcaaggtccatctcttgaattttgccaatctagcagcctatcagttctttgaccaaccgcaaaaggtggccttggagattcgtgaggggttgcgtgaggatcagatgcaaaatgttcgtgttgcagacggtcaagagtcctgtttagctgacctagcggtaatcagtagtaagttcctcattccttatcggggagttggaattctagccattatcggtccagttaatctggattaccaacagctaatcaatcaagtcaatgtggtcaaccgtgttttgaccatgaagttgacagatttttaccgctacctcagcagtaatcattacgaagtacattaagattgaaatcattaaaggaggcgaacatggcccaagatataaaaaatgaagaagtagaagaagttcaagaagaggaagttgtgaaaacagctgaagaaacaactcctgaaaagtctgagttggacttggcaaatgaacgtgcagatgagttcgaaaacaaatatcttcgcgctcatgcagaaatgcaaaatatccaacgccgtgccaatgaagaacgtcaaaacttgcaacgttatcgtagccaggacttggcaaaagcaatcttaccatctcttgacaaccttgagcgtgcacttgcagttgaaggtttgacagatgatgtgaagaagggcttggggatggtgcaagaaagcttgattcacgctttgaaagaagaaggaattgaagaaatcgcagcagatggcgaatttgaccataactaccatatggccatccaaactctcccagcagacgatgaacacccagtagataccatcgctcaagtctttcaaaaaggctacaaactccatgaccgcatcctacgcccagcaatggtagtggtgtataactaagatataaagcccgtaaaaagctcgcagtaaaaataggagattgacgaagtgttcgatgaacacaagaaaatctatcttttttactcagagcttagggcgtgttcgattcggcaattctgacggtagctaaagcaactcgtcagaaaacggcaatcgctatggcgtttgcctagcttccttactaactcgtcgtcgaaataaaatcgatttcgactcctcgtgtcgcaatttacataatagaaaacttgtccgaaacgacaataaactatgaagaaagataaaatatgtttggctttgtaatagtgagcgaagcgaaccaaacacgatactcttcgccgtggcgctatttgcgcaaattttgagaccttaggctcaaagtttagtcaaagagattgacgaagtcaagctctgacggcgtcgccactgtcgccacttaagaagagtatcaaaaagaaaaatagaaaattaactaacaaggagaaaaacacatgtctaaaattatcggtattgacttaggtacaacaaactcagcagttgcagttcttgaaggaactgaaagcaaaatcatcgcaaacccagaaggaaaccgcacaactccatctgtagtctcattcaaaaacggagaaatcatcgttggtgatgctgcaaaacgtcaagcagttacaaacccagatacagttatctctatcaaatctaagatgggaacttctgaaaaagtttctgcaaatggaaaagaatacactccacaagaaatctcagctatgatccttcaatacttgaaaggctacgctgaagactaccttggtgagaaagtaaccaaagctgttatcacagttccggcttacttcaacgacgctcaacgtcaagcaacaaaagacgctggtaaaattgctggtcttgaagtagaacgtattgttaacgaaccaactgcagcagctcttgcttatggtttggacaagactgacaaagaagaaaaaatcttggtatttgaccttggtggtggtacattcgacgtctctatccttgaattgggtgacggtgtcttcgacgtattgtcaactgcaggggacaacaaacttggtggtgacgactttgaccaaaaaatcattgaccacttggtagcagaattcaagaaagaaaacggtatcgacttgtctactgacaagatggcaatgcaacgtttgaaagatgcggctgaaaaagcgaagaaagacctttctggtgtaacttcaacacaaatcagcttgccatttatcactgcaggtgaggctggacctcttcacttggaaatgactttgactcgtgcgaaatttgacgatttgactcgtgaccttgttgaacgtacaaaagttccagttcgtcaagccctttcagatgcaggtttgagcttgtcagaaatcgacgaagttatccttgttggtggttcaactcgtatccctgccgttgttgaagctgttaaagctgaaactggtaaagaaccaaacaaatcagtaaaccctgatgaagtagttgctatgggtgcggctatccaaggtggtgtgattactggtgatgtcaaggacgttgtccttcttgatgtaacgccattgtcacttggtatcgaaacaatgggtggagtatttacaaaacttatcgatcgcaacactacaatcccaacatctaaatcacaagtcttctcaacagcagcagacaaccaaccagccgttgatatccacgttcttcaaggtgaacgcccaatggcagcagataacaagactcttggacgcttccaattgactgatatcccagctgcacctcgtggaattcctcaaatcgaagtaacatttgacatcgacaagaacggtatcgtgtctgttaaggccaaagaccttggaactcaaaaagaacaaactattgtcatccaatcgaactcaggtttgactgacgaagaaatcgaccgcatgatgaaagatgcagaagcaaacgctgaagccgataagaaacgtaaagaagaagtagaccttcgtaatgaagtagaccaagcaatctttgcgactgaaaagacaatcaaggaaactgaaggtaaaggcttcgacgcagaacgtgacgctgcccaagctgcccttgatgaccttaagaaagctcaagaagacaacaacttggacgacatgaaaacaaaacttgaagcattgaacgaaaaagctcaaggacttgctgttaaactctacgaacaagccgcagcagcgcaacaagctcaagaaggagcagaaggcgcacaagcaacagggaacgcaggcgatgacgtcgtagacggagagtttacggaaaagtaagatgagtgtattggatgaagagtatctaaaaaatacacgaaaagtttataatgatttttgtaatcaagctgataactatagaacatcaaaagattttattgataatattccaatagaatatttagctagatatagagaattatattagctgaacatgatagttgtatcaaaaatgatgaagcggtaaggaattttgttacctcagtattgttgtctgcatttgtatcggcgatggtaccgtatctgacgaacgttcagcttatat

SEQ ID NO: 122 - DNA, 8145 bp; double-stranded, linear
tgctattttcgattcccttgggcgttttgattgcctttgccttgcaagtccattggaagcccctccattatctgattaacatttacatctgggttatgcgaggaacccccttactcttgcaactgatttttatctattatgtgctcccaagtattgggattcgtttagaccgccttcctgcagctattattgcctttgttctcaactatgcagcttactttgcagaaattttccgtgggggaattgacactattccaagaggacagtatgaggccgccaaggtcttgaagtttagcccttttgacagagtgcgctatattatcttgccccaagtgaccaagatcgttcttcctagtgtctttaatgaagttatgagtttggtcaaggatacttctttggtctatgctctcggaatttcagaccttatcttggctagtcgaacagctgctaaccgcgatgctagtctagttcctatgttcttggcaggagccatttatttgattttgattgggattgtgacaattatttccaaaaaagttgagaagaagtatagttattatagataggaggctgccatgttagaattacgaaatatcaataaagtctttggagacaaacaaatcctgtctaatttcagtctaagtattcctgaaaagcaaatcctggctatcgttggaccttctggtggaggtaagacaactcttttacgtatgcttgcaggtcttgaaaccattgattcagggcaaatcttttataatggacaacctttagagctggatgaattgcagaagcgcaatctactgggatttgtcttccaagattttcaactatttcctcatctatcagttctggaaaatttgactttatcgcctgtgaagaccatgggaatgaagcaggaagaggctgagaagaaggcgagtggactcttggaacagttaggactaggaggacacgcagaggcctatcctttctcactatctggtgggcaaaagcagcgggtggctttggcgcgtgctatgatgattgacccagaaatcattggctacgatgaaccaacttctgccctggatccagaattacgtttggaagtggagaagctaatcttgcaaaatagggaacttgggatgacccagattgtggttacccatgatttgcagtttgctgaaaatatcgcagatgtattattgaaagtagaacctaaataggaggaaaaatggatgaaaaaatggatgcttgtattagtcagtctgatgactgctttgttcttagtagcttgtgggaaaaattctagcgaaactagtggagataattggtcaaagtaccagtctaacaagtctattactattggatttgatagtacttttgttccaatgggatttgctcagaaagatggttcttatgcaggatttgatattgatttagctacagctgtttttgaaaaatacggaatcacggtaaattggcaaccgattgattgggatttgaaagaagctgaattgacaaaaggaacgattgatctgatttggaatggctattccgctacagacgaacgccgtgaaaaggtggctttcagtaactcatatatgaagaatgagcaggtattggttacgaagaaatcatctggtatcacgactgcaaaggatatgactggaaagacattaggagctcaagctggttcatctggttatgcggactttgaagcaaatccagaaattttgaagaatattgtcgctaataaggaagcgaatcaataccaaacctttaatgaagccttgattgatttgaaaaacgatcgaattgatggtctattgattgaccgtgtctatgcaaactattatttagaagcagaaggtgttttaaacgattataatgtctttacagttggactagaaacagaagcttttgcggttggagcccgtaaggaagatacaaacttggttaagaagataaatgaagctttttctagtctttacaaggacggcaagttccaagaaatcagccaaaaatggtttggagaagatgtagcaaccaaagaagtaaaagaaggacagtaagataaaatagtggctgaaactgcgttttgattagcaaaacgtagttttttttgtaatctaggaaaacgataatagcgattgaatatggataattgaatatggaatagcccactgtgatttctaaaacattgttaaaaattgatttgacttccaaaattaaaatgttctgtaatgaaatactgatgtaactgttttaggaacaataaaacgcataatatcaaggtttttgcaccttacattatgcgtttttgtgattttaagacttgttagctgattttttacaatcctgcgaaatctttgatttcttgtgctgacattgaagagtcgcaacggacgttgatttgtccatctgtaatatgaacaaaacctggtacagttgggattccatagcgtgagcggaatgcttgcaaatcattgagttggcttggttcttcactattgatgaagtaaatgtgagctttggtttcagctacgacacctgacaatgtacctgcaaatttacggcagtaagggcaagttttgcgaccgataaagaaggttgcagtttcttttttatcaagagcttcttgcgcacgcacaactgtagtgacttcaaggtctttgatgttatctaaaaattgttccatgagattacctcgctttcattgataagtctagtatgccataaagtttctaaaattgcttagatttgatacgaaaaaagatgaggttggttggtctcatcttttataggtctttattttacaaatgcattgatttctgcttcgatgttagcaatcttagcttgtgattcttcgttggtttcccctacaactgcaatgtagaacttgatttttggttctgtacctgaagggcgaacggcaatccatgaaccgtcagcaagtgtgtatttcaacacatcacttggaggagttgtcaagtttgtaacagtaccgtcagcaacagtagcagtttgtgccttgaagtcttctacgacagtgatagctgttgcgttccattctgttggagcattgttgcggaatttagccataatcgctttgatttgttcagcaccatcgacacctgaaagagtaacagagattgttttttctgcgtagtagccatattctttatagatttcttcgataccgtcagcaagtgtcaaaccacgagaacggtagtaggcagcaagttcagcaactacaagaacggcttggatggcatctttatcacgtacaaatggtttaatcaagtaaccgaagctttcttcaaatcccatcatgtaagtgtggttgtgtttttcttcgaattcttggattttttcagcgataaatttgaaacctgtcaagacgttgaacatagttgcgccgtagctttcagcaatcttcgttaccaagtcagttgaaacgatagatttgcagagagcggcattttcaggaagagttccagcgtttttgtgagcttccaagatgtatttagccatgatagcaccgatttggttacctgaaaggttgaggtagctaccatctttttgaagaacttcaacaccaacacggtcagcgtctgggtcagttgcgacaagaacatctgcaccaacttgacgaccaagttcttcagcaagggcaaaggctgcttggctttctgggtttggagatgttacagttgaaaagtctgggtcagcagttgcttgcgcttcaacaacttgaacagagtcaaatcctgcttgggcaagagcacgacgagccaacatttcaccagtaccatgaagtggtgtgtagacaatcttcatgtctttaccaaattcttcaatcaaggctgggttgatgtttatgtccttaacctctttaaggtattctatgtcaacagcttcgccgataacttcaatcaagccagaagctttttcagtttccacatcagcaacttcaactgcaaatgggttttcgattgcacggatataagtagtcaaagcgtccgcatcgtgtggaggcatttgtccaccgtcttcaccgtaaaccttgtaaccgttaaatggagcagggttgtggctggctgtgaccatgatacctgcgaaacagttgagatgacgaactgcaaatgatagttctggagtcggacgaaggctttcaaatacgtaagatttgatgccgtgtttagcaagaactgccgcagattcaaaggcaaactcaggtgagaagtgacggctatcgtaggcaattgctacaccgcgttctttctcgtttccaccttttgactcaatcaaacgagccaatccttcagtagcttggcgaacaacgtagatgttgatacggtttgtaccagcaccaaccaagccacgcatacctgcagtaccaaattcaagatttgtatagaaggcatcttccttagttttttcgtccatattttccaaatcttgacgaaggtagtcacgaagctccacaaaatcaacccatttctggtaattttcttggtaagacattcaaattctcctttatttttaaaacatttaatcagtttaattatatcattttttttagttttagtaaaaccttatctgcttcgaacatctcttcaaaccaggtcagattgaattttggggttatatgatgttgaggctaggaaaaattcaatttcagtaaaaaaagtaagtcttctcataacaaaacattgatatagttacttagttttaaacaagcatattataataaagctatggcatatagtactgattttaaacagcgagcattagattacatcaaagaggggcacagccatgtcgaggcagccaagttttttggtgttggcgtcagaactctcttcacgtgggaaaagaaagacgtgaacaagaacacatagagaggaaaaagcgagtcgtcaaaaaccgaaagattcctttagaggaattgaaagcctttgtagaggctcatccagatgcttttttacgggaaattgcggcacattttgattgtgctgttccttcagtatgggcagctttaaagcagattaaggtcactttaaaaaaagatgacgagctttaaggaacaagacccagaaaagtagccttatttcttaagaattttaatagtttaaagcacctagcacctgtttatattgatgaaacaggaatcgaccgctatctctatcgtccttatgcaggggctcctagaggggagaaagtctatgaaaagattagcggacgtcgttttgagcgaacttcaattgttgcaggacaagtagacggagagtttatagctcccatgatttacaagaaaagcatgacaagcgatttctttgtggagtggttcaaaacgcaactcctacctgctttgaagacacctcatgttattgtcatgggcaatgctggttttcatcccaagaacattttggatgaactctgcatccaagataaacactttttcttacctctaccaccttattcaccggatttgaatcctattgagcaagcttgggctatcttgaaaaagaaagtgacggatgtattaagggaagttccaactatttttgaatgtttggaatgcttttttaaaactagatgactataacggttctaaaggaacctatcgagtagtcattaaaactaaggatactgctggttaagagaagacggtatacaatcaaaccattcaccgtgtagccgaaatcgttcagaatgaagacttgtatcagaatgaagacttgtataagaaaggtttgaatgttgaacttgcgcaccaacaaattaagggattttttgaagcagagtttaaaaatcgtattaatggagttcttaatactaaaataaaaaatagtacattaaatcgtgtaaataaaaaaactatacaccagagcaacaaaaactccatgatcaatttgaagcagaagcaacggaagatgctaaaaaacaaggcgatattgtgttgaatgttgaccaggatttcatgagcatatctaagtctaataaaagtggttcagactggaagaaaactttcacagtgaggataaccaataggctagcaaatgacttgaataatgtcttgaaacaggttgataaagatactcctaataccccaacttggctaaactcagctgcttctaaagctaaagatgatgacagagtatataaactactgaagactcttataccaggagaaaattacctatcatgttaaggataatcagctagaagtagaaacagataaatacacatatactgccgctagaaatggtagtaaggaagttggtattcaagagtcagatatagcagcaactctaagtgccgatgaatataattctaatcgccaaacttttgagagagaatacaaatacaaaagcaaatgcccttaataatggttgggctagatctggttctgaagagttcaaaaagttctcccactttgtaggggtagacaaagggattgtgcgaacgaatgtactgactggtaaaaaactatctgataagattaggaaagaagtgggctctggagatagcaaactaggaaaaggcggctatttctctactggggatgttctattaggaaaagatgttgtttcttataccgtacaagtattttcagagaataatgaaagagtaggagtaaacactcaaagtcaccgtgttcagtataatctcccaattctagctgacttttcagtcatccaagatactgtggaaccatcacgaaccgttgttgaaaaaatcattccaaaactaaatattcccgaagaagagaaagggaaaataaccgaagaaatcaagaaaaagaaaaaaacctcagaattggcagaactaatctcagaaaatgtgaaagttcgctatgttgatgaacaagggcgtttgctatcattgaaaaatgatactggaattggagaaaaagaaagtgacggaacctacattaccaataaaaaacaactgattggtaccagctataatgtcacagataaaaaactcagtagcatgactactactgacggaaaatattatacttttaaagaagcagatacaaattctgcaagtttaactgggaatattgtaagcgaaggtagaacagtgaccttagtttatagagaaagcgaagcgccaaccactgctacagtaacagccaattactataaagaaggtaggcaagagaagttggtagagtctgttataaaagctgatttagcgataggttctgagtataccacagaatcaaaaactattgaagggaaaacaacaactgaggacaaagaagaccgagttatcacaaggaaaacaacatacaccttggtagcaactcctgaaaatgcgtaccagaagacggtgcaacagttgactattactaccgtgagaatgttgaggaaacagtggttcccaaaacagcaacctctactgagacgaagactataacgcgtatcattcattacgttgataaagttacgaaccaaaatgtaaaagaagatgttgttcaacctgtaaccttaagccgtacaaaaactgagaacaaggtcacgggagttgtaacctacggtgaatggacaacaggaaactgggacgaggttatatctggtaagattgacaagtacaaagatccagatattccaacagttgaatcacaagaagttacgtcagactctagtgataaagaaataacggtaaggtatgaccgtttatcaacaccagaaaaaccaatcccacaaccaaatccagagcatccaagtgttccgacaccaaacccagaactaccaaatcaagagactccaacaccagataaaccaactccagaaccaggtactccaaaaactgaaactccagtgaatccagacccagaagttccgacttatgagacaggtaagagagaggaattgccaaacacaggtacagaagctaatgctaccttggctagtgctggtatcatgaccttgttagctggtctaggattaggatttttcaagaaaaaagaagatgaaaaataatagattttagaatctaggaaccaggaaaagctcacagatgtgggcttttttcctggttttgagaacgaggtctttcgtaaagaataaaaacgcttacaagtctgttgaactgggaaactatgaatcctatttttttaaaaatatttccagaaatcagttgcgg

SEQ ID NO: 123 - DNA, 8697 bp; double-stranded, linear
cggtaccgggaacgatacttagtctaattttgcaccttttccatgtatggtaaaggtttttctttttttaaaaaggaaaacgagaagaggaggttcttatgaaagcaagcattgccttgcaagttttacccctagtacaggggattgatcggatagctgttattgatcaggtcattgcttatctgcawactcaagaagtgacgatggtagtgacaccatttgaaacggtcttggaaggggagtttgatgagcttatgcgcattctaaaagaagcgctggaagtggcagggcaggaggcagacaatgtctttgccaatgtcaaaataaatgtaggagagattttaagtattgatgagaaacttgagaagtatactgagacgacacattagtctattgggctttctcggagtattgtcaatctggcagttagcaggttttcttaaacttctccccaagtttatcctgccgacacctcttgaaattctccagccctttgttcgtgacagagaatttctctggcaccatagctgggcgaccttgagagtggctttactggggctgattttgggagttttgattgcctgtcttatggctgtgctcatggatagtttgacttggctcaatgacctgatttaccctatgatggtggtcattcagaccattccgaccattgccatagctcctatcctggtcttgtggctaggttatgggattttgcccaagattgtcttgattatcttaacgacaacctttcccatcatcgttagtattttggacggttttaggcattgcgacaaggatatgctgaccttgtttagtctgatgcgggccaagccttggcaaatcctgtggcattttaaaatcccagttagcctgccttacttttatgcaggtctgagggtcagtgtctcctacgcctttatcacaactgtggtatctgagtggttgggaggttttgaaggtcttggtgtttatatgattcagtctaaaaaactgtttcagtatgataccatgtttgccattattattctggtgtcgattatcagtcttttgggtatgaagctggtcgatatcagtgaaaaatatgtgattaaatggaaacgttcgtagaattagaatgtttctgaaaaagaaaagaggaaatcaaaatgaagaaaacatggaaagtgtttttaacgcttgtaacagctcttgtagctgttgtgcttgtggcctgtggtcaaggaactgcttctaaagacaacaaagaggcagaacttaagaaggttgactttatcctagactggacaccaaataccaaccacacagggctttatgttgccaaggaaaaaggttatttcaaagaagctggagtggatgttgatttgaaattgccaccagaagaaagttcttctgacttggttatcaacggaaaggcaccatttgcagtgtatttccaagactacatggctaagaaattggaaaaaggagcaggaatcactgccgttgcagctattgttgaacacaatacatcaggaatcatctctcgtaaatctgataatgtaagcagtccaaaagacttggttggtaagaaatatgggacatggaatgacccaactgaacttgctatgttgaaaaccttggtagaatctcaaggtggagactttgagaaggttgaaaaagtaccaaataacgactcaaactcaatcacaccgattgccaatggcgtctttgatactgcttggatttactacggttgggatggtatccttgctaaatctcaaggtgtagatgctaacttcatgtacttgaaagactatgtcaaggagtttgactactattcaccagttatcatcgcaaacaacgactatctgaaagataacaaagaagaagctcgcaaagtcatccaagccatcaaaaaaggctaccaatatgccatggaacatccagaagaagctgcagatattctcatcaagaatgcacctgaactcaaggaaaaacgtgactttgtcatcgaatctcaaaaatacttgtcaaaagaatacgcaagcgacaaggaaaaatggggtcaatttgacgcagctcgctggaatgctttctacaaatgggataaagaaaatggtatccttaaagaagacttgacagacaaaggcttcaccaacgaatttgtgaaataatgacagaaattagactagagcacgtcagttatgcctatggtcaggagaggattttagaggatatcaacctacaggtgacttcaggcgaagtggtttccatcctaggcccaagtggtgttggaaagaccaccctctttaatctaatcgctgggattttagaagttcagtcagggagaattgtccttgatggtgaagaaaatcccaaggggcgcgtgagttatatgttgcaaaaggatctgctcttggagcacaagacggtgcttggaaatatcattctgcccctcttgattcaaaaggtggataaggcagaagctatttcccgagcggataaaattcttgcgaccttccagctgacagctgtaagagacaagtatcctcatgaacttagcggtgggatgcgccagcgtgtagccttactccggacctacctttttgggcacaagctctttctcttagatgaggcctttagcgccttggatgagatgacaaagatggaactccacgcttggtatcttgagattcacaagcagttgcagctaacaaccctgatcatcacgcatagtattgaggaggccctcaatctcagcgaccgtatctatatcttgaaaaatcgccctgggcagattgtttcagaaattaaactagattggtctgaagatgaggacaaggaagtccaaaagattgcctacaaacgtcaaattttggcggaattaggcttagataagtagaaaaatagggagttggtgaagattatcctttaccagcgccctttttcttttaaaaatgagaaaatttcggtataatagtcaaacaaggtcaaggtttaaagagagaggtgggtttgttatgagatttaaaaatacatcggatcatattgaggcctacatcaaggcgattttagatcaatctggtatcgtggagttgcaacggagtcagttggcagatacctttcaggttgttcctagtcagattaactacgtgatcaagacacgctttacggaaagtagaggctacttggttgaaagtaagcgtggtggcggaggctacattcgtataggacggattgagttttctagtcatcatgaaatgctccgggagctgctttactcgattggtgagcgagtcagtcaagaaatttatgaggatattctccagcttttggttgagcaggaattgatgaccaagcaggagatgaatttgctagaatcagtagctttggatcgcgttttaggagaagaagctccagttgttcgagcaaacatgctacgtcagatcatacaagaggtagatagaaaagggaagtaagatgaactattcaaaagcattgaatgaatgtatcgaaagtgcctacatggttgctggacattttggagctcgttatctagagtcgtggcacttgttgattgccatgtctaatcacagttatagtgtagcaggggcaactttaaatgattatccgtatgagatggaccgtttagaagaggtggctttggaactgactgaaacggactatagccaggatgaaacctttacggaattgccgttctcccgtcgtttgcaggttctttttgatgaagcagagtatgtagcgtcagtggtccatgctaaggtactagggacagagcacgtcctctatgcgattttgcatgatagcaatgccttggcgactcgtatcttggagagggctggtttttcttatgaagacaagaaagatcaggtcaagattgctgctcttcgtcgaaatttagaagaacgggcaggctggactcgtgaagatctcaaggctttacgccaacgccatcgtacagtagctgacaagcaaaattctatggccaatatgatgggcatgccgcagactcctagtggtggtctcgaggattatacgcatgatttgacagagcaagcgcgttctggcaagttagaaccagtcatcggtcgggacaaggaaatctcacgtatgattcaaatcttgagccggaagactaagaacaaccctgtcttggttggggatgctggtgtcgggaaaacagctctggcgcttggtcttgcccagcgtattgctagtggtgacgtgcctgcggaaatggctaagatgcgcgtgttagaacttgatttgatgaatgtcgttgcagggacacgcttccgtggtgactttgaagaacgcatgaataatatcatcaaggatattgaagaagatggccaagtcatcctctttatcgatgaactccacaccatcatgggttctggtagcgggattgattcgactctggatgcggccaatatcttgaaaccagccttggcgcgtggaactttgagaacggttggtgccactactcaggaagaatatcaaaaacatatcgaaaaagatgcggcactttctcgtcgtttcgctaaagtgacgattgaagaaccaagtgtggcagatagtatgactattttacaaggtttgaaggcgacttatgagaaacatcaccgtgtacaaatcacagatgaagcggttgaaacagcggttaagatggctcatcgttatttaaccagtcgtcacttgccagactctgctatcgatctcttggatgaggcggcagcaacagtgcaaaataaggcaaagcatgtaaaagcagacgattcagatttgagtccagctgacaaggccctgatggatggcaagtggaaacaggcagcccagctaatcgcaaaagaagaggaagtacctgtctacaaagacttggtgacagagtctgatattttgaccaccttgagtcgcttgtcaggaatcccagttcaaaaactgactcaaacggatgctaagaagtatttaaatcttgaagcagaactccataaacgggttatcggtcaagatcaagctgtttcaagcattagccgtgccattcgccgcaaccagtcagggattcgcagtcataagcgtccgattggttcctttatgttcctagggcctacaggtgtcgggaaaactgaattagccaaggctctggcagaagttctttttgacgacgaatcagcccttatccgctttgatatgagtgagtatatggagaaatttgcagctagtcgtctcaacggagctcctccaggctatgtaggatatgaagaaggtggggagttgacagagaaggttcgcaataaaccctattccgttctcctctttgatgaggtagagaaggcccacccagatatctttaatgttctcttgcaggttctggatgacggtgtcttgacagatagcaagggacgcaaggtcgatttttcaaataccattatcattatgacatcgaatctaggtgcgactgcccttcgtgatgataagactgttggttttggggctaaggatattcgttttgaccaggaaaatatggaaaaacgcatgtttgaagaactgaaaaaagcttatagaccggaattcatcaaccgtattgatgagaaggtggtcttccatagcctatctagtgatcatatgcaggaagtggtgaagattatggtcaagcctttagtggcaagtttgactgaaaaaggcattgacttgaaattacaagcttcagctctgaaattgttagcaaatcaaggatatgacccagagatgggagctcgcccacttcgcagaaccctgcaaacagaagtggaggacaagttggcagaacttcttctcaagggagatttagtggcaggcagcacacttaagattggtgtcaaagcaggccagttaaaatttgatattgcataaaagaataaaagtatcagcatctgaccataagtcacagtggagtgaaattcaatgaaaatcaaagagcaaactaggcagctagccgcaggttgctcaaaacactggtttgaggttgcagatagagctgacgtggtttgaagagattttcgaagagtatgaaactaaaacctatagcttctaaacgatccgtggttttcatcattcaacacaaaattcatatgtttattaccctccgtcgtatttgtcttagagcgtgtgtagtagaaaaagagcagtcttatctgaaatttttattctttcaaaagagacctgtttcttttttgcatgtcaaatccgttctagctggtatttgaaaaatcaaactaatattcaatgaaaatcaaagaacaaactaggaagctagccgcaggttgctcaaaacactgttttgaggttgtagatagagctgacgtggtttgaagagattttcgaagagtataagctgcaagatgaatgattttcttgtattgacgttgttgttgacaaaaagtagcggataaatgaaatccattccattatcatagatgataggctggtaggaaattttcaaatagcatacaggaaatagatgtatggagttctggtagtagaaagggagagagatgaacattttagttgcagatgacgaggaaatgattagagaaggaattgcagcatttctgacagaagagggttatcatgtcattatggctaaggatggacaagaggtcttggaaaaatttcaagatctccctatccatctcatggtactggatttaatgatgcctaggaagagtggttttgaagtgttaaaagaaatcaatcaaaagcacgatattcctgtcatcgtcttgagtgctctgggagatgaaactactcagtcacaggtatttgatctctatgctgatgatcatgtgacaaaacctttttctttggtactgcttgtcaagcgtattaaggcgcttatcagacgttactacgtcatagaggatctttggcgatatcaggatgtaacagtggattttacctcttacaaagcacattataaaaatgaagaaattgatctcaaaccaaaggaattactggtactaaagtgtttgattcagcataaaaatcaagttttaagtagagagcagatattggaagaaatttcaaaagatgtagctgatttaccttgtgatagggtcgttgatgtctatattcgtactcttcgcaaaaaattagctttagattgtatcgtgactgtgaaaaatgttgggtataagattagcttatgataaaaaatcctaaattattaaccaagtcttttttaagaagttttgcaattctaggtggtgttggtctagtcattcatatagctatttatttgacctttcctttttattatattcaactggagggggaaaagtttaatgagagcgcaagagtgtttacggagtatttaaagactaagacatctgatgaaattccaagcttactccagtcttattcaaagtccttgaccatatctgctcaccttaaaagagatattgtagataagcggctccctcttgtgcatgacttggatattaaagatggaaagctatcaaattatatcgtgatgttagatatgtctgttagtacagcagatggtaaacaggtaaccgtgcaatttgttcacggggtggatgtctacaaagaagcaaagaatattttgcttttgtatctcccatatacatttttggttacaattgctttttcctttgttttttcttatttttatactaaacgcttgctcaatcctcttttttacatttcagaagtgactagtaaaatgcaagatttggatgacaatattcgttttgatgaaagtaggaaagatgaagttggtgaagttggaaaacagattaatggtatgtatgagcacttgttgaaggttatttatgagttggaaagtcgtaatgagcaaattgtaaaattgcaaaatcaaaaggtttcctttgtccgcggagcatcacatgagttgaaaacccctttagccagtcttagaattatcctagagaatatgcagcataatattggagattacaaagatcatccaaaatatattgcaaagagtataaataagattgaccagatgagccacttattagaagaagtactggagtcttctaaattccaagagtggacagagtgtcgtgagaccttgactgttaagccagttttagtagatattttatcacgttatcaagaattagctcattcaataggtgttacaattgaaaatcaattgacagatgctaccagggtcgtcatgagtcttagggcattggataaggttttgacaaacctgattagtaatgcaattaaatattcagataaaaatgggcgtgtaatcatatccgagcaagatggctatctctctatcaaaaatacatgtgcgcctctaagtgaccaagaactagaacatttatttgatatattctatcattctcaaatcgtgacagataaggatgaaagttccggtttgggtctttacattgtgaataatattttagaaagctatcaaatggattatagttttctcccttatgaacacggtatggaatttaagattagcttgtagacagattagttttttattaaagttcatatagggttaacataagtgtgttattctttgtgtagataaaagaaaggatactaatatggtattagcgattattttagtaacattctttattcgattgatttttttaaagcgttcgatagagaatgagaaacgaatccttagcaatggcgggg

SEQ ID NO: 124 - DNA, 4317 bp; double-stranded, linear
aaccatacatacggcaaggcaaagctgacgcggtttgaagagattttcgaagagtattagttgcctttaaaggcatccaccatcgtttgaaattcttcatttgagagagtaatccctttgcccattttagtatggtctggactccaagcacgaatatcaaactttgcaggggcaccattaaagctcacacggttaatttccttggtccaacctttttcgttttcagaaagagtcaacaagtgctcttcgatttcaaatgtaaattctgccattttcttctccttttttagtttcattagtttattcgtaaaatcttgtagattttaggaaaattttatataatattgatataaaagaagggaggccaatatgagacataaattccagcaagttctaaataaaatacatgattttttaaatggatatgaccaacctgaccagactgaaaccaactcccttacagccactattgaagaggctatccagaaacaaaccgctgttcaccttatcttgtctgagacaagctttacaggtgacatcatcaaatatgatcagcaaggccagcaaattatcgtgaaaaatttttccaaaaatgtgagccggattatccgtataagcgatattcaacgcctgcgatttgtcccctcaactgtccaaacagcccaaaaaaatagatttaagaaagagtgagatgtagttgcttcatcccactcttttttcttagcgaatttgttcaaaatgtaaatgaactgcgatatgatctccataaccacttctttccaagtcacgttgtaaacgataggaaatgtagtgttctgcaatggtaatgtaacctgcgcccaataaacgatgttcaaccatagattgaatcatactgatagtcgcacgttccaccttggcttcttgtaaatccaaaactaccttcttagtgacttgagcaagattttgacgcaaatcatctgtcaaaacataaacagtttgggctgccttcaagatggcttggtaaatcttatctggattaaattcagcaatttcgccattacgtttgattacttgcataggtttctcctttattctttgttttctttgatttctgccagcattttttcttcttctactgtcagttgataatgttcaagtaaatccggtctgcgctcgtaggttttctttaaactctcgtacaatcgccactgacgaatcttttcatggtggccactcatcaatacatctggcacgaccatgcctcgataatcatagggacgtgtgtactgaggatattctaaaagacctgaagaaaaactatcatcttggtggctagactccttgccaatcacttctggaatcaggcgaactgtagcatcaatcatggtcatagctgccaattctccaccagtgaggacatagtcacctagggaaatctcatctgttaccaaggtcttaatgcgctcatcataaccctcatagtgcccacagataaagattagctcttcctcttgagccaaatcttcagcataagcctgatcaaactgctttccagcaggatcaaggagaataacgcgcggatttttcttttcaatagcatcaaaggaatcgaaaataggttgtgctctgagcaacatgccctgaccgcctccgtagggctcatcatctacatgacgggccttttcagcattttctcgaaaattatgatactggatatccaagagccctttttctcgagcctttccaacgattgagtgctccagtggagaaaacatctctggaaagagggttaaaatatcaatcttcatcgtctaacccttctaagatttccacatcgacccgtttacttggaatatcaacattgagaaccactggtgggatataaggtaaaagcaaatcacgtttgccttttcgtttgaccacccagacatcattagcacctggttgcaggatttccttgatggttccaaccaagctatcaccctcatagacttccaaaccgataatctcgtgatagtaaaattcaccatcgtctaggtcattcaaatcttcctcagcgaccttgagactgtatcccttgtacttttcgatagtattgatatggtacatatctttgaatttaataatgtcaaagttcttctgtttacggtggctagcgatggtcactgtttggacaaactgatctttttcatcaaacaaaaccagctcagctccttttttaaaccgttcttctgcaaaatccgtcacagacaagactcgcatctccccctgtaatccctgcgtattaacgattttcccaacattaaagtagttcatcttgtctcctgtaatctccttttttccatcttattctaacaattctcgaataatagccgcaattttttccgattctgaccattgtaaataatggtgattccctcctaaaatgagtttagtattggaagtccaatattctgattctctgtactctttttctctataaggctgacaaaaaacaaatacaggaatatgagcttctatagatacatcctcaaaatcttcctcagtaatctctccagatatctgaaattctggatcttgattttccaactctaagcctttttcttgcattaattcccagatttttttattcgtttcaggactaaatgttgcttgagttaagttcttaaaataaagttcaggaccacactcgtcaatcagcctcatctgctcttccatttctggataaggattttctgaaaaatcagcaaacatgacttttttagttgtcggttcaattgctactaaagtctgacgcttaattggtttctcgagtaatttgcaagctaaaattccactccaactatgtgcacaaagtatatattcagaaattcctaattcttcaagtacttcataaaccgcatctgcaagattatctagattttttccagcttggtcatgaatcggactcctacctgtgttcggaaaatcaattgtcaaataaccaattgtaggaggaggtttttcaagtataagtgaaaaattttcataacttggtagcaaacctgctccgtttaaacaaactagcactttcttttgcttttgataagtaacagagaggctaccaatttctgtagatacttcaaacctcttcataaagaaatccactgattctatataatgaattattaaaaatccttatcctttattttatcacgttccaaggattttctcaagttggaggaaggggacaatatctctactttcccttcaataatccttccaaattatgtttatgttggtaattaatggctgcggttttgtctttctcaaagacagtcttggtaaggtcaatatgattaatagctacgattgcgacggtgtagtaaatgatatcagccagttctctggcaagttcctcgttcgaatcctatcccttcttttcgaccagagcgcctattcaaaacctcgactacttctccgacttcctccactaacttcataaagagaccttcatcagtccgagactgctgttaatgttcgattaagtagtcttggaattgcctaaacgttcaatcttttatagtatattgaaactagaatagtacacctttacttctaaaacattgttagaaatcgatttgactgtcctgatcgatttgtcctgttcttgtttcattttactatatcttctattccacacaaaaaagcgagacatccgtcccgcccttcttatttttcgtcaataacgattcttacttttttgtattcagttgggacagagtagacaatcgttcttatcgcagaaatagtgcgacccttacgaccgattacacgacccacatcgctttgatcaagattcaaatgatattccaaaaattctggtgtatcctcaatcttgatagttaaggcatctggttgtgaaattaagggtttcacaatcgcaataatgagattttcaatcgtatccatctgtcaacctactttaaacttattttgaaaatttagaatcgtggaattttttcaatacgccttcttttgaaaggatgttacgtactgtgtctgaaggttgagctccattagccaaccatgcaagaacgcggtcttctttcaaagttacttggttttcagcaacaagtgggttgtaagttccaactgtttcgatgaaacgtccgtcacgtggtgaacgtgaatctgctacgttgatacggtagaaaggttttttcttagaacccatacgagtcaaacggattttaactgccatttttaaagtctcatttctttaattttttatttcggtgaaatagctgagctatttagcacatgttctattatagcagatttctggcatgtgtc

SEQ ID NO: 125 - DNA, 4881 bp; double-stranded, linear
aatttatttgactggaaattgtagagggttctcgaaatttcttgaatggttaaaataaggacaagagaaaacatggatatctatatccttgtgccaaaaaaaccactgccctccccagaccaacctgaggaaagcagtgattcttattttaggagttaggaatgaatacacgaaatcaatttagctgattattttttgtttttcaagaattcatcgtattgtttttgcatttcgttcaatactttttcgtaggcaccttcagatttcaatttttccatcaattctggaatcgctttatctgggtctacagtaccagtgttgatagctgtatcaaattgttgcattgtgttagcaatagctgagatttcagatttcacattgtcagtattgaagataaatccaagcgctggagattctttagcttctgccaattctttcttagaattttcgatttgttggtctgtaacgttttcgttgatgtaaaggatccagttgttaccagtgttccatccacccatgtgagtgtttcctttgtagccatcaagaacgcgaacacggttttctttaccttcaattttttcccagttcttgccttctggaccgtaaacaagaccgttcaagagttctgggttcgtattcaagaggttcaagatttccattgatttttctttgttcttagagttgtttgagatgacaaagttagcaacttgtgttgtttggtttttcttgatgaagttagtaattggtttgatttggatatctttgttggcaacacgtgaaagcaagctgttaccgtagtcagctggtcctactgtttcttcacgaacgaaccaagtatcttgttgaaggtcaaaggaagtatcgcttgttgcgacgtcttttggaatgtagccagcttcatagaatttgtgaagagtcttcaagtgttctttgaaacgaggcacttcgtaacggtttacaactttagtagtatcgccttcaaggtcgataacgaatggaagaccgtttgctactgggtagtcaaaattatcagatgggatgaaaactttaccaatagcaaatggtactacgtctggagctttttctttgatttgtttcaagactggctcaagagtttcgtaagaagtaacacctgaaatatcgataccatatttagcaaggagagttccgttgaaggcaaagttttgagatgatgcaacgttggctgcaactggaacagcgtaaatcttaccatttacagtattacccttgatgtaagctgggtcaagtgctttgtaaaggtctttaccttcttttttgtacaattctgtcaagtcagcgtaagcacctttttgagcatttacaatatagttatctgcaaaggcaatatcatagttttcaccagatgatgtgataactgacattttcttaccatagtcaccccagccaaggtattggatatccaatttggcaccaactttttcttcaatgattttgttggcatttgctaacaattcatccaagttgtctggtttgtcaccgatttggtacattttgataacaggtttgtcacctgaatcagcagcttttttgctgttacctgtcaaatttccacaagcagcaagacctgcagccagagcgactacactagcagatgcaaaagcatattttttccagtttttcatgataaaaactcctttttttatttttaaacttataaacaatgtaatgatcttatactcaataaaaatcaaagagcaaactagaaaactagccgcaggctgctcaaagcactgctttgaggttgtagataagactgacgaagtcagttacatatatctacggcaaggcgacgttgacgcggtttgaatttgattttcgaagagtattaacttcacacaagggaagttgggaactgagaaatgttatttctcaataagcactattctttcacaccaccgatagtcaaaccttttacaaagtagcgttggaaaaatggatacaaaatcgcgattggaagggttgcaaccacaaccatggccatacgacctgtttctttcggtagagcaactcccagttgaccaatcaagccgaccgctttggcaatgtagtccatattttgttggatttgcatgagcaaatattgcaatggatacaagttgtcactcttgatgtaaagaagggcgttgaaccagtcattccagaaaccaagagctgttaagagcgtgatggttgcgatacctggtagtgacaatggcaaacagatttggaagaaaatccgggcctcactggcaccatcgatacgagccgattctagaatggcttctggaatggtcttcttgaagaaggaacgcatcaagatgatgttaaatggtgagagaagcattggaacaatcaaggcccaaacagtgtcaccaagctgaagtacacgggtcaccatgatataacctggtaccaaaccagcgttgaacaacatactgagaaggacgaagatggtaaagaatctgcgatacttaaaggttgtccgtgaaatagcgtaggcataggttgttgtgataaagacatttgtcaatgtcccaactacggttacaaagacagagatgaagagggcttgtaggattttatccttaaactgtgccaaaaactcaaaaccgtctaagccaaattgggatgggaagaagctatagccgtattggaggaggcttttctcgtctgtcactgaaataatgataacgaatacaaaaggtaggatacaagagagggcaatcaaacccgaaatgatactgaagaagatatctgctttcttactgaaggagtgaatgccgacattatcaattttttcttttttaattttcttttttgccatattctcctcctttctagaacaaagctgagtttggatcgactcgtcttgcaagcaagtttgataggataaccagaatcaaaccaacaacggattggtaaagaccggctgctgcagccataccgatatctgctgtctgagtcaaaccattaaagacatatacgtccaaaacgttggttacattgtaaagctgaccagcattgtgtgggatttgatagaagagaccgaagtctgcgcggaagatatttccgactgcaaggatggtcaatacagttacaagcggagtcaactgaggaatggttacgttgcgaatacgttgccacttgctagctccgtccactgtcgctgcttcgtagtaggttggatcaattcccatgatcgtcgcatagtacatgacactgctatatccaaagcctttccaaatacctaggaaaagtaggagatagggccagatgcccaggtcagcgtagaaattgacttctttgagaccaagactttccaatagatgattgaacacccctttatcaatatttaggaaggcatctgtaaagaaactgatgataacccaagacaagaagtaagggaacaacatagaagtttgaaaaatcttcaccattctcttagaacggagctcgctgaggataatggcaatccctacagatacaactaaacctagaaagataaagccaagattgtagaggacagtatttcgtgtgataataaaggcgtctcttgaactaaataagaatctaaaattatcgagtccgacccatttactatttatgatactatctatgaaaccattactggtcatgtggtagtctttgaaggcaaccacgttcccaaatactggaatgtaaaagaatagaatcaaccagagtgcccctggcaaaaccatcaagagaaagatccagttgtctctcaatgtttttgaaaactttttcataatttcctccctttttattttgatatccatctaaaaattcttttttagacttttgataacgattacattattagtatactcctatttgcaggttaggttaaactcctaattatagaaaaaactccacaaattatgtagcagatttaaaactttatcaccactatcaaacaaatgtcctaaatcaattgtttattttatctctattagcccagtgatggcgtcactctgttataagcatccaacaacggggtatactgaaaaatctccagactagggaactcagcgatagttcctaatctggagatttttaatatgttattaggcgtttgctttcaacttagcaataacctctttaagattatcaatcaactctgctgcagtatgctcagagcctttttcatctgccaagaacaaaactgctttttgaagttctttttgagagttttcaaggacatccttatctactgtttcaaggtttgagtctttaagaagtttacttaattccttggctaatttcttgagtttgatttgcagactcatcttctcctgctgtttctttgcccgctgtttgtcctccatccttagttgctgactggctttccttaatggactctagggaagcaatggcatctttgactgtttgcaagatatcacgtaaaccttgctctgtcaaactatcatctgcaaaagctttattagcctctgccaaaaccagacgtgctgaatctgtggtaggattcgatacacctgtcaatgatctcaaaagattttctaaggtttgagtctgcttactaatactagactaaaatcaaaaagtattatataacagtgatatgaaatcaactaaagaagaaatccaaaccatcaaaacacttttaaaagactctcgtacagctaaatatcataaacgccttcaaatcgttctattttgtctgatgggcaaatcttataaagagattatagaacttttatagtagtttgaaataagatgtgaacatctctatcaggaaagtcaaattaatttatagaaatattttagcagccaaggtgtactgttatagattcaatacactatacttggtggtttagctcg

SEQ ID NO: 126 - DNA, 13121 bp; double-stranded, linear
aggatccccggaaaaggagactaaaaatgaagaaaaaatttctagcatttttgctaattttattcccaattttctcattaggtattgccaaagcagaaacgattaagattgtttctgataccgcctatgcaccttttgagtttaaagattcagatcaaacttataaaggaattgatgttgacattattaacaaagtcgctgagattaaaggctggaacattcagatgtcctatcctggatttgacgcagcagtcaatgcggttcaagctgggcaagccgacgctatcatggcagggatgacaaagactaaagaacgtgaaaaagtcttcaccatgtctgatacttactatgatacaaaagttgtcattgctactacaaagtcacacaaaattagcaagtacgaccaattaactggcaaaaccgttggtgttaaaaacggaactgccgctcaacgtttccttgaaacaatcaaagataaatacggctttactattaaaacatttgacactggtgatttaatgaacaacagcttgagtgctggtgccatcgatgccatgatggatgacaaacctgttatcgaatatgccattaaccaaggtcaagacctccatattgaaatggatggtgaagctgtaggaagttttgctttcggtgtgaaaaaaggaagtaaatacgagcacctggttactgaatttaaccaagccttgtctgaaatgaaaaaagatggtagtcttgataaaattatcaagaaatggactgcttcatcatcttcagcagtgccaactacaactactctcgcaggattaaaagctattcctgttaaggctaaatatatcattgccagcgattcttcttttgccccttttgttttccaaaattcaagcaaccaatacactggtattgatatggaattgattaaggcaatcgctaaagaccaaggttttgaaattgaaatcaccaaccctggttttgatgctgctatcagtgctgtccaagctggtcaagccgatggtatcatcgctggtatgtctgtcacagatgctcgtaaggcaacttttgacttctcagaatcatactacactgctaataccattcttggtgtcaaagaatcaagcaatattgcttcttatgaagatctaaaaggaaagacagtcggtgttaaaaacggaactgcttctcaaaccttcctaacagaaaatcaaagcaaatacggctacaaaatcaaaacctttgctgatggttcttcaatgtatgacagtttaaacactggtgccattgatgccgttatggatgatgaacctgttctcaaatattctatcagccaaggtcaaaaattgaaaactccaatctctggaactccaatcggtgaaacagcctttgccgttaaaaaaggagcaaatccagaactgattgaaatgttcaacaacggacttgcaaaccttaaagcaaacggtgaattccaaaagattcttgacaaatacctagctagcgaatcttcaactgcttcaacaagtactgttgacgaaacaacgctctggggcttgcttcaaaacaactacaaacaactccttagcggtcttggtatcactcttgctctagctcttatctcatttgctattgccattgtcatcggaattatcttcggtatgtttagcgttagcccatacaaatctcttcgcgtcatctctgagattttcgttgacgttattcgtggtattccattgatgattcttgcagccttcatcttctggggaattccaaacttcatcgagtctatcacaggccaacaaagcccaattaacgactttgtagctggaaccattgccctctcactcaatgcggctgcttatatcgctgaaatcgttcgtggtggtattcaggccgttccagttggccaaatggaagccagccgaagcttgggtatctcttatggaaaaaccatgcgtaagattatcttgccacaagcaactaaattgatgttgccaaactttgtcaaccaattcgttatcgctcttaaagatacaactatcgtatctgctatcggtttggttgaactcttccaaactggtaagattatcattgctcgtaactaccaaagtttcaagatgtatgcaatccttgctatcttctatcttgtaattatcacacttttgactagactagcgaaacgcttagaaaagaggattcgttaatggcaaaattaaaaattgatgtaaatgatttacacaagcactatggaaaaaatgaagtcctaaaaggaattacgactaagttctatgaaggagatgttgtttgtatcatcggtccttcaggttctggtaagtcaactttcctccgtagcctcaatcttttagaagaagtcactagcggtcacatcactgtgaacggctatgatttaactgaaaaaacaaccaatgttgaccacgtccgtgaaaatatcggcatggtattccaacacttcaacctcttccctcatatgtctgtattggacaacatcacctttgctcctattgagcacaagttgatgactaaggaagaagctgaggaattgggaatggagttgcttgaaaaggttggactagcagataaagctaatgccaatccagatagcctatcaggtggtcaaaaacaacgtgtggccatcgctcgtggcctagcaatgaatccagacatcatgctcttcgatgaaccaacttctgcccttgaccctgagatggttggagacgtacttaacgttatgaaggaattggctgagcaaggcatgaccatgattatcgtaacccatgagatgggatttgctcgtcaggttgccaaccgcgttatctttactgcagatggcgagttccttgaagacggaacacctgaccaaatctttgataacccacaacaccctcgtctgaaagagttcttagataaggtcttaaacgtctaaactcaaactgtaaggatttccttgcagtttttctacctcgtattggaatttttgatttttcggaaaattatgttagaattaagtttatgaaatgaggtttcctcatacctagcaagactaggaataaaaatagaaattaggtagctagatgtcatctaaggttattgttacaattttcggtgcgagtggagacctggctaaacgcaagctctacccttccctttttagactatatcaatccggcaatctttccaagcactttgccgttattggaactgcccgtagaccttggagtaaggaatattttgaatctgtagttgtcgagtccatccttgatttggcagatagtaccgagcaagcccaagaatttgctagccacttctactatcaaagccatgatgtcaatgattcggaacattatattgctttgcgtcaattacaagctgagcttaatgaaaaataccaagctgaacacaataagctcttcttcttgtctatggcacctcagttctttggaaccattgccaaacacctcaaatctgaaaacattgtcgatggcaaaggttttgagcgcttgatcgttgaaaaaccatttggtacagattacgcaactgcaagcaagttgaatgacgaactcctagcaacatttgacgaagaacaaattttccgtatcgaccattatcttggtaaggaaatgatccaaagcatctttgcagttcgctttgcaaacttgatttttgaaaacgtttggaacaaggattttatcgacaatgttcaaattacctttgcggagcgcttgggtgtagaagaacgtggtggctactatgaccaatccggtgccctccgtgacatggtccaaaaccacactctacaacttctttcgctcctcgccatggacaaaccagcaagcttcacaaaagacgagattcgtgctgaaaagattaaggtctttaaaaacctctatcatccaactgatgaagaactcaaagaacactttatccgtgggcaataccgctctggtaagattgatggcatgaaatacatctcttatcgtagcgagccaaatgtgaatccagaatcaacaactgaaacctttacatctggtgccttctttgtagacagcgatcgattccgtggtgttcctttctttttccgtacaggtaaacgactgactgaaaaaggaactcatgtcaacatcgtctttaaacaaatggattctatctttggagaaccacttgctccaaatattttgaccatctatattcaaccaacagaaggcttctctcttagcctaaatgggaagcaagtaggagaagaatttaacttggctcctaactcacttgattaccgtacagatgcgactgcaactggtgcttctccagaaccatacgaaaaattgatttatgatgtcctaaataacaactcaactaactttagccactgggatgaagtttgtgcgtcatggaagttgattgaccgtattgaaaagctctgggctgaaaatggtgccccacttcatgactataaagctggaagcatgggacctcaagccagctttgacctacttgaaaaattcggtgccaaatggacttggcaaccagatatcacctatcgtcaagatggtcgcttagaataaaaaaatttcctgcaagtttatgccttgcaggatttttgcttctgattagattaaaccttccaagagacctttcataaagttttctgagttaaactctccaatatcatcgattttttcaccaaaaccaatcaattttacaggaatattgagttcttcacgaatggctagaaccacacctcctcgagcagttccatcaatcttagtcaaaacaattcccgttaaaggtgtgattttcgaaaattctttggcctgtactagggcattttgacctgttgatgcatcaagtgccaagaaggtttcatgtggtgcttctggcacaacacgtttgataatacgaccaatcttttccaactcagccataaggttatccttattttgcagacgaccagcagtatcaatcatgagaatatcgataccttcagtcacggcacgttccataccatcaaagaccacgctggctggatcagctttttcaggtccagttactactggaacatctactcgtcggccccattcagctagctgagctactgcacccgcacggaaggtatctgctgcaaccagcatgaccttcttaccagcttgtttgtagcggtgggctagttttccgatagaagttgttttcccaacaccattcacaccaacaaagagcataactgtcaagttatcttggaagtggatgctttcatcgtagctaccatccttttcataaagctcaaccaatttctcaatgatgacacgacgaagtacatcaggtttcttggcattttcaagcttggcttcgtaacgtagttcctccgttaagttagaagcgacttggacaccaacatcactcataatcagcagttcttccagttcctcgaaaaattcttcgtcaacagagcggaagttagcaaagaaggcattcaagcgggcaccgaaacctgtgcgagttttcttaagactgcggtcatatttttcctgaacagtttcttctgtttgaggagcttctggttcaagcacttcagaattattttcttctacagttccttcgtgctcaagcttctcttcctctggtaattcttctgagtttggtaattcttctatttcttcttgagaaacccctacagctggctctgaatcctgactttcttcaactgtgtcttggatttcctcttcttggaacacagcttgttcaacaatttcaacctctgcttcttcctgagaaacttcctcaacttctgtgaaggtaggatcaacatcttcagacaaatcaagattttccagagcttcttttacaacttcttcgattttaggttcttctttttttccgaatagacggtcaaacaatcccatatcttagttctcctttagcacatattcttcgatagcccaggcgacagcttcctcatcgttggtcatcggcgtcactacatttgcggctgcctttacttcaggaacagcgttttgcatagcaacaccaagacctgcccattcaatcatagagaggtcattggcctcgtcaccacaagccatcacttgactttggtcgattccaagatggctgattagttttgccaaacctgttgctttatgaacattctttggtgaccattctagcaacatttcacgtgatttaaagatttcatattggtcaaacaattctggagaaatcttctgaatggctgcatccaagggttcttgagcaaaggcagtcacgcatttgttgtaggtcatttgactagataagtcttcaaagtccactggaacaaaggtcaaagctggattgaatttggcataaagactttcttggtccgattggatttgataaactgttccttctgagatggcatcaagaggcagtgataatttctctgtttcttcatacaaacgtgccacatcatcatatgaaaagactgttttatcaaggatttctcctgtatttttctgaactaatccaccattaaaagtaatggtatactcatcttcctgaccgtcagtccctaactcatggagaaagaaatccatggcttttaagggacgaccagttgtcaatacgaccttgataccacgatcacgcgcagcttgcaaggtttccttggtacgatccgtcagccttttatcagtagtcagcaaggtcccgtccaagtccaatgcaatcaattttatatctgccattataagccctccatataagctataaccgaccgttccttatggtgaccaatcacagtctttgctaattctaaaatttcaggtcgtgcattttcaggagctacaggatgtcccacaacctgcatcatatgtaagtcattaagattgtctccaaaagccatgacctgatccattgtgataccaagttttttaactaattcaacaatggccactcccttatcgacatagtccagaacaatatcaatggattcaaagccagttgtcatggccttaacaccaggaacgttttcgtttacccaagcctccccatcttccagcgtttcttctgtgaagttggttgtaaatttgaaaatgtcatctgtgatatcttccaaactcgctactttttggatattttcattatagtgctgactcactttcaaataggtctcatcaaccgtatctagaacatatgaacccttcttacccgtcaagagcagtttattgatatctacataaggtgaagttttcagcttttcaaaagttgccagataaaagtcacgagacatagtcgcttcatacaagtcctgaccttgatactctaccaaactgccattttccgcgatgaaaataatgtcatcacgaacaccagcaaataatttttctagagacagaaatccccgacccgaagctaccgcaaagtaaatccctttttccttgtaggaaaccaagagagacttgagacgatccatatcaaagcgtccattcccatctaggaaggttccgtccatatccgttgctactagtttaattgtcatccttcaatactttctaaatcttttaacttaactgaaacaatctttgaaacacccgattcttgcatggtcactccatagatggaatcagccgctgccatggttcccttacggtgggttacgacgatgaactggctgtccttgtcaaagcggttgaggtaatccccaaaacgtttaacattggcttcatccagcgcagcttccacctcatccaagataacaaatggaatagtcttgacacgaataatggagaagagcaaggcaagagccgatagggctttttcaccaccactcatgagattaagagactggattttcttgcctggtggttggacagaaatttcaaccccagctgtcagcaagtctccttcagtcaaaatgaggtcagcctgacctccaccaaacatctgcttgaaggtcactttaaaggactcacgaatgacctcaaaggttgatttaaagcgttccttgacctcatcattcatctctgtaatggtctcaaggagcaggtttttcgcagacaaaatatcatcacgttggctatttaggaaatccagacggttgtgaacttcttcgtactgttcaatagcgtctaaattgacaggacccagtgagcgtatagccttctctaaatccttaacttcttgctctgccagattgagattttccaactcatgcgccttttctaaagcttctgtgtagctgatctggtactggtctgttaattgactttgtagatggcgcaagcgctcgctaaccttttctttcttggcttcagcacgagtttgcttgcgaatccactcttcattctgctggcgagcctgatccaaatgactagcaatatcatccagttgaccctcaatatcatccaactcaaactgcttgcgaatcaaaccttgttggagatttgttttttgagttttggattcttccgcctgttgactgagcaattctgtatcaaccttctcaagattatcaatcttttcttgaagaaggcgctggatttcctcttgttcaaaatcaagattgtccaattccttgcctaagcgttcaatatcagcaacttcataacgtttttgcccttgcagttctgtcttaagcaaacgagcttgcgctagctcttcctgcaagttttgatagcgttcttggatggcatttttgttagacttaatctcttcaatctcagcttccagattttgcttgtcactggagattgcagcaagacgctcttggcagttttccttatccgcttgccaatctccctcggaaagacgatctatttcctcttcttggagtttccaaagagtttccagttcttcaacttgctgactagtttgctgataagcgaggaacaagccttgctcctgaatacgtgcctgctctccttgagatttaatagcttctaatgactcggtcaatctggccatctcatcttgcaaggtcttcaaagtcgcctcttctgaacccaagcttgcttcttcttcagcaatttctttttgtaattgctccagttctggcttgataaaaatgctgttattctggcgattggcaccacctgcataagaaccacctgtgcgcaactctgtcccatccaatgtcaccatacgaacctgataacgaacttggcgagctgctgcacgcgcatgttctacggtatcaaagatagccgtcgtagctagcaagttcttgaaaatggcttccagtctagtatcaaaagtcaccaactcatctgccatcccaaggaaacctgggcttacagcgatagcatcttggttctgactagaaatcgtacgcgccttgatagtggtcaaaggaagaaaggttgcacgaccggctctgttccgtttaaggaagtcaatagccttggttgccgactcttcatcttctacgatgatatgctggctacttgcccctaaggcaatctctagggcagtttgataataaacatcaaaggtcagatgctcactgactgcaccaataatcccacctaggcgatctttttcttggagaacactcttaacacctgcataaaagttactatgatttctcaggatattttccaaactttgagctctggcctgcttgtttttgagattatccagacggtcaaagagttggctttgttgagcttgataggaagttttctgctcctcttgctccttggcaatagcttggtagtcagccaataatttctgaacctgctccttggcagtttcaagctcttccttttgctgactagccttctctttagctatagctaattgctctttcagcttttctagttgatctgcttgtttttgagaaagctgacgactattttccaactcattctcaatacgggtcaactggtttgagacatccgcttcttcttgtaaaagagctacaaagcgttcacgtaagagctcaatcatctgatcaggatcgtctgagaaagccagcaattcagcttctaaacgattgagtttttgattattttggactagatttccctctaacagagctaaagagctttctttatcagacttttctttgctgagtgaatttctcttatcctccaaagcagccaaacgggcttgtgcctcctgttgattcaaggccacttgctcggactccagtttcgatagggctaattttctttctaaatcactaatcagactagtcaagtccatcaaactgccttggtctttggccatttcagcctgtaaatcttggcgttgctttttaagagtttgattttcttcttctaatttttcacgcttttggtaataactcatcaagagttcttgaacctgagtcaactcttcttctgtcgactctagttcagccttattttccttgatttgagcaaccagaacatctaaataaatagccttacgttgtccttccaagtctaaaaacttacgggcattctcagcttgcttctcaagaggcttgatttgattatccaactcgtagataatgtcctctaagcggtccagattatcctgagtttgctgcagtttactctcggtttcttttctgcgagtcttgtattttaaaactccagcagcttcttcaaaaatagctcgtcgttcctcaggcttggaattaaaaatctcctcaaccttcccttgggaaataatagagaaggaatctcgtcccaatccagtatccaagaagaggtcatgaatatcacgcagacggactttcttgccgtcaatcttgtattcgctatctccactacgatagacatggcgttccaccctgatttcttgacctgcatccttgataaatccgtcatgattatccagagtcacaactacagaagcataattgagcggtttgcgactttcggttccagcaaagatgatatccggcatcttgcccccacggagactcttgacactagactcccccaaagcccaacgcagactttctgtaatattggactttccagatccattgggtccaacaactgccgtcacaccttggtcaaaaacgaccttggtcttatcagcaaaagacttgaacccctgaatttcgatttcctttaaatacatgaatccagccccttctcaacggcatttttggcagcttcctgctctgctaatttcttagaacgaccttggccttgaccgatgctcttaccttcaacaagaacttctacatcaaaaaccttatcgtgagcaggccctgtttcagaaatcacctgataacgaatagccacatcaccattgacctgaagcaactcttggagatgggttttatagtctgtaatcatctcaaactcgcctgcttcaaccttaggaatcatgacttgatagataaattccttgaccttggccacatccttatccaaaagaagggcaccaagaaaggcttcaaaggcatcaccaagaatggtgtcacgattgcgaccacctgatttttcttcccctttacccaacttgataaactggtcaaactggcaatcacgcgcaaaaccagctaaactctcctcacggacaatcatagcacggagttttgataggtcaccttcaggctttttaggatattttttatatagatattctgaaatcaataactgtagaacagcgtctcctaaaaattccaagcgttcattgtgtgaaatttttaagaggcggtgctcattggcataactcgtatgagtaaaggcagtttccagtaactttttgtctgcaaattcgattgcaaaatgattctttagtacagtttgtaattctttcataccaacctctttctaactgataatagtcctttttattatatcaaaaaaagccccctgagtcactctaaaacgggactggaaagcatttgggaattctttagacagagattctcagttttagcggcaaatttgggtcaggataaagaaaaaagccctattaaaggctttttaggatgtttacatccaccctgagggaatcgaacccccatctcaagaaccggaatcttacgtgatatccattacactaagggtggaaacttgttttattataacagaaatttgctctaataacaagttttttggtcaaagaccccgtcttagtgggaagcatccccattccagatggagtttttcacgatcacataatcaacgtgtttaaggtcagcaacctgacgtccacctgcataagaaatagcactttgaaggtcttgttccatctcagttaaagtgtcttgcagatgacctttagcaggaagcaagatacgtttgccttccacatttttgtaagcacctttttgatattgtgaggctgaaccataatattctttgaactgttcaccatcgacttcaatcgttttccctggactttcaatgtgtcctgcaaagagggaaccaatcatgatcatgctagcaccgaagcggatagacttagcaatatcaccgtgagtacgaattcctccatcagcgataatcggtttacgcgcagccttggcacaccagcgtagagcagccaactgccaaccacctgtaccaaaaccagtcttaaccttggtgatacaaaccttaccaggaccgattccgaccttagtagcatccgcaccagcattttccaattcacgcacagcttctggtgttcccacatttccagcaatgacaaaggtatctggcaattctttcttgatgtgttgaatcatagaaatcacgctatccgcatgaccatgagcaatatcaatagtgatatactcaggagtatcagccttgagctggctaacaaaatcatactcataatccttaacaccgacagagatagaagcaatgagcccttgattgtgcattcgtttaataaaaggaatgcgtcctgcctcatcaaaacggtgcataatgtagaagtaaccacctttagccagttgctctgctacattttcatccaaaatcgtctgcatattcgctggcacaacaggtagtttaaaggtgtgatttcctaaagtgacacttgtatccgcttctgcacggcttttaatgacacatttatttggaatcaattgaatatcttcgtaatcaaaaattggaaattcatttaacatatcgatgtctcgtttcttttgtaatgacctacctatgctcttgcatcactacgccttttccgacgtttcctgg

SEQ ID NO: 127 - DNA, 9578 bp; double-stranded, linear
ccgaatgcaatgtttacggttgaacttgaaaatggacatcagattttagcaacagtttctggtaaaattcgtaaaaactatattcgtattttagcgggagatcgtgttactgtcgaaatgagtccatatgacttgacacgtggacgtatcacttaccgctttaaataatcgaaaaacttggagggataagaaatgaaagtaagaccatcggtcaaaccaatttgcgaatactgtaaagttattcgtcgtaatggtcgtgttatggtaatttgcccagcaaatccaaaacacaaacaacgtcaaggataagatagaaaggagaaaacatggctcgtattgctggagttgatattccaaatgacaaacgcgtagtaatctcattgacttatgtttatggtatcggacttgcaacatctaagaaaattttggctgctgctggaatctcagaagatgttcgtgtacgtgatcttacatcagatcaagaagatgctatccgtcgtgaagtggatgcaatcaaagttgaaggtgaccttcgtcgtgaagtaaacttgaacatcaaacgtttgatggaaatcggttcataccgtggtatccgtcaccgtcgtggacttcctgtccgtggacaaaacactaaaaacaacgcccgcactcgtaaaggtaaagctgttgcgattgctggtaagaaaaaataatataggaggtaaaagtcttggctaaaccaacacgtaaacgtcgtgtgaaaaagaatatcgaatctggtattgctcatattcacgctacatttaataacactattgttatgattactgatgtgcatggtaatgcaattgcttggtcatcagctggtgctcttggtttcaaaggttctcgtaaatctacaccattcgctgctcaaatggcttctgaagctgctgctaaatctgcacaagaacacggtcttaaatcagttgaagttactgtaaaaggtccaggttctggtcgtgagtcagctattcgtgcgcttgctgccgctggtcttgaagtaacagcaattcgtgatgtgactccagtgccacacaatggtgctcgtcctccaaaacgtcgccgtgtataatcatcgcattacactgcttttcgtttaagagggagtaactaaatgatcgagtttgaaaaaccaaatataacaaaaattgatgaaaataaagattatggcaagtttgtaatcgaaccacttgaacgtggctacggtacaactcttggtaactctcttcgtcgtgtacttctagcttctctaccaggagcagctgtgacatctatcaacattgatggtgtgttacatgagtttgacacagttccaggtgttcgtgaagacgtgatgcaaatcattctgaacattaaaggaattgcagtgaaatcgtacgttgaagacgaaaaaatcatcgaactggatgttgaaggtcctgctgaagtaacagctggtgacattttgacagatagcgatattgaaattgtaaatccagatcattatctctttacaatcggtgaaggttcttctctaaaagcgactatgactgttaacagtggtcgtggatatgtacctgctgatgaaaataaaaaggataatgcaccagttggaacacttgctgtagattctatttatacaccagttacaaaagtcaactatcaagtggaacctgctcgtgtaggtagcaatgatggtttcgacaaattaacccttgaaatcttgacaaatggaacaattattccagaagatgctttagggctttcagcacgtattttgacagaacatcttgatttgtttacaaatcttactgagattgctaagtcaactgaagtgatgaaagaagctgatactgaatctgacgaccgtattttagatcgtacgattgaggaactggacttgtctgtgcgttcatacaactgtttaaaacgtgccggtatcaatactgtgcatgatttgacagaaaaatctgaagcagagatgatgaaagtacgaaatcttggacgcaagagtttggaagaagtgaaactcaaactcattgatttgggtcttggattaaaagataaataaaggaggaatacatggcttaccgtaaactaggacgcactagctcacaacgtaaagcaatgcttcgcgatttgacaactgaccttttgatcaacgaatcaatcgtgacaactgaagctcgtgctaaagaaatccgtaaaactgttgaaaaaatgattactctaggtaaacgtggtgatttgcatgcacgtcgtcaagcagctgctttcgtacgtaatgaaatcgcatctgaaaactatgatgaagcaactgataagtacacttctactacagcacttcaaaaattgttctcagaaatcgcacctcgttatgctgaacgtaacggtggatacactcgtatccttaaaactgaatcacgtcgtggtgatgcagcgccaatggcgatcatcgaattagtataaaatcatcaattttgttgagtgttatgatgatggagtcttgtgctcttagtctagctctggtctaccgctaggatttcggtcctagcgggaacactcatcataagttgggatagtagacgcttgtttacgaaattgtttttttcttaagaacaacttcgtaagcaggcgtttttgagtattttcgttagaattatgctatactatttgaaaagaatcctgtttaatgttaaggtttcttattttaagaagaattggagtttacttatgaaagccattataactgttgttggtaaagataaatctggaattgttgcaggtgtttctggtaaaattgcagaattaggattgaatattgacgatatctctcaaactgtcttggatgaatattttacgatgatggctgttgtatctagtgatgaaaagcaagattttacctatcttcgtaatgaatttgaagcttttgggcaaactttgaatgtaaaaatcaatattcagagtgcagcgattttcgaagctatgtataatatctaggaggtcatcatggatattagacaagttactgaaaccatcgccatgattgaggagcaaaacttcgatattagaaccattaccatggggatttctcttttggactgtatcgatccagatatcaatcgtgctgcggagaaaatctatcaaaaaattacgacaaaggcggctaatttagtagctgttggtgatgaaattgcggctgagttgggaattcctatcgttaataagcgtgtatcggtgacacctatttctctgattggggcagcgacagatgcgacggactacgtggttctggcaaaagcgcttgataaggctgcgaaagagattggtgtggactttattggtggtttttctgccttagtacaaaaaggttatcaaaagggagatgagattctcatcaattccattcctcgcgctttggctgagacggataaggtctgctcgtcagtcaatatcggctcaaccaagtctggtattaatatgacggctgtggcagatatgggacgaattatcaaggaaacagcaaatctttcagatatgggagtggccaagttggttgtattcgctaatgctgttgaggacaatccatttatggcgggtgcctttcatggtgttggggaagcagatgttatcatcaatgtcggagtttctggtcctggtgttgtgaaacgtgctttggaaaaagttcgtggacagagctttgatgtagtagccgaaacagttaagaaaactgcctttaaaatcactcgtatcggtcaattggttggtcaaatggccagtgagagactgggtgtggagtttggtattgtggacttgagtttggcaccaacccctgcggttggagactctgtggcacgtgtccttgaggaaatggggctagaaacagttggcacgcatggaacgacggctgccttggccctcttgaacgaccaagttaaaaagggtggagtgatggcctgcaaccaagtcggtggtttatctggtgcctttatccctgtttctgaggatgaaggaatgattgctgcagtgcaaaatggctctcttaatttagaaaaactagaagctatgacggctatctgttctgttggattggatatgattgccatcccagaagatacgcctgctgaaactattgcggctatgattgcggatgaagcagcaatcggtgttatcaacatgaaaacaacagctgttcgtatcattcccaaaggaaaagaaggcgatatgattgagtttggtggtctattaggaactgcacccgttatgaaggttaatggggcttcgtctgtcgacttcatctctcgcggtggacaaatcccagcaccaattcatagttttaaaaattaagaaaataggagaaattttaagttctatttaagattagacgtgtatactataatcattaaataaagacctcctaatattatttgaaacagataacactgaattagtttgaatttgattttcatctaatatctttatttaatgaactcctaaactttttcataataatctccttcaaaagtcgcctgtatgggtggcttttattttatcattcatgatataatagaagcaaacggaggacggaaaatggtaaaagtacgattgtatttggtacgtcatggcaagaccatgtttaacacgattggtcgcgcgcaaggttggagcgatactcccttaactgctgaaggtgaacgagggattcaagagttaggaatcggtttgcgagaatctgatctacagtttgagcgtgcttattcgagtgattctggtcgtaccattcagaccatgggaattatccttgaagaacttggcttgcagggggaaatcccttatcgcatggacaagcgtatcagagaatggtgtttcggtagttttgatggagcctatgatggcgatcttttcatgggcattattcctcgtatctttaatgtggaccacgttcaccaattgtcttatgctgaactggctgagggcttggtagaggtcgatacagctggttgggctgaaggctgggaaaaactcagtggccgaatcaaggaaggctttgaaatgattgcaaaagaaatggaagatcaaggtggaggtaacgcccttgttgtcagccatggaatgactattggaaccattgtttatctgattaatggcatgcatccgcatggtctggataatggtagcgtgacaatccttgaatatgaggacggccagtttagggttgaagttgtcggtgaccgtagttaccgagagctaggacgtgagaagatggaagaaggctctatttaatcagtctagacttgcttgccatgagctagggatttgataagaatatcaagataagaaaaaacagccgagggcactcctttcggctgtttttgatgtggaaaactaaagtgtaatgctattgcttttagagattttcataaacaagagcaaggaacctactgttagaacagtcaggatagttgacaaggttgcggctacaccgtaatttcctctgagaacctctgtataaatagctacagtcattgttcttgttttgacattgtagaggaggatagaagtagagagttttgaaatcattgtgactcaagataagatggctccagaaatgataccagatagcatcattggagttgtaatcttagcaaaggtattgagacgactacttcctaagctttcagcagcttcttcaatacttggtgctatttgttgtaagctagcaacagatgagcgaatagtataaggtaatcttctggcagatagagacataatcaagatgaaagcagtccctgtaatcataagaaatccacttccaaatagaccagtattgaaggaagaaatgaaggcaatccctagaacggttcctggtacaatataaggtaccatactgaggctgtcaattaagtttgtaaacaaattccgttttctaacggctaggtaggagataaatgtcgcaaatagaacaactagaactaaggcaatcaaagggatacgaatggtattgaaaatagcagatcccatacgatggaaagctaccttgtaactgtttggagaataacctttaacagataccatacctgatgtttttaggaaagaggtataaattaagtagatttgaggtaaaacagagataaagataattccgtagactgttgcataaatggcagccatttttccttttgtagtttttttaggctcaattggatggagcagattcatgctgaaactgtagcggtttgcaatgtgtttttggataaggaaaattgccaaggcaatgataatcgccataattgcaaaagcagaatttcctccaacctcgctaataaattgggtataaatcaggacagggaaagtccgatacccttcgccaatcaacataggcgttccaaagtctgagaatgctctcataaatacaagcaaggagctgctagtaaggttggaactaggagaggtaaaacaaccgttacgataggtttaaatccgaaggaccccatgctttcagctgcttcaagtagagaattgtcaatactgttcattgttccagcaacatatagaaataccagtgggaatagttgcagtgtaaagacaagtacaattcctttgaatcaataaatatcgatagctggaagataaagggcatttgtcaaaaatttagtgatgacctcatttcgtcctagcaagagaacccaggagtaggctcctacgaaaggagctgacatggaagcaatgataatcaatatttgtagaaatttcttccccttgaagtcatacatagagaagagataagctaatagggttcctacaactaaggaagtgatagtagcggtaatggaaaccttgaaactgttgactagtgtctcagagtagtaggctttactaaagaaagtgacaaaattagctagtgagaattgtccttcatgtataagtgcttgcttgagcacggtaacgataggataaacgagaaagataggataggtaagaaagaggaagaaagaggaaactgtccaaatatttagttttttacgttccatggttgactccttttatcaggttttgggaaccatctgcagaaaagatgtttaatttttgcgtattgattcgtagacgaatacgattgcctttttgtagatcttcttcaaaagttgattcttcactaacttgaatttttgaggcaaaacctgtctcaatgaaataatccgtatttagtccaagatagacgctatctctaatagttccttcaatatctccagattcatctttgataaactcttcgggacgaatgcttacatgaatagcttgctcctcaacctgatcaagagctggcattcgaagggcatagccatctgaaaagacgatataagcgccgtcgctccgtttttcaagattggcagggataatatttgtgcgtccgataaaggttgccacaaactcattagctggtttatgatagagttcttttggtcggccgatttgttggatcaccccatctttcataacagcaatttggtctgaaatagccatggcttcttcttggtcgtgggttacataaacagttgtaattcccacttcgtgttggatttctcggatggcttgacgcatatccaagcgaagtttggcctccagattactaagtggctcgtccatgaggagaacacttggattaaccgctaaggcgcatgccaaggtgacacgttgttgttgtccaccactgagtttatcgggctttcgatccgcatattgagcaatttgcatgagttcaagatacttgttggtctgttgaatcaattcttcttttggaaccttcttttgcataagaccaaaagcaacgttgtctcggacagtcaaatgtgggaaaatagcgtagttttggaaaaccatcccgatattgcgtttgctgggttccatattattgatttttgtatcatcgaagtaaaattctccaccttcgatactgttgaaacctgcaatcatacgaagaagggtcgttttcccacatcctgaagctccaagaagggtaaagagacttccttttggaattgtaatgttcaaattctcaataacagggacatcgtggtagatttttttggcgttaataattttgatctcactcatagtgaacctcttttactgtttagattggatatctgtaaagacttcgttgtatttcttaacgatatctgatttattcttgatgacataatcataatcttcagtgagtgttttgattttgtcaattggtttcatgttttcgcttgttttagcatttttacgaacaggacggttagtagtggttgtaccaagtgtatcttgtacttcttgagagataataaaatcgataaatttcttggcattttccatatttttagattttttaacgatagcagcactagcaggtaggaagacggttccttcttttggatagactaccttaatgttagctccgtcatttaagagtttaactgctggatcttcataagagagaccaacagccatttctccatcagcgactactttatagacactagatgaacttgaaccgattttaccatcaataagtgtgaaaagatcttttacataagaccaagccttatcatctttgtaaccaccttgagcttgtagcatatttgttaattgagcaaaggcgctagaagagtttgctgggtcagcagttgcgatttttccttttagttcaggtttgaaaagatcgttatatccttcgatgttcatgcctttagttaaatcagggttgacgattaaaacactaccatctagtgtataaggagtagagtagccagttgtgttttgatattctttgataacattatcattttcttttgaagtatagttttcaaagagttctccgtgggtagtatattgtgtataagaaccaccaaagataacatcagctacaggaacttctttttctgactctagttttttgaaaagttctccagtaccagcttgaatcagttctactttgataccatatttttcttcaaaggcaggaatagttgctccaattaagccctctgagtttggtgaataaacgactagcgaaccgccgtctcctttatcagatgaactgtcatcggcagattcattagaagaacaagcagcataatacatccatttctttttcatgatggatacctccgttgtgttatttaagtttattttaaaacaatgtaagcgtttttaaaacatacaattctattctatagtgtattgaatctataacagtacactttgactgctaaaatatttctataaattaatttgactttcctgatagagatgttcacatcttatttcaattcactatattagagtaaaattctctacaaaaagaagaatagcctattttactattcttctgagtgatttcaattcctttggggaaatatggagatactttttaaatcctgacaaatggttgtttctttttctaaatcggtgatactgtatcggagaatgcgcgtgaggtcacaaaggctgcgatagagcttctatggagaatttctttttggagagattttttaaaggaatgagacatccgctacctccttggaaggtttttg

SEQ ID NO: 128 - DNA, 13440 bp; double-stranded, linear
cgggctgttgtgacgattcttatttctatctgtgttatctttttgggaactattttgggtgttgtcttggcttttgggcaacgttcaaagtttaaaccgcttgtttggttggccaacttgtacgtttggattttccgtgggacaccgatgatggttcaaattatgattgcctttgctcttatgcatatcaatgctccgactattcagattggaattttaggtgttgatttttcgcgtctgattccagggattttgattatctctatgaatagtggtgcttatgtttcggagactgttcgtgccggaatcaatgcggttccaaaaggtcagctagaagcggcttattcgctagggattcgtcctaaaaatgcgatgcgttatgtgattttgccacaagcagtcaaaaatatcttgccagcattggggaacgaatttatcaccattatcaaggacagctccctcttatcagctattggggtcatggagttgtggaatggggctacaacagtttctacaacaacctatctacctttaacaccacttttatttgcagcattttactacttgattatgacctctattctgacagtagccttgaaagcttttgaaaaacatatgggacaaggagataagaaataatgacagaaaccttgataaaaattgaaaatttacataaatcctttggaaagaatgaagtattgaagggcatcaacctcgagattaaaagaggagaagttgtcgttatcatcggtccttcagggagcgggaaatctaccttgcttcgctctatgaatttgttggaagaagcaaccaaggggaaggttatctttgagggagtcgatattacggacaagaagaatgacctgtttgccatgcgtgagaagatgggcatggtttttcaacaattcaatctctttcctaatatgactgtgatggaaaatatcaccttgtcccctatcaagaccaaaggtgacagtaaggccgttgcagagaaaagagctcaggaacttttggaaaaagttggtttgccagataaggcagacgcttatccacagagtttgtcaggtggccagcaacagcggattgccatcgcgcgtgggttggctatggaaccagatgttttgctctttgacgagccaacttcagccctagatcctgagatggttggagaagttctggctgttatgcaagatctagccaagtcaggaatgaccatggttatcgtaacacatgagatgggatttgcccgtgaggtggcagatcgtgtcatctttatggcagacggtgtggttgttgaagacggaacacctgagcagatttttgaacaaacccaaggacaaaggactaaagacttcttgagtaaggttttataagttagctttgtttagctatttgtagccagctttaaacgttaaagagaagattagtgaaaagctcaaccagagctttttcttatagtttaaagctataggattgcctaggaaagaagtgttagagctacattgtattttttggtataattaaagatatttgtaagaaaagagaagtgatatgacacagattattgatgggaaagctttagcggccaaattgcaggggcagttggctgaaaagactgcaaaattaaaggaagaaacaggtctagtgcctggtttggtagtgattttggttggggacaatccagccagccaagtctacgttcgcaacaaggagaggtcagcccttgcggctggtttccgtagcgaagtagtacgggttccagagaccattactcaagaggaattgttagacctgattgctaaatacaatcaggatccagcttggcatgggattttggttcagttgccattaccaaaacacattgatgaagaggcggttctattggctattgacccagaaaaggatgtggatggtttccatcctctaaacatggggcgtctttggtctggtcatccagtcatgattccttcgacaccggcaggaattatggaaatgttccatgaatatgggattgacttggaaggtaaaaatgcagtcgtcatcggtcgatccaatattgtcggaaaacctatggcccagcttcttttggcaaagaatgcaacagtaaccttgactcactcacgtactcataatctttccaaggtggctgcaaaagcagatattctggttgttgcaatcggtcgtgccaagtttgtgactgctgactttgtcaaaccaggtgcggtagtcattgacgttgggatgaaccgcgatgaaaatggtaagctctgtggggatgttgattatgaggcggttgccccacttgctagccacattacgccagtccctggaggtgtcggtcctatgaccattactatgctgatggagcaaacctatcaggcagcacttaggacattggatagaaaataagataaaaattttctgaggaaagtgtattttctatagctatatctaaaatgatagaaatgaatattaaattttagaaataagtttataaaaggaggtttgcgcctcctttttgttgtataatggagtgaggtgattagatgattttaaaaatttataatggggaatatagtttacaatgggatggaatatactacttagcactaattgattatccaaatattcaagagtgggaattagaaaaaattgctaaatttatagcttacgaaaaacttcataaacgtcaaacaagtattgagtgtgctgattcttgtttaaaaaaagaaattttagattacatctgtcagcatccctttctgccaccatttactcctacagataaaagagtagcctcgacttatgacctacataagaggttagtgacttcagactactgtagtcatactacgactatagatgcagcgatttctatttttaaaactggtcgtcttttatctgctgtgaaagcctttgggcgagatgctgaggagttggttttggatagtcgaaatgctgcatctgatccgatagattattttgactatgtcatgttagggtggtcaaatacaagttctggttatcgattggcgatggagcgtttattaggtcgagctccttcagagaaagaattacaagacaagtttattcctggagtaagttttcattttatctatacagatttgattaaagttcctggttatatttttgatggttaccatgctgtaaaaattaaggacatgcttaatttattaagtgagttgtatatttgcattattccaactcataataagagccaatttgaaaatattattccaaccaaaatacaagatagggtgtattatcttgactatgctggagaagacttagaagagtggactaagaaagtctatcaagttgttttaaaacaatcagataaaggatagttgaggaaaaaacgatgaaagtgattgatcaaaccttactagaaaaagtcattattgaacgttcttgtacaagtcataaaggagactacggtcgtctgctgttgcttggtgggacttatccttatggtggtgccatcatcatggctgctttagcagctgtaaaaagcggtgcaggattggtaaccgttggaacggacagggaaaatatccctgctctacacagccatttgcctgaggctatggccttttctctgcaagatcagtaattgttacaagagcaattggagaaggcagaagttgtcttgctggggcctggtttacgagacgatacgtttggagaaaatcttgtaaaacaggtctttgctagcttaaaaaagaatcagattttgattgtagatggaggggccttaaccatccttgctaggacaagtttgttgtttccatctaaccagcttatcttaactccccaccaaaaagaatgggaaaaactgtctggtattgctattgaaaagcaaaacgaaggtacaacatctagtgccctgacttctttccctcaaggaacaattttggtagagaaaggtccagctactcgtatttggcaagttggccagtctgattattaccagttaaaggttggcggtccctatcaggcgactggtggtatgggtgatacactggctggaatgattgcaggatttgcaggccaatttcgacaggccagtctctacgaacgtgtggcagtagcaacccatcttcattcagccatagcccaagaactatctcaagaaaattatgtggtcttgccgacggaaattagtaattgtcttcctaaagtaatgaaaagatatgtctaaaatagttagacaaaaaatgttgataatttgtatcattattcttaattcacaaaaaacgaacgtttagtattcttcttgctaagaaactaaatttgttcgtttttttactcttgtaaatctatttttgttagagttgatttggtttacatccgtacttaaattgatttgttagagctctacttttattaaaaaaattcaatttcaaggataaataagcagtattctaaaggtacttttagatgaaataaaagcctttacatggtataatagaggtagctctttaatggaggtgtttgagtggaaaatctgaagaaaatggcaggtatcacggctgctgaatttatcaaggatgggatggttgtagggctaggaacaggttctactgcctattattttgtcgaagaaatcggtcgtcgaatcaaggaagaaggcttgcagattacagctgtgacgacttctagtgtgaccagtaaacaggctgaagggctcaatatcccgctcaagtctattgaccaagtagactttgtcgatgtgacagtcgacggggcggatgaagtggatagtcagtttaatggaatcaaaggcggtggtggtgcccttctcatggaaaaggtggtcgcaacaccatcaaaagaatacatttgggtggtggatgaaagcaagctggtcgaaaaactaggtgcttttaaattgccagtagaagtggttcagtatggtgcagagcaggtctttcgtcattttgaacgagctggctacaaaccaagtttccgtgaaaaagacggccaacgttttgtgaccgatatgcagaattttatcattgacctcgccttggatgtcattgaaaatccaattgcttttggacaagaattggaccatgtcgttggtgttgtggagcatggtttattcaaccaaatggtggataaggtaatcgttgctggacgagatggagttcagatttcaacttcaaaaaaaggaaaatagaagggggcataagatgtctaaatttaatcgtattcatttggtggtactggattctgtaggaatcggtgcagcaccagatgctaataactttgtcaatgcaggggttccagatggagcttctgacacactgggacacatttcaaaaacagttggtttgaatgtcccaaacatggctaaaataggtcttggaaatattcctcgtgaaactcctcttaagactgtagcagctgaaagcaatccaactggatatgcaacaaaattagaggaagtatctcttggtaaggatactatgactggacactgggaaatcatgggactcaacattactgagcctttcgatactttctggaacggattcccagaagaaatcctgacaaaaatcgaagaattctcaggacgcaaggttattcgtgaagccaacaaaccttattcaggaacggctgttatctatgattttggaccacgtcagatggaaactggagagttgattatctatacttcagctgaccctgttttgcagattgctgcccacgaagacattattcctttggatgaattgtaccgtatctgtgaatacgctcgttcgattacccttgagcgtcctgcccttcttggtcgcatcattgctcgcccttatgtaggtgaaccaggtaacttcactcgtacggcaaaccgtcgtgacttggctgtatctccatttttcccaactgttttggataaattgaatgaggctggtatcgatacttatgctgtgggtaaaatcaacgatatctttaacggtgctggtatcaaccatgacatgggtcacaacaagtcaaatagtcatggaattgatacactattgaagactatgggacttgctgagtttgaaaaaggattctcattcacaaacctagttgactttgatgccctttacggccatcgtcgtaatgctcacggttaccgtgattgcttgcatgagtttgatgaacgcttacctgaaattatcgcagctatgagagagaatgaccttctcttgattactgcggaccatggaaatgacccaacgtatgcaggaacggatcacactcgggaatatattccattgttggcctatagccctgcctttaaaggaaatggtctcattccagtaggacattttgcagatatttcagcgactgttgccgataactttggtgtggaaactgctatgattggggaaagtttcttagataaattggtataagatgacgcgctatgctttgctggtgagaggtatcaatgttggtggtaagaataaggtcgtcatggcggagcttcgtcaagaattgacaaacttgggactggaaaaggttgagagctacatcaatagtggcaatattttctttacttcgatagattccaaagcccaattggttgaaaagctagagactttctttgcagtccattatccatttattcagagcttttctttactgagtctagaggactttgaggcggaacttgaaaatctaccagcttggtggagcagagacttggcacgaaaagattttctcttttacactgagggtttggatgtggaccaagtcatcgcgacagttgaaagtttagagctgaaagatgaagtgctttattttggaaaacttgggattttctgggggaaattttctgaagaatcctattctaagactgcctatcataagtacttgctgaaggtgcctttctaccgccacattactattcgtaatgctaaaacctttgacaaaattggtcaaatgctaaaaaaataataaaggagacacacaatgacatttttaaacaaaatccatgaaactgctactttcctgaaagaaaagggaattgcagcccctgagttcggtctaatccttggatcaggacttggagaattggcagaagaaatcgaaaatccagttgtagtagactatgctgagattccaaactggggccgttcaacagtagtcggtcatgctggtaaattggtatatggtgaactggcaggtcgcaaggtcttggctcttcaagggcgtttccatttctatgaagggaatcctctggaagtggtgactttcccagttcgtgtgatgaaagttcttggatgtgaaggtgttattgtaaccaatgcagctggcggtatcggatttggtcctggtaccttgatggctatctcagaccatatcaacatgacggggcaaaatccattgatgggtgaaaacttggatgactttggcccacgtttcccagatatgtctagggcctacacaccagaataccgtgccactgcccatgaagtggctaaaaaacttaatatcaagcttgatgaaggtgtctatatcggagttactggtccgacttatgaaacaccagcagaaattcgttcctataagacactgggagcagatgcagttggtatgtctacggttcctgaagttatcgtggcagcccactctggcttgaaagttctgggaatttcatgtatcactaactttgcggccggtttccaagaagaactcaatcacgaagaagttgtagaagtgactgaacgtgttaaaggtgatttcaaaggcttgcttaaagcgattcttgctgaattgtaagaaaaaagatttaaaagggggagtgcctctgttttttcaggattgactgcctatccggattaaagaagaaacagaggaatactatgagcttcttcctgctcttataactgaaagaagcggaagaataggtatgtctgatctgatagccagcattgtgaaagacaagattctaggatactagcattagcttcctagccaagcagactagtatgataaggagagatgagaatgaattgactttctgaatttctcagtcttatcatatatagcacaatgagatttcgcttgagtctgcttgtaaataaacgaaaagaaagataagaaataatgaaaattggtcaacgaattatgcgctttggcataaaaaattaagtatcggagttgtatctgttgtagtcggctttgatttctagctccagctggaatttcagccaatgaagtaaagcaagatgtaacatctgaagtggtaataggtgtgctagattctaaggaggaattgaaagagtcagaaaatgatgctccaaaactagaaactcctcttagagaggagccaagactagctcctcaaacgcttccggaagcaagtgaagttcttgaaaacaaaagggaagagtcaaaagtagagataacataaccagctcaagcggatgatatccgcaaggttgttggggaattagccaaggatataagtattactaagttgtatatgacaggtcattctcttggatgttacctagctcagattgcagcggttgaagcttaccaaaaatatcctgatttttataaccatgtattgaggaaagtgacaactttcagtgctcctaaagtgattacttccagaactgtttggaatgctaagaatggtttctgggatgttggtttggaaagtcgtaaattagctgttagtggaaaaattaagcattatgtggttgataatgacaatgttgtgactcccttgattcataataatcgtgatattgttacatttacaggtaattcacgctttaaacaccgttctcgtggctattttgaaagtccaatgaatgatattcctaactttaatattggtaaacaagctaccttggataaacatggttatcgtgatccgaaattggataaagtgcgattctttaagaaacaggctctgcctcgatcttctagtcaaccaagcgctgaaccaatggaaaatattgcctcaggaaaacaggttactcaaagttcgacagctttcggaggagatgctagaagagctgtggatggcaaagtcgatggtaactatggtcacaattctgtcactcatacaaacttccaatctaagccttggtggcaagtagatttggctaaagaagaaaccattcgccaaatcaatatttacaaccgaacagacactgcccaggatagattggcaaactttgatgtcattcttttagacagttctggtaaagaaattgagtgaaaacgtataacatctcctaaagatgtgtcagcacaaattacgattaaccataaaaaagcgcgctatgttcggattgagctagaaggctataatgccctcagtcttgcagaagttgaagttttctgctttatagctacgaatgctgaaacggcgacacaagtttctaagccagttcaaccaatcagtcagactcctgtgaaggataaaacattgacaattcaacacagtggagcttacattgcccgctactccataacttgggaagaagttccagtagataaagatggaaaccaagttgttcgtagtcattcttgggaaggaagcggtcgcaaccagactgcaggttttgtcctcaacctcccaatcaaagaaaatatgagaaatctgcgagttaagattgagaaaaagacgggcctactatggaatagatggcaaacaatctatgaaaacagaccaattttagctcaaccccaccgtaaaattacccattggggtacgacattgaattccaaggtgagtgacgatgatgtcttgtaatctgatggtagaatgacagttagtttgtctagtttataagaaagtactacctgagcttgaataggactcaggtagctctctatgaaagaacaaaattaatactcaatgaaaatcaaagagcaaactaagaaactagccgcaggttgctcaaagcactgctttgaggttgtagataagactgacgaagtcagtcacatatataatccaaggcgacgttgacgtggtttgaagagattttcgaagagtataaacagaaaggtagagcgcgtgttctaatttgaacacgagtagaaaacttttctaaaaacaaaaacgaaaggatgggtaaactgtattcgctgaactgaatacgggcgactctcctctaaatcaaaattaagaaaggaattgaccccaccctaaaagtagtgggaaaaagatagttgatctagcgagcatcgctcactgcgcccaactcctattttcccttcgctttttgatgggtttggtatctttctcaatataaaatataaaataaagaaaggtagagcgtgtgttttgatttgaacacgagcggaaaactcggaaaatagataatctgactgaaaaatcaggatttctcgtcaggttcctaattttcagtcgttttcttctcgctctttgtatcataaattatgtctatccatattgctgctcagcagggtgaaattgctgataaaattcttcttcctggggatcctcttcgtgctaagtttattgcggagaatttccttgatgatgctgtttgttttaacgaagtgcgtaacatgtttggttacactggtacttacaagggtcactgtgtatctgtcatgggaactgggatgggaatgccatctatttcgatttatgcgcgtgagttaatcgtagactacggtgtgaagaaattgattcgtgtgggaactgcaggttctttgaatgaagaggttcatgttcgtgaattagttttggcgcaggcggctgcaaccaactcaaacatcgttcgtaatgactggccacagtacgattttccacaaattgctagctttgatttgcttgataaagcctaccatatcgccaaaaaacttggtatgactactcacgttgggaacgttttgtcatctgatgtcttttactcaaattactttgaaaagaatatcgagcttggtaaatggggagtcaaggctgtggaaatggaagcagcagctctttactatcttgctgcccaataccatgttgatgcgctagctatcatgaccatctctgatagcttggtcaatccagacgaagacacaactgcagaagaacgtcaaaataccttcactgatatgatgaaggttggtttggaaaccttgattgcagaataattatagccaaaaaggggctctttgtcaactgtagtgggttgaaaaaaagctaagcttgagaaaggacaaatttcgtcctttcttttttgatattcagggcgataaaaatccgttttttgaagttttcaaagttccgaaaaccaaaggcattgcgcttgataagtttgatgagattattggtcgcttccagtttggcattagaatagtgtagttgaagggcgttgacgattttctctttgttctttagaaaggttttaaagacagtctgaaaaagaggatgaacctgcttcagattgtcctcaatgagtccgaaaaatttctcagggtctttgttctgaaagtgaaaaagtaagagttgatagatctgatagtggtgtttcaagtcttctgaatagcttaaaatcttgtcaagaatttctttatttgttaagtgcatgcgaaaagtagggcgataaaaacgtttatcgctsartttacgactatcctgttggatgagtttccagtaacgcttgatagccttgtattcatgagattttcgttcaaactgattcataatttgaacacgaaaacgactcatggcacggctgagatgttggataatatggaaacgatctagaacgattttagcacacggaaaaagctgtttagccaagtcatagtaaggactaaacatatccatcgtaatgattttcacttgacaacgaacggctctatcgtagcgaagaaagtgatttcggatgacagcttgtgttctgccttcaagaacagtgataatattaagattatcaaaatcttgcgcaatgaaactcatctttcccttagtgaaggcatactcatcccaagacataatctttggaagccgagaaaaatcatgctcaaagtgaaagtcattgagcttgcgaatgacagttgaagttgaaatggccagctgatgggcaatatcagtcatagaaattttttcaattaacttttgagcaattttttggttgatgatacgagggatttggtgatttttctttaccaggggagtctcagcaaccatcatttttgaasagtgatagcacttgaaacggcgttttctaaggagaattctagaaggcataccagttgtttcgaggtaagggatcttagacggtttttgaaagtcatrtttcttcattagacttccacaatcagggcaagatggagcctcataatccagcttagcgataatttctttgtgggtatccatattgatgatatctagaatcttgatgtttgggtctttaatatcgagcagttttgtgataaaatgtaattgttccatatgattctttctaatgagttgttttgtcgcttttcattataggtcatatgggactttttttctacacaaaaataggctccataatatctatagtggatttacccactacaaatattatagagcccaaaaaggaagccctttatgaattgtaggacttccttttcttatccagaaattgatctagctctctctgatttcgaagaatagtgactttatgtgaatattcttggcaaagtttttggtaattttctttttgagttttgcggacgcccatcccaaagaatccatctgataaactcccactcaaagcgttcagggcaatctaccgccatactttctctgacttttccacggtatttaagataacgcttaaaggctctaaagagacaggtcaatggcgaaaaattgagaaagatgatttggtcagcttcttgcattcgttcttggtagtagcaccaagaataattaccatcgatgacccaagctttatgcttggtgagaaagttttttatctcggttaacatccattcgcagtcactgtcttgccaaccaggttgaaattggagtgtgtccatgtgcagttttggaatggagtagtagttagataacttttctgctatagttgacttaccagaaccagaatatccgataattgcgattttcattttctaccttttcctatttggagacaaaaaaacagcctctatggactgtttcttatttaacaagtttagctgaaagacgagctttatcgcggcttgctttgtttttgtgaatcaaacctttagtttctgctttatcgatagctgagctagcagcacggaaaagttcttcagatgggtttgcttcgaaagcttttatagcagtacgcatagctgatttttgagctgagttcttttcgattcgtctaacgttcaattcagcgcgtttgatagctgatttaatgtttgccaatggtcttacctccatatttactaact

SEQ ID NO: 129 - DNA, 8512 bp; double-stranded, linear
ccttttttcaaaaactagatactagtctatcaaaagtaggaaagggtttcaagaaaattgattggaaattttttgaaaatcatagaactattagctaatccctagtattgaaaagactggatagcttctttcaggtcatcttgtaaactatttctctggtcaagttggacatagacttccaccagacaggatctaaagttggaaaatttgtaaaaatcctccctttcttctatcggaaaatcaacagtttttatccaagaagctacttgttcttgctccaacttcccttgtaaaataggttcatagatcactcttgctaaacgccaatcctcatcatctgtaaagcgaatcgacattcttttaaatagttggccaagtatatcaaatacttcatgaactctgtttttaggaaagtctggatgacaaaccacctctgtcagtaaatcggctccatgtgcaaaagcgtgaacccaaccatactgacttgagaaaccccttgtatccttttcttttgaaagatagtgcaagccttgatttaaaaggacattacgaatttctggagaaggatttcccaaatgatcaaacaaccactggatttcttcctggttataatttggtttttcttctgctatttttcttagtaaatcttgatacatggtcaatacctctacatttctagcaactgttcaaaaaggcagtcttaaatgactcaatattgaattctcaattaaatacaatctgatataaaatgacgtaaataactatcaataccagttctacagtaagttcaaatttaacatcacgaccttcaacgacatttttgaaaatagctacaactaagacaaatagaatgacgcttaacaagcccataaacatcattctaaaaaatttttctattcccctactctcccaactcagcactataggagataatctggtcaactgtgtcagacaagaattggatggtatcacggagtggtttgtctgttgaaatatcagcaccgataatcatggctgactcaagtggtgtcttgctaccacctgatttgaggagattgagccagtcttcagctccagtttcagaatgttttagatgaaggtaaccagcagtcgagataactagtcctgctgagtaagtgtaactatacaagcccatatagtagtgagcttggcgcatccaagtcagagttgcatcatcgtcaatttcaatagcatctccccagaaatccgtcaaaacttccttcataatgctgttgagcttgcttgctccaaaggtctccccttcttcaatcaatgtatacaccttacgctggaaggcggcttccaagaggtgggtgataaagttatggaagtaggtgtctgtcaagcgatgagccagagcgaagcgtttttgacgtgggtcattagactggttctccaagtaatcactgagtagcaattcattgaaggttgacggtgcttcaacatagtaggtcgacatatgggcattgaagtaactttgatgattgtctgaaaagatgaattgaccagaatgcccgatttcatgaatcaaggtatagacatcgctcaaacggcctgtccagctcatgagtacataagggtgtacgcgatatgggtccgccgcataaccaccggaatccttgccactgttagcagcaaagtccacccagcgctcttcttggtaacgagcaacttcctgacaatattcttgccccaaaggttctaccgacttcatgaccaaatcataggcatcgtcaatagtcacttcaggattcagggcgctgtccaagtccaatttccagtctgcaaaggtcatcttttcaagaccatttaccttggcaacatgcttgaggtatctctgagcgactggtgcaaagtccttcatgatgaggtcaatctggcggtcaaacatgacacggtccacttcttgttcagctagaagatagtcaaagacagagtcgtatcccttcatatcagccaagagtttttcagacttgacctgagccagataggctgctgcagccgtattttggtgcttacgaagtccctctgagaaggaacggaaggatttctcacgaacctcagcatcctcatggttttggtagaaattctcataggtcacaaagctgtttttgtaggtcttgccatgggcttcaaagtcagccatttcaaaatccccagctcgcatcttagtataaatgtcctgcggactgtagaaaacttcaccgagatttgtcaaggccttctccacatctgcccctaagtagtgggcttttttgattttagcctgacgaatggcagctgttaaatgtggcaatttacccaaacggtccaagacttcctcatctgctgccaccaaggcatcgtcaaagaaggtcaaggctacgctggcatctgtttcaaattccatcccagcttgggcaatattggcaaattcgtcattgctatagtccgtcgtctgaggcataaaaccatagttgccaatatggctcatctgaatgtagatctgttccaattccgcaaaggccttctcgaaatcctcaaaagtgtgaagattgcccttgtaatcacggctaaactggttgatgtcttcgcgagctttctcgattgcacgcaagaaatcctcacggtcttggtatagggctgttaagtcccagagttccttctctggaaattctgaacggtgtttttgttccattttcttcctcttatttctctaattctactaaaacactaagggctgataaagcgtaaagcggtgctgtttctgctcgcaaaatacgaggacctaggcctgccaaaacggctcctttagcttcaaaactttcgatttctgcaggtgagagaccgccttctggaccaaagataaagagcagtttggctcctgtttcaagaccagtgactgcttgcagaagcgcagcggcttctccttctttagctgattcttcataggctactatgatagagtcaaactggtccagctgagctagaaaatctgcttttttctcgaaaagtttaatacttggtacaatattacgcttgctttgctcggctgctccaagggcaattttttctagtttttcaacttttttacccaatttcttgccatcccacttggcaactgaccagtctgcaggaaaggcccagatttggctagcccccagttcggttactttttgagcgatgaactccagcttgtctcccttgggaaatccagatgcgatggtcacttggactggtagttccacattgtcatttaattcttggaccaactcaaactgacgattttccatatccagcacgcgcgccaagcgcttgatgccatcatcaaagactaaggtaacctcatcctcttctttcaagcgcataacctgaaacatatgcttactggtttccttgtcctcgatagtgacaggagagatagcactgccttttacaaaatactgctgcatgctagcctccaatcacaccagagatatccttggttttcttaaagacacaggtattccattccccttgaaccatgtgagtttcgaggaaaaatccagctgactcagccgactggcgcaccatgtccaacttgtccttgataatgccactcatgatcaggtagccttcatcctttaccaagcgataagcatcgtctattagatgaatgaggatatccgccaagatattagccacaatcacatctgcctcaatttccacacccttaagcaaatctccagccgctacatggatattttccatgccagggttgagctcaatattttcctgagccacacgaaccgccacatcatccaggtcataggcgaaaatttctttagcccccagaagcgagctggcaatagagagaacccctgaaccagtccccacatctagcaccgtttcgccaccacgaagaacctgttccaaggcaaaaaggctcatcttggtagttgggtgggttccagtaccaaaagccatgccaggatccagcttgataatcatttcccccgcagtcgcctcatagtctgtccaagagggaacgatggtcaaatcatgagtgatacgagcaggttcatagtatttcttccagttgtctgcccagtcttcctcagccaaggcagtcgtacctatttttaactctcccaaatccataaaatctgtcaattctgctagacgagcctgcaaatccgcctcaaccactgtcacatccaccgtgtcagggtagtaggctgtcactacgatttcttcttgctgctccacctctgggaaaatctctccaaagcggtccacatttcccacatagtccatactgtcttcgattgcgactccttgcgctcccagctcaatcaagagattggaaaccaactcctctccctcacgcttcactgtaacttttaactcttgccatgtttccattattaataccaagcccgtaaaacacaaaaccaaaataggaaattctctgaagacgcttgtgtctaagagaagtttatctttttggcacagtgtttagggcgggttcagtttagaaatgtaactgaaccatcctttctaatcacttacttttaaataatcttttaatctctcttgcaactgaggcacaacttgactggaactaagaaattcctcaacattcatcagctgatagccctgtccttcatctccgaagatgatattgtcaaattgttcttgtcttagctgaccaaccataaagaccgatttcttgcctttaaaaattacgctaggataaatcttgctccaaagcagacagtcttcatctaaatgaattcccagttcctcataaacttcacgccgagcgcattcaaaagggctttcgtccccttcacggccaccacctggcagttcccacatattggcccagggaatacttgccttatcatcgcgtaagatagtcaaaagcttatccccacaaaacaaagcaatcttgcaacctgtgaaatcagaaatttctagttccatcttcagttccttctaacatttccttttccagctcggctaaccagttttcataatatcttttctcatccctcaacattcgactactatccattttctgtctagcaatcttgagagccttacgagttcgatctacatctttcttcacctttaattgataccaggcttgtatcacttgaagattggacagtttgagagacagaaacgatttgacctgtcgaatactagcatattgctccgcttgctcaaaatctccttccaacaaggcgatatgaagcagggatagttgggcaactgtctgcatcatcggagtagttgtcctctcaagtaatgcttgaaactgctgtttagctacttcttccttcccttccaaaatggaaacttcaccttgcatacctaatacaccatccgcaaaactccctcgtgcatcctcaggaactgcttgaacaaagtctttcaaatcatattcttgaggagctagcaaggtctgggcagaatgtctcaataccaggtaggcgtatttggtattttcagggtgttgtagtaattcccaaatttttgctccatcggtgatgtcgactggcaaaatgttatttaggaagaaagataaattaagaaaaatccaagtccctgcaaaataccagcttcttgtcaaaaatccaaacaatatcgccaataatatcaagccgagatgaaccatcaagcctcctgaaagcatcaggatgattctttgatcgctttcatcctcttttaaaccaatgtattgagcaccaacatttttcagaatggctgttctactaagatgaaacctgcctgactttttggtcaaaataaaatgtcctaatccaaaagccaccagccgatagcctgtcaagtagccacaaaaagcatgacccagctcatgaagaataaagattaaatacatgcttagaagagcgaaggcataaccaaaagtaaaggctaaaactgcggaataccccaactctgcaaatgcgattgttccacaagcaaaagctagcataataaagacaacagctagcacataaaccaaataagtcccaattttcttcataacacctccaaccaactcctagtatcttggataaggataaaattctcccttttccaagccaatttttccttcttcaaagacttcttggttccattccatgacaaattcctctgcttctgggtcttccaaaaagtccatgaggacatctagcccaacctcagcagtatctttaaggaaaagcgcaaaataagctaaaaattcacgggaaaatccttttttaggcaggtaaggaataacagtcaaatagtcttcctcattgactgttgacttggcaggattgtagaaaaggaccgcttcctcaaaaagaatgtcatctgatgaaacctctccgtcttcatccaccatctccacaccgcagcattttgcgcttccaatagaaaactcacttctaccgcatggttgcgtttgtcccagctaatctcaaagtcaaagggaaagttcttgtccaactcttcctctaaaatatctaaaaatccgtatgttgccattttgtcctctttctatgcgactctttaatcgccccgattgctcggaaatatgctaaaatagatactaccatcttaccacaaaattattttatgtcctaattataccatattacctcatttaaacccttggtatcagtgattttcttaaaagtctgatttcttcatttctcataaaaatcaatataaaaagccctcgaaagggctaataaatctataaaatcaataggcgagtaactagcacaagtggacgtgcttttttattgactattaccacgataccacgcttaatcttaggcttgaactttcttatctgcaatagcgtctgtcaaagtctgagaaaagttaagccccatttctcgtcccaacttatctgcccattttggtatggtcaaagtctttttaatgggttcctgacttcctaggtattctgatacatcaacagataccatagaaataaaagatttatcaaggtcataggttgacacgaaatcttcatcatctttaaaaggatcattatcaattaaagacaagctattgatatctgatggctgaggtaactctccatcactctctatcaaatctgcaacagttatccctagccactccgaccccatagccaaagcctcagaaatcccctctccttgtgtagctgagtattcaaaatctgggaaatggacaaaataagtcgcttctgttccgtctgtgtcgtcataataaaataaagctggatacgtaactaacatttcactacctccatatcaaaaagcagggactgaattttacaacccagcttgctttcttatccctctttcagtgtacttattcagctcaccatgaaggattgtgataggtctttccccttgcttttccattttaatatgggagcctttaccgcctctagtctttatccaaccatgggccgtaaggagtttaaccatctctttttgtgtcataggcatagcgcttttacctcctgacaacaccattataacacgtgttacacgtattgtaaaggagtgatacttattattctattatacataaaagcccctagatgtggttctaagggaagccaatttattcatacctatttttctaatgagtagtaaaaactgcttctttatcgagcaattcatcatctgtatagtcaattgtaaaagtatctcgatctaagacagattgaggcggagttgaatgaatcataggaacactgcgtactctatattttttatctccaatttttacaaactgatactcttcgaaaatcaaattcaaaccacgtcaacgtcgccttaccgtactcaagtacagcctgcggctagtttcctagtttgctctttgattttcattgagtatgattaactctcaagtcttcgaaatcaggattttcaacagttattacaaggaggcgatttactacttcaaaaacatcaattattctatttttcatattttttcaacccattattagaatgaacttcttggtaagcaaaatcaagtttagatttaatgttttcgtacaaatctaaaatctcttttggagtatcttcccggaagaaaagttttcttttccctgaaataacttgatcactaagaatccaatgacgaatttgttttgtaaaaatcaaaatttcctgacttggtagttccatcatttccattgcttatcacctctcttttcattatagttcatacaatgacattcagcaatattatttctcaagtcagcacttccacttctttaggctcaactatcctattttgagctttaaggaaaatcaaatctctcatgctgatacctctcctcattaaattaaatagtaaaaaagattctatctcactccctgattattacaaaaccattgaaatatcacaactaataggctagaatggacatagtaagatatagtagatgagtcattctactcaaatccacgttagaaaggactgctatgccagacaatctcgccgttcgcatgcgcccngg

SEQ ID NO: 130 - DNA, 2869 bp; double-stranded, linear
ctcgtttcaaggttgagtctcttgcaaatcttgttcgcgttcttccttttgccaaggcatctctcccatggttggtgccagccattgttggaatcttgctctcattggttctaccaaacaagcaagaaagcgatgtttttgaaatggaataatcacttaaatcacttttgtagccaagtctacaggagtgattktctttttttatccgatgataaatgtgttataataggtagcgaaagaggtgaagaaatgaatcaaacagtagaatatatcaaagaactgacagccattgcgtcgccaacaggctttactcgtgagattgcggactatttagtcaagactctagaaggttttggttaccagccggttcgcacatccaagggcggtgtcaatgtaactattaaaggtcaaaatgatgagcaacatcgctatgtgactgcccatgtagatacgcttggtgctattgtccgtgctgtcaaaccagacggccgtctcaaaatggaccgtatcggtggctttccttggaacatgattgaaggagaaaactgtaccattcatgtggctagcacaggtgaaaaagtatcaggaaccatcctcatccaccaaacttcttgccatgtctataaggatgcaggaactgcagaacgcacgcaagacaatatggaagtgcgtttggacgccaaagtaactagtgaaaaagaaactcgtgctcttggcattgaggtcggtgattttatcagttttgacccacgaactgtcgtgacagagacaggttttatcaagtctcgccatttggatgacaaggtcagtgcggcgattttgctcaatctccttcgcatttataaggaagagaagattgaattgcccgtaacaactcattttgctttttcagtctttgaagaagtgggacacggtgcaaactctaacattcctgctcaggtagtagaatatctggctgtggatatgggagccatgggagatgaccagcaaacagacgaatatacagtgtctatctgtgtcaaggatgcttctggaccttatcactatgacttccgtcaacatttggtggctttggcgaaagagcaagatattccatttaagctggatatctatccattttatggttcggacgcttcagcggctatgtctgcaggggcagaagtcaaacacgcccttctcggtgctggtatagagtctagccattcctatgagcgtacccatattgactcggtgatcgcaacagaacgaatggtcgatgcttatcttaagagcacgttggtggactaatatgtgccttatttgtcagagaattgacctcatcaagaaggaagaaaatccttactttgtcaaagagttggaaacaggctatcttgtggttggagaccaccagtattttgaaggctatagtctctttctagccaaggagcatgtcagcgaattgcaccatttgaaaaaggagacaagactccgttttctagaagaaatgagtttagtccaagaggcagttgccaaggcctttgctgctgagaaaatgaatatcgaactgctaggaaatggcgatgctcatcttcattggcatctgtttccacgacggacaggtgatatgaatggtcatggtctcaagggtcgtggaccagtctggtgggttccctttgaagaaatgacagcagaaacctgccaagcaaaaccggatgagattaaaagattagtcaaacgtttatcgtcagaagtagataaactattagaaataaaggagtagaaatgaagaaaagatacctagtcttgacagctttgctagccttgagtctagcagcttgttcacaagaaaaaacaaaaaatgaagatggagaaactaagacagaacagacagccaaagctgatggaacagtcggtagtaagtctcaaggagctgcccagaagaaagcagaagtggtcaataaaggtgattactacagcattcaagggaaatacgatgaaatcatcgtagccaacaaacactatccattgtctaaagactataatccaggggaaaatccaacagccaaggcagagttggtcaaactcatcaaagcgatgcaagaggcaggtttccctattagtgatcattacagtggttttagaagttatgaaactcagaccaagctctatcaagattatgtcaaccaagatggaaaggcagcagctgaccgttactctgcccgtcctggctatagcgaacaccagacaggcttggcctttgatgtgattgggactgatggtgatttggtgacagaagaaaaagcagcccaatggctcttggatcatgcagctgattatggctttgttgtccgttatctcaaaggcaaggaaaaggaaacaggctatatggctgaagaatggcacctgcgttatgtaggaaaagaagctaaagaaattgctgcaagtggtctcagtttggaagaatactatggctttgaaggcggagactacgtcgattaatactcttcgaaaatctcttcaaaccacgtcagcgtcgccttacctactgactgcgtcggttctattcacaacctcaaaacagtgttttgagtcgattcgtcagttttatctgcaacctcaaagctgtactttgagcastgcggctagcttcctagtttgctctttgattttcattgagtacaaaaagtaaacttttctcttgcaattccagataaatagtgtataatggatgggtatgtgaaaaacatacttgtgggaggtaaaaatctctaattaccgccaaaaccacaaaggaggatttaaaaatggctaaaaaagtcgaaaaacttgtaaaattgcaaatccctgctggtaaagctacaccagctccaccggttggacctgctcttgg

SEQ ID NO: 131 - DNA, 6186 bp; double-stranded, linear
ctgaatcccttataggagtccagtaactttttagcctctactttgccttcataggcagcttcaacatcattaaaaaaagaargcactgaagcaagttcttcagtgctccacgacaaatctagtgggtaactatactgtttgttcattaactaataccagctctcattcttgcttcttttagttcttgcttacgataactacgagggagaaaagcacgaatctcatcttcattaaaaccgatttgcatacgcttggcatcaataataattggacgacgcaaaagactaggatactgctcaatcaaatgaagcaattccgataccgaaatactctctacatcaatattcaatttttgaaaaatttttgaacgagttgaaatgatgtcatcagtaccattttcggtcaaggaaaggatgtgttgcaattcttttcttgttaaaggactggtcataatattgtgttccacaaagggaacttatgtttttctaaccaggccttagccttacgacatgatgtacagctcggtgatagaaatagtgtaatcatgcttttctcttcttatctatactttgctacttctattatacaaaaaaataaagcgcttgactagggatttttagaaaaaaagcctattttttcaagaaaaataggctttttgcgaacgattgacacaattggatttggttaattcactcttaacgatggttttaaacgatatatatttttatatatgtaaattaaaaacatctttcctttcacttcctacgacttttcagatacagatagccaaagaagttttcatagagggcaaaaaagaggaggaaggcatgaagaaagaaggtctctggcaaaatcataataacaggatccttggctggatcaaaaagccaggtatcatctcccacaaagagaatttgatggaaaagagtaaagaattggtcaaaaccaatcaaaactcccccaagtccaatcatcacaggtaagactactagagccaggagactttttcgataaagagacaaaaagtcctttttcacaatcctattgacaaagacatagaaacttggcagtgtcactagagctactagctgaaccaaatgaaagagattcttgaccactgcgaaatggtgcagaccagctgctgacgaacgaaaatcaggcatctgtaagacctgactaaaaggattggtcagataattcatcaagatatgaaaattgtattgaatggtttctggttttagatagactcgattcgttaagtttagccactgaatctccataggatagaaaatccaagccagataaatggtcagaaggatggagagggagaggagaaagagcatagagccccaaaagatcaatttagttttcatcaaaatcccactccgcaaggctagaaaccacatgtgtcggtgcgattggcaggccagctacttcttctgccttagtaaaacctgtcgtcaccaagagcgttggaatgccattgtcaatcccagcccgaatatcagtcaaataattgtccccaaccatgattaactcttcacgttccaaacctaagtgctcaaccgccttgtccataatgatggcatttggttttccgatataaaccggcttcactcgtgtcgctacttcaagcagcgtaatcagtgagccagcacctggcaaaagaccgcgttccgtcgggatgttgaggtcaggattggttccgataaaatgggcacccttttgaatagcaagagttgctgtggcaaatttttcatagtcgacttgccaatccagaccaactaccacgtaggcaggtttttccttgtcttccacataaccagccgccttgatggcttccttgagtcctgcttctccgacgacatagacggtcttttcaagccccaaatcattcatatagtcgatggttgccaaagtcgctgtgtagacagtcgataggggcgtatcgatattaaaattctgagccaacatctccttaacactctctggagtgcgggttgtattgttggttacaaagagatagggaatgtcccgcttttgcaattcatgaacaaaagtctctccagcagggattcggtctttccccttataaatggttccgtctaaatcaattaaatagcctttatatttcatctatttctccctaagccttttttatttcttgccaagtaatgattgcttgggcattgataaccccatcacttgtaatttcatgcttgctttccagtccagtccgttcaacagccgatgtaatcaccccacctggtcgaacttccttgacatacttgaggttgattttcttgggaatatagtgggtcaaaaaatccgctcccatgacctcaaaaatccagtccaagtatttactgttattgacatgaccattcatatccaagtcgtaaaaacgaacatggtaatccttgctgatcggttcttccaaggactcatacttcggtccacggataagttttttatcaaaatcagactggtaaggagccacaatctcaggttcaacaacatggacttttcgactgtcgcggtccatgagaacaaaggtcgccatcatgtggatgagctcctgctccgcttcattataaatagtaaagcgacggtagcaaaaaagtcgattgtagctcaaggcttccgtttcgatggtaatttcttccgcaaaacgaggcaaacgaaccacctcaatatcatattctacgataatccagaccagattatattcttccaaaatggccttatcactaactcccagttcaatcgactgcatccctgaaacttgcagtgacagcaaaatcacatctggaagtttgatatgaccgttcatatcagccatatcaaaaggaattttcattttcatttgataagttaagcccatgatcctactccaaaataaatcgttctgctacagtatctcccaaaaagagacctctctttgtcatgcgaacgtggtcaccctcaatctgcatgaggccttgttgaaccaaatctctgacaatttctccataaagtccagcaaaagactgtccaaatttttcctcaaatcgcgccatggaaaccccggatttcttgcggagtcccaagaacatttcttcttccatttgctccttttgactcaggtgatcttctgtaatacaagcattgccttcctcaaccgcactgagataatgacgaatgggaccatgatttttatagcgtactccattgacataaccagatgcccctgcaccaataccatagtattcagcattgtcccagtacatgagattatgacgactttcaaaaccgggtttggagaaattagaaatctcataatgctcaaaacccgctcgctccagctctgcaatgatgtactcaaacatctccgcttctagttcctccttaggcagaggcaatttcccacgtcgcatccggttcataaagaccgtatggttttctaaaatcaaactatacaaactcatgtggggaatatccaatccaatggctttagccacattttcctttacttgctccatggtctgaccaggcagagcataaatcaaatcaatggagatattgtcaaaaccagccagtttcaggcgatcgatattttcataaatatccttctccaaatgactgcgcccaatctttttcaacatcttatcatcaaaggtctggacacctagcgaaacacgattgacagccgaatttttcaaaacagctatcttatccgcatccaaatcgcctggattggcttcaatggtcaactcttccaagacagacaaatccaagtttttagtcaagccattcagtaacacctccagttgcggagccgacagggctgtcggtgttccaccaccgatataaagggttgacaacttttcaatatcataagaacgaaactcttccagcagatgctctaaatagctgtcgactggctgatttttgatgaagacctttgaaaaatcacaataataacaaatctgggtacaaaatgggatgtgcacataggctgacgttggttttttctgcatagtaattattataccacaaagactagattccagataaaaatcaccatccccagatacatagtccgtccggagatggtgatggtttattcttctgttatatcaatcacaatctcttctgagtcatcaagagcttcggctttttcttgccattgctccttgagattatttaattgattttttgatgcttctgtcgcttgaaaagcataggatttagtttgagcaagtatactgtccacagtgatttcacctgactcaacctgttcttttgttttcagaacaaaatctgtagcctgctccttaacttctgtcagtttttcacagacttgctccttggcatactccggatcttctctcaaatcatctagaaaatcttgagcctgactgcaaacttgtttgcccttatcacttgttaaaaacaaggcaagagctgcacctgaaacggttcctaaaaggattgaggataatttacccataaggattctccttttttattttttgaaaaatttacttgcaagacgaagagctgacagacttgcaccagtcttgagtgtttttgaaccagctgatgaagctttcttgctcaagacacgcgcatggtcattgaggtctgaaacagatagagataaatctgcaacagcactgaagagtggatcaatcgtagccaccttgacattgatatcatctgccaagacattgaccttagccaacaactcattggtgtgatgcaaggtcacatccacatctgaagtcaaggttttaatcgtcttttctgtttcatcgatgacacgaccaagcttttgtacagtaatgatcagatagaccaaaaagacaatcaaagctagggcaacaagaatatatgcaacttctaacatttagttttcctcctctgtaatatagtaaggggccttctttcgattttgataaataacgatcattataccgagaccgataaggacaactgacagccattgggacactcgaaagccgaagaacatgagactatctgttcgcataccttcgataaccatacgaccgaaaccataccaaatcaagtaaaaggccgtgatatgacctcgtctgagactcttccatttccgtctaaaaatcagaatcaaggcaaagccaagcagattccatagagactcataaaggaaagtcggttgacggtagctcccctcaatatacatctggtcacggataaagccaggtagataatccagattatccactgttgcaccataagcttcttggttaaagaaattaccccaacgccccaaactttgagcaatcataacgctaggcgccgcaatatctagaaaatcccaagtattgatgagtttacggtcagcaaagatatagagcacaagagccccagttatcaaaccaccgtaaatggccaaaccaccattccaaatggcaaaaatctctcctaaattctgactatagtaatcaaatcggaaaataacatagtagagacgagctcctaaaatagccaagggaaaggctactaagataaaatctaaaatatcgtctggtatgatcttctttctaggtgcttctttcatggtcaaataaaccgcaagaatcaagcctgtcacaatacataaggcataccaacgaatggctaggggtcctagttgaatagcaattggatcaagcattttgcacctcatttcgagcgattagacttgtcagtcgttcgtcgaacaaacgggtcgcatcaaagcccatttccttggcacgataattcatggcagctgcctcaatcacaacagagatattacgacctgttttaactggaatacgaatacgaggaatgtacgccagaaacttcaagttcctctgcattatttccaagacgatcaaaggtcttatgcgtatcgtaattttccaaatagacagcaagctgaacctgtgaagaatccttgacagcactcgcaccgtagagactcataacatcgataataccaaccccacgaatttcaatcaagtgtttcaaaatttcagctggttcaccccagagagtaatctcatccttggcaaagatatcgacacggtcatcggctaccaaacggtgaccacgtttgacaagctcaagacctgtctcgctcttaccaattccactatctccctgaatcaagacgcccatcccataaatatccatcaa

SEQ ID NO: 132 - DNA, 9541 bp; double-stranded, linear
gaaaatcacaaccctttttgcaaaatttttgagattattttcacaaacttgatttttcaaagtatactcaataaaaattaaaaaaatccactacgtcaaggcgaggctaatgtggtttgaagaaattttcgaagagcgtgaatgagtatcatctatagtaaaataaaaaaactgaacaatttggttggggacagccaaaccaatttctcacaatgtttcagaaacaagggtgtgctattccaatttcagcctactataactgtcatagattgctgaaacaaagtctaggtaaaagtcttcataataaaaagacctcctatcaagtgttcaaaaactttgataggaggtcttgttttgtgaaaatatttatcaaattttctatacaagtgagctgttagccaggttctttctattctttcaatttcaatgaatggattttttactaatactcataactgggaatttgtctgtgtaaaaatagcgagatagatggtatttataaaacactcaagacagctagactaatatcatttaaaacattatcttcttttgagcgactgttggttaccaacatagctaaatttcctgcattttcaaattgatagggttctgatttagcattcacaaccaccaagaggtgttctttgccgtgaacttcatagataaggtagccgctatgttcaatcgcagaatgcacaaagacatgatggtaaatttcatcatagctagagtaagaaaaggcaccagtttttgtcttcaatcggatgacttgacggataaactcaatactgtcttgacgctcattaatcaagttccagttcacttggttcacactgtcaggagcattatagctattcatcgcacgctctctatcatcatgggtcaactcaccattttcaccagtcgcaaccagtttggtacgaccaaattcttgaccgatttccataaaggccatcccctgcatgagcagattcatggctgtggcagtttcgaccttgcgcatgatttgctctgaactttggtctggatgaagggttgccaataaatcgtgaagattgtaattgtcatgggcttctacatagttaagcacctgatttggatgtgtatagcttcctaattcacgacttcctaggattgctttagctagaattggctctgtcgcagcaccactgacaaaacctgacttgatagcaccataaacttctccccctttgacagcatcgcgctgattgtcattaaagaaaccaatatttggcatctggtaggcattgtccttcttggccttatcataaggggcaagacctgttcccatatcccatccttctccatagaggataatgttggagtcgatttcatccaagctttgacgaatcatctgcatggtcttgacatcatgaatccccatcaagtcaaaacggaagccgtcaatattatattcctgcacccagtatagaagagaatcaatcatatacttgcgaaacatttcgtgttcactggctgtttcatttccaacacccgttccattctggaaggtaccatctggattcatacgataatagtaatcagggactgttgtttggaatggtgcatcaacaactgagaaggtatggttatagactacatccataatgactccaatacccgcatcgtgataagcttgaaccatcaccttcaaatcacgaatgacctgagctggatcatctggattagttgaaaaactagtttctggcgcgttatagttttgtggatcataaccccagttgtaggttacatttccatcctcatcgtattctttatgacggtctgcaattggttgcaattgaacataattgtagcccagcttcttgatgtaatcaaaagcagttgactggccgtattggttaactgttccagcctgagcagcacccaagaaagttcctcgaagatgttcatctacacccgatgtaggtgatttagtcaaatcacgaatgtgcatttcacagataactgccttacatggattttccaagcgccaagtagcctccgaaccgtgcttaacctcgaagttttcaacttgcttttctacatggctcagaatagctgaacgtttgccatcagggctggtcgcgattgtataaggatcacgtgtcagtgtttggtgatgagggaattggacttgatactgataagtcttacctaccaaatcttcttcaacatccaaactccagacaccgattgtattgtccttatgattataagagtagctattgcctcttttcatctcaaaagtcttccaaacgggtgcatcattagcagctgattcataaacgacaacttgcacttctgtcgctgtaggtgaccagagagaaaaatgagcctgattgtcctctacacggcaacccaattctccttggtaaccccaatgatgatcaaaactagcactgttaatggccttatcaaaggcaaaaggattttgatttttatagaaaggactggcaatagcaggattttcagagtaataaatcctatcatcgccttccaaaatccagacctctgttaataggggatagtgattaaaacggatagaatattctttactagtttgacctgtatgaaccacaaaattcaagctttctataacatgtgaacttgggtgttcaaagctaaataaagctccaaaataatcttctttgtaggttagcaaatcaattcgttgatcctgactttttacaaaggagcaagtgtcatattctccattcttacgatggtaatgaatgcgcatagggtagttatacattttttatttttcctttttactttgtttctatttcactaataaatttttgtcaatctcgtctcaattaacagacatagtcatattctctaaactctgtttttaaacgatccattacaaactttctagccatgcctcatctctgacctggataccaagttcttgtgctttttgcagtttacttccagcgtctgcacctaccacgacgaggtcggtctttttagaaatactacctgtcactttggcacccagactttcgagtttacttttagcttctgagcgcttgagtcgttccaattttcctgtcaataccacggtcaaacctgacaaggccgcatccgctactaccgtctgtcctttatagtccagattgaccccagtttctttcaattctctgagcagaatttcagagccttctgtcgcaaaataagtctgaagacttttggcaatcacgccacctagactttcaatactagccacttcctctgaatctgcctgagacagattttcaattgaatggaaatattgaagtaaaagctgactaaccttgcttccgacatgacgaattcccaaaccaaataagagcttctcggcagaattttcctttgatgcttggatagcctgatacagtttagcagcggacttttccttaactccctctaaaaggaggaaatcctcttcttgcaaacgataaatatccgccacatccttgactaaattagcagcaaaaagcttctcaacaatagatggaccaaggcctgtaatattcatagcatcacgagaagcaaagtgaatcaagccttccatgatttgagcagggcaacgcggattgatacaacgtagggccacttcatcttcaaagtgcaacaagtcagagttacaacttggacagtttgtagggatatctagtttttcttcagaaacccgtttggactctaccacacgtaaaacggcagggatgatgtcaccagccttatatacaatgaccgtatcgtcttttcggatatctttttcagcaatataatctacattgtgcagggtcgcacggctaacagtcgtaccggcaagttgtactggtgttagattagcagttggagttacaacaccggtacggccaactgtccagtcaactgataagagttgagcttctttttcttcggcagggaacttgtaggctactgcccactttggagccttaactgtaaaaccaagttcttcttgacttgctaggtcgttgaccttgattaccactccatcaatatcgtaaggcagattttcccgttcctgtcctacttcttggataaaattccagatttcatctatgttttcagccaagattcgcttaggattgaccacaaaacctagttgttctaggtacttcaaacccttttcttggctatcacgagttgaagggctggcttcttgatagagaaacgttgcaagattacgcttggcaactactgctgtatccaactgacgcagagttcctgctgccgcattacgaggattagcaaattcaggctctccattttcttggcgcgcttggttaacttggtcaaaggaagcgcgtggcatgtaacattccccacgaactgtgatatctagttcttctggcaaagtcaaagggatgtccttaacacgcttgaggttttctgtgatattttcaccaattgaaccatctccacgtgttaccccagcaaccaaaatccccttttcataagtcagcgagatagataagccatcgattttcagctcacaaatataggtcggatgagccacttccttacgaacacgcgcatcaaaagcatctagctcctcacatgaaaaagcatcctgcaaactataaagaggatactgatgactgtatttttcaaaaccatctaaaaccttgccaccaacacgatgagtcggactgtctgctagcacttgctctggataagcagtttctaactcgaccaactcacggtaaaggcggtcatactcactgtctgaaaccgagggattatcgctggtatagtactcagtcgcatagcgattgagcaaagcgactaactcattcattcttttattcataagaccattttaccataaaacaagccctcctcacaaacgagaagggcggaaaaaacacttagtttgaaattatttttgaaactcaagcaaccttatatcaatttttcaaaatgagttcgaacatatccgagagctaagaaatataaggctacaactccaagtccaataatcaagaaagaataaagatggacacttggcaagactgtcataaatccttttgcaataggcataaatagaatagctaaggtaaaaattgtactcagtactcttccaagaaattcgctctcaaccttggtttgtacttgagtaaaaaagtgaatattaaaaatcgtcataaacaattcacaaactaaatttccagaaaaggaaagaaaagttggaagtggtaatcccatcataaaaactccgacacctgtcaaagccagtaaaatcaaaagattataaatattagctttaattttactagctagaagagccccaatgatggaaccaatagcccccatagttaaaatacttgcataggctccttctgacccgtaaagctgattcgaaaagggaagtagaaattcaaaagctgcaaaaaagaaattaacgctggaagctaccagcaaaaggaagaaaatttcttgctgatgccagatatagtgtaacccatccttgatatctacaaaaatatctctcccagtaaaagcctttttctcttgaacttttgcttcctcttttggaaggaaagccactagaacaaaagcaatgaaaaaagtcagcgagtctagcagtagcgtcatatggagacttgcaaactgtaaaacaaggaaggaaagaacaggagagctaacacctacaacctgcaaaaccagctctaagcgagaattatagatcacaatctcatctttctccaccacttcagttatgatagctttattggctgtgcgagaaaaggcaaaagcaatagcctgcacaatgttagcaacaatcaaagcgccaatcatccagctatcattccttatgaaagaaatagccagacaaagaatcccacaaacaagatctgccgtcattaaaatcttacgacgagaaaaacggtctgaaataactccgccaaagggattgacgagaatagatgtgacgagctcagaaatctgatacattcctaaaactgtctgtcctatagtccccatagaagccaaccagacactatttccataatcatagagcatatttcccattttattgatagccccacggctaatcaactgcactgcatagcgattcatattaaagctcctctcaaattttgaaactattgtatcaaaaccgaaaggagctttttattttttcccttatttgggaaaattaacttttgacaaatttttcgtagtgttcctgataataggctacttgctctggaagacctaacacatcaaaaatatgcatggcctcttgcatctgcttacagccttctttacactgtcctttttgatataaggcaaaaccttttaaataatggaaaacattacgctcataaagcttaatacctttgtcaataatcttctctgtataagcctcaaaatagttggcattataaaaagaagaatgctctaaacaatgctggtaacaattgagggccaaaatcaacactaatctcttatggcgactaatctcttggtaaaattcctccctctccataacttctctaccaatccgagtgacatagtctacatcgtagaaactatagaggttaccgaaaagaatcaactcatacatggtccattcttctgttttgaagagataatctgctaccttacccaaatcatcctgcttcatatcataactcgcatctctttgacaaatcagaccttgtagcaaaatccagttcagctcaaaataaaggggagtcgtcgaactcttagacttttcaagttgttctctttgaagcttttgaaaacctgcaatatcgtttgaatagtaaagtgggataatctgtgccatcatagacacatgttcatgattatgaaaattccttgccttatccatgaaattttcgattgttacatgaatgttatccaaaatctcaaagaaacgggagactgccaggtcagactccccaagctcaaagcgagataactgagaggtagagcaggattcgcctgctgcttcctttaaagaataatttccacttgttcgaaattcacgaaatacttttccaagatgttccatctttacacctgctctgataattcttcccactcaagcatagcttcttcctgacgatggctgattttgtccagctcagcctgtaattccatgagtttgtcggcatcgtttgtttccaacatttgttcagaaatggcttggctttgactttctagctcttcaatttcagcttctagactttcgatttgtcgcatgagtttgcgaacttctttttgactttctttctgggcctgatagtcattgactggacttgcttcctttgcttgattgctagttgaagcttcctcagtctgactcatttctgctgttgctttcttctcaacatagtagtcgtaatctccaaggtagagagttgaaccattctcagacaattccaaaacatgagttgccacacgattgataaagtaacgatcatgactgacaaacagcaaggttccatcaaagtcaatcaaggcattttctagcacttccttactatcaatatccaagtggttggtcggctcatccagaatcaaaaagttattgttttccatagacaatttagctaaaagcaaacgagctttttcgccaccagatagcatgccgactgattttttaacatcatctcctgagaaaaggaaggctccaagacggttgcggatttcaacttctggtgtcagtttgaaatcattccagagttcatccagcaccgtattacttggtgtcagcttgctttgggtttggtcatagtaaccaacctcaacattagcgccaaagcgcttttctcccttgataaaaggaatctggtccacaatagacttgataaaggttgacttgccgataccatttggaccaacgatagcgacagcattcatcttacgaagatctaggttaatcggttgtgacaagacttccccgtcatagccaacagctgcattttcaacagtcaaaacaacattgcccgacgttttttcagactggaaggtcatgttggctgatttcttgccagcttcaggcttgtccaaacgttccattttttccagttgtttacggcgagattgagcacgtttagtcgttgaagcacgaactagattgcgattgacaaagtcttccagagcagcgatttccttctgttgcttttcatagttttttgcctcagtaactagcttttgctccttcaattcgacaaaacgagagtaattccccacatagcgatccaaggaatgcttggtcaaatctagcgtaattgtcgcaaccttgtccaagaaataacggtcgtggctgacgataatgagggcaccgctatagtttaccaagtaattctctagccaggcgatggtttcaatatccaagtggttagttggctcgtccaagaccaagagattgggcttttcaaggagcattttggcaagtgccaaacgagtattttgaccaccagaaagctcagcaattttcatctgccacatagactcgtcaaacttgaatccattcaaaatcgctcgaatatcagcttcataggtaaagccacctgcttggcgaaaattctcagataagcggtcataatctgacatcagtttatccaaatcctcaccagacttttcacccatctccagctccatctgacgcagttgtctctccgtccgacgcaaatcattaaagacatgaagcatttcatcgtagatggtattttcagactcaaaacggctatcttgggctaggtaagacagagaaatatcttttttcttattgatttctccgctagttggctcctcttctccaactaaaatcttcaaaagagtagacttacctgcaccatttttcccaacaagagcaatccgatctcgttcatcaacctgcaggttgatattatcgaaaagaacctctcctgcaaaagaacgttcaattttattagcttgtaaaataatcatacaagtagtatagcatgtttccctaaggcattcaagataatcgtaagtcttttagtacaacttttataacataaaataaactaaattatgtatattttatattagattacttcactatcttgttggattttctaaccagctaatcttgtttcaaatagttatcgcacaagtctattatttaattcttttcatcatttacgtacgtatagcagattgaaataagatgagaacaaatcgattgggaaagtaaaattaatttctataaatgttttagcaattgtttcgtactattttagattcagtctactatatacaatattttcggaacattcaactttttaactctatttattactagatttcataattaaaaaacctactgaccaagctagaaagcttgatacaataggctttttaaagactgattatttaacagcgtctttaagagctttaccagctttgaatgctggtactttagaagctgcaattgtcatttctttaccagtttgtgggttgcgacctttacgttctgcgcgctcacgaacttcaaagttaccaaaaccgatcaattgaactt

SEQ ID NO: 133 - DNA, 3502 bp; double-stranded, linear
ttgactatcctatcatgctttctaaggtctactcaagaaaatcattttcaagttttcacacctttctcaaaaaagttaaaaaattttctcaaaaacgcttgactctgacctaaggcgaagggttatactatcattgtaaggaggaaatcatgtaccatataaaagaagctgcgcagctttcaggtgtctctgtcaagaccctgcatcactatgacaagataggactcttggtccccttaaagtcggaaaacggctatcgaacctacagtcaagaggatttggaacgccttcaggtcattctttactacaaatatctaggcttttctttagagaaaatagcagagctgttaaaggaagaaaggacagatttattgccccatttgactaggcagttggactatctaactcgcgaaaggcaacatctggataccttgatttccaccttgcaaaaaactattcaagaacaaaaaggagaaagaaaaatgaccattgaggaaaaattcacgggatttagctatcaagacaatcaaaaataccaccaagaagcggtagagaaatatggtcaagaagtcatgggacaagcgctcgaacgccaaaaaggtcacgaagacgaggctacggccgcctttaaccaagtctttcaaactttggcacaaaatcttcaagttggtttacctgcaacagcaaccgaaaaccaggagcaagcagccaagctcttgcaagccattcgcacttatggatttgactgctctattgaggtattcggtcatatcggtaaaggttacgtctacaacccagagtttaaggaaaacattgacaagtttggttctgaaacagcccagtacacgtcagatgccattgcggtttacgttcagacaaatgcagaataaataggctaggaatttcctagcctattttttacttcaaatcataaagccagtcgtcaccgtttttgtagtaaaagaattcactgagatcttcttctagaaacacacgaagcatatcagacatatcatcggttgcaagttttagatgagaaagattttcaaagtcctcccaccaaactttcccttcgtctgaagactggagttcaccagtaaagtgttctgtcttgtaaaaaaggacgacataacgataatccttgtcgtcataccagtttttgataccacagagttggggtttggaaatgatcagaccagtttcttctttcacttcacgaatgacagcatcgacaaaggattcgccacgttcaacatgaccaccaggaaaagtaatgccagaccagtcgggattaactcggtcttggaccaggaccttatctccgtttttaatcatacacatgttaacaaattcgactgcctctcttctgttcattcttcacaacctttaatctttaatcataatgcagacttcccgccacccagccggtacagagggcagaagtgatgttaaagccacccgtgtgggcattgatatccataacttcgcctgcaaagtggaggccaggtaccagcttactttcaagggttttaggattgatttccttgagactgactccacccttggtaacaaaggactttgcaagggacatttttccagttacaggaattttaagttctttaatggactggacaagttgttctcgttccttttcagtcagttgtttgactttttcaggatatccttgtacaaaaaattcggccaagcgttctggtaacaaggtttttaaagcgtttttcaaggatttttcccgattttcttctagaaatgtaaccaagtccttctcagaaagttgaggcaaaacatcgagtgagagaacctccccacctttgacaaagctagacatgcgtagggcagcaggacctgacaaaccaaagtgggtaaagagtaaatcatgagtgatgacatgcttaccataacttagggtcacatcgtccagagaaataccttgtaaggctttatgtggaaaatctgttaataaaggactttcagcagcctcaagatcggtgatggtatgcttaaaatggcgagcaatctcgtgaccaaaaccagtcgaaccagtcgaaggataagacttaccacctgttgtgacaatgagtttctcacaagtgaaggtttgatccgctgacttaaggacaaactggtcatctacttttttaacagaaacgatttctatttgagtagcaacttgaccacctagttcggtgattttcttttccaaagcttcgataatagtccgagacttgtcactggctggaaagacgcgtccgtggtcttcgaccttaagtttaacaccattttctgtaaaaaagttgatgatgtcatgattatcgaactgggagaaaacactgtaaagaaagcgtccgtttccaggaattccagctagcaggttgtctaagctaccattgttggtcacattgcaacgtcccccaccagtcccagctaatttttttccaagtttccgatttttttcgatgaggagggttttctgtccataaaagctactggaaatcgtagccatcataccagcaggtcccccaccgatgacaatagtatcaaaatgtttcatagctctattgtaccacaaaaaaacaagagatgatggtcacctcttgtcaagaatgcaattaatcaatttcatagcccatcagcaaaccgccctcttctgcatagaaactgcagagaccagaggttggtagaattttaatatccgcttgtgggaaggtttcacggattcgctctgagagctgttgacaacatttttcgttattgcgttgggccatgacaatacggccaccagcatatccagcttttactaactcatcataggcagcttgaactgatttctttgatccccttgctttttgtagcaattcgagagtcccagtttcactagcttttccgaccatacgaatgttgagaaggccaacgaccgtaccgataagcttgctcaaacggccgttcttcaccaagttatcgactttggctaggacaaagagcaacttagttttttcttgataggcggtgatagcttcaaccacttcttcaaaagacaagccctggtcaatcaagtcattcaatttttctacgagtaggtcaacttcaccaccagcagataaactatcaatcacatgaatcttagtgtcaggatggtcttccagataaatattctttgctagttgagcactattgtgactgccagaaagggtacctgtgatggttactaggaaaatgtttttggcaccttcaaatgctcgcaaatagtcatctgggcttggacaagccgattttgaagcttctgcagttgcatacatggtttccatcatttggtcaatatcgagactggcgtcatcaacaaagacctgatcagctacttgaatggttaaggggacacttacaaaggttgtgttaatagctggtgttggcagttgacgataatcacaaccagagtcagcaataatcttccaagtcatagaaattctccatctttgtcaggaacgat

SEQ ID NO: 134 - DNA, 12665 bp; double-stranded, linear
cgattgatttttttaaagcgttcgatagagaatgagaaacgaatccttagcaatggcgggaaagaatttggagttgagaatacaaaacgattaactatggctcatattgttttttatctctcttgcttggttgaggcaatggtgcacaagacaatttttgatggcatgggcatggttggtttagtcttgcttattttttctatgctgatgttgatgttggtgattcacttgttgggagatatttggacagtgaagcttatgcttgtcaataatcacaaatatgtagatcatatcttgtttaggacagtaaaacaccctaattactttttaaatattcttcctgagttgattggcttgaccttgttgagtcatgcttatgtgacttttgttttagtttttccagtttatgcagttattttgtatcgacgaatagctgaagaggaaaagctattacatgaagttataatcccaaatggaagcataaagagataaatacaaaattcgatttatatacagttcatattgaagtgatatagtaaggttaaagaaaaaatatagaaggaaataaacatgtttgcatcaaaaagcgaaagaaaagtacattattcaattcgtaaatttagtgttggagtagctagtgtagttgttgccagtcttgttatgggaagtgtggttcatgcgacagagaacgagggagctacccaagtacccacttcttctaatagggcaaatgaaagtcaggcagaacaaggagaacaacctaaaaaactcgattcagaacgagataaggcaaggaaagaggtcgaggaatatgtaaaaaaaatagtgggtgagagctatgcaaaatcaactaaaaagcgacatacaattactgtagctctagttaacgagttgaacaacattaagaacgagtatttgaataaaatagttgaatcaacctcagaaagccaactacagatactgatgatggagagtcgatcaaaagtagatgaagctgtgtctaagtttgaaaaggactcatcttcttcgtcaagttcagactcttccactaaaccggaagcttcagatacagcgaagccaaacaagccgacagaaccaggagaaaaggtagcagaagctaagaagaaggttgaagaagctgagaaaaaagccaaggatcaaaaagaagaagatcgtcgtaactacccaaccattacttacaaaacgcttgaacttgaaattgctgagtccgatgtggaagttaaaaaagcggagcttgaactagtaaaagtgaaagctaacgaacctcgagacgagcaaaaaattaagcaagcagaagcggaagttgagagtaaacaagctgaggctacaaggttaaaaaaaatcaagacagatcgtgaagaagcagaagaagaagctaaacgaagagcagatgctaaagagcaaggtaaaccaaaggggcgggcaaaacgaggagttcctggagagctagcaacacctgataaaaaagaaaatgatgcgaagtcttcagattctagcgtaggtgaagaaactcttccaagcccatccctgaaaccagaaaaaaaggtagcagaagctgagaagaaggttgaagaagctaagaaaaaagccgaggatcaaaaagaagaagatcgccgtaactacccaaccaatacttacaaaacgcttgaacttgaaattgctgagtccgatgtggaagttaaaaaagcggagcttgaactagtaaaagaggaagctaaggaacctcgaaacgaggaaaaagttaagcaagcaaaagcggaagttgagagtaaaaaagctgaggctacaaggttagaaaaaatcaagacagatcgtaaaaaagcagaagaagaagctaaacgaaaagcagcagaagaagataaagttaaagaaaaaccagctgaacaaccacaaccagcgccggctccaaaagcagaaaaaccagctccagctccaaaaccagagaatccagctgaacaaccaaaagcagaaaaaccagctgatcaacaagctgaagaagactatgctcgtagatcagaagaagaatataatcgcttgactcaacagcaaccgccaaaaactgaaaaaccagcacaaccatctactccaaaaacaggctggaaacaagaaaacggtatgtggtacttctacaatactgatggttcaatggcgacaggatggctccaaaacaatggctcatggtactacctcaacagcaatggcgctatggcgacaggatggctccaaaacaatggttcatggtactatctaaacgctaatggttcaatggcaacaggatggctccaaaacaatggttcatggtactacctaaacgctaatggttcaatggcgacaggatggctccaatacaatggctcatggtactacctaaacgctaatggttcaatggcgacaggatggctccaatacaatggctcatggtactacctaaacgctaatggtgatatggcgacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagatggctatggagtcaatgccaatggtgaatgggtaaactaaacctaatataactagttaatactgacttcctgtaagaactctttaaagtattccctacaaataccatatcctttcagtagataatatacccttgtaggaagtttagattaaaaaataactctgtaatctctagccggatttatagcgctagagactacggagtttttttgatgaggaaagaatggcggcattcaagaggctctttaagagagttacgggttttaaactattaagccttctccaattgcaagagggtttcaatctctgccagggtgctggcttgcgaaatggctccacggagtttggcagcgccagatgttccacggagatagtgaggagcgagaccgcggaattcacgaactgcgacgttttctcctttgaggttaatcaatcgtttcaagtgttcgtaggcgatcttcatcttgtcttcaaaggtcaaatcaggtaggatttctcctgtttcaaagtaatggttgatttggttgaagaggtaaggatttcccatggcagctcggccaatcatgactgcgtcagcaccaacttcttcgatgcgttgcttggcttcttggacagtacggatatcaccgttggcgatgaatggaatcttggttagagcttgggcaaccttgtaaagggtctcaaggtctgcgtggccagtatacatttgttcacgggtacggccatgcatggcgagggcagaaacacctgcagcttcagcagcgagagcattttctactgcaagagatgggtccgcccagccggtacgcattttgacagtaagtgggatatcaaggacagactggaccttgttgatgatggagtaaatcttgtctggatccttgagccacatagcaccagcttcgttcttcacgattttgttgacagggcagcccatgttgatatcgacgatatcggtcttggtgttttcttggatgaattctgctgcgcgtgctaggctgtcttcatcgctaccaaaaagttggatagagacagggttttcgccctcatcgatatgaagcatgtgcagggttttttcgttgttgtattggattcccttgtcagagaccatttccattacaacgagtccagctccgagctcctttgcgatagtacgaaaggctgagttggtcacgccagccataggcgctaaaacggtacgattgggaatctcaatattgccaatcataaaaggtgtattaagatttgtcacgaatgagttcctccaggtccttttcatcaaagttgtaagtagtttggcagaattgacaagtgatttctgccccgtggtcttcctctttcatttcctgtaagtctgagcttggaaggctggcaagagcgttcataaagcgttcatggctacagtcacattggaaacggatttcttcttcagaaagacgcttgtaggcttcgtccccgtagatagccttgaggagggcttcgatatggtcgtcgctttcgagaagagtagagatagctggcatttcttggatgcgtttttcaaagcgagcaatctcttctttcttggctcctggcaagacttgaactaggaaaccacctgcaaccttgaccttgtcttcctcgtccaaaaggacattgaggccgaccgctgaaggcgtttgttggctttcagtaaggtaaaaggcaaggtcttcaccgatttctccagagatgaggggagttatagagttgtaaggatttccagtaccgtagtctgtgataacgaggaattgaccatttccaacaaaaggtccgactaggacttcaccagtcgcagtctttttgatgtcaacaccaggattttgaacatagcctttgacgttccccttggtatcagcgacggtgataatagcacctagagagctagatcccaacaccttaactgtaagtttggtatttcctttttcattggctgcgagaatctggctagcgataagagttcgaccaagcgctacagttgagctagcttgggtttgatgtttttcttgagcagtgcggacggtttcagtgctatcaaggacaaaagcacgaaaggctccgctttctgatatagttttaataattttatccatagctactattttagcataaaaatgcccaaagggggagccgtgtgtttactgattttcaggataatggaccaggaaatcagcatgaaaataaaaagagaaacagattattttagcatttgtcagatttatgctatgcttaaggtagaaaatgaaagggataacaaatgtatttaggagatttgatggagaaagccgagtgtggtcaattttcaatactttcctttctattacaagagtctcagacgaccgtcaaggctgtaatggaagaaacaggattttcaaaagcaaccctaaccaaatatgtcaccctgctcaatgacaaggctttggatagtggcttagagctggctattcactcagaagatgaaaatctgcgtctgtctatcggtgcagctaccaaggggagagatattcggagcttgtttttggagagtgctgttaaataccagattttggtttatcttctctaccaccaacagtttttagcccatcagctggctcaagaattggtgattagcgaggctacgcttggtcgtcacttggctggtttaaatcagattttgtcagaatttgatttatccatccaaaatggccgttggcgaggtccagagcatcagattcactatttctatttctgtcttttccgaaaggtctggtcgagtcaggaatgggaaggtcacatgcagaaaccagagagaaaacaggagattgccaatttagaggaaatctgcggtgcaagtttgtctgcggggcagaaattggacttggttctctgggctcacatcagtcaacaacgtcttcgggtcaatgcttgtcagtttcaagtcatagaagagaaaatgcgagggtattttgacaatatcttttatcttcgtttgctgagaaaggttccgtccttttttgctgggcaacatattccactaggagttgaggatggtgagatgatgatattcttctcttttctcctatctcatcgcattcttcctcttcatactatggagtatattcttggttttggagggcagttggcagatttactgacgcaattgattcaagaaatgaagaaggaggaactattgggggattatacagaggaccatgtcacctatgaactcagtcagctttgtgctcaagtctatctctataagggctatattttacaggatcgctacaagtaccagttagagaatcgtcatccatatttactgatggaacatgattttaaagagacagcagaggagatttttcatgctctacctgcttttcaacaggggacagatttagataagaagattctctgggaatggctccagttaatcgaatatatggctgaaaacggtggccagcatatgcggattggtctggatttgacatctggttttcttgtcttttcaaggatggcagccattttgaaacggtatttggaatacaatcgttttattaccattgaagcttatgaccctagtcggcattatgatttgctggttaccaataacccgattcataagaaggaacagacaccagtctattatttaaaaaatgacttggatatggaggatttggtagcgattcgccagttattattcacttaaaaggcttggttaatccaggtcttttttgtgaaattcacacaatctcctcacatttttttaaaaattaaaaaaagttgataaacaagaaagcgctttattttgtatactagtaagtgtaaagaggaaacacctcaagatctttatcaggaggacagtacatgtcacaagaaaaatacatcatggccattgaccagggaactacaagttctcgtgccatcattttcaacaaaaaaggggaaaaggttagctcgagtcaaaaagagtttacccagattttccctcaggcaggttgggttgagcacaatgccaatgaaatttggaactctgttcagtcagttattgcgggtgctttcatcgaaagtggtgtcaagccaaatcaaatcgaggcaatcgggattaccaaccaacgtgaaacaacggttgtctgggataagaaaacaggacttcctatctacaatgctatcgtttggcagtcacgccagacagcacctttggctgagcaactaaaaagccaaggttatgtggaaaaattccatgaaaagactggtttgattattgatgcttacttctctgctaccaaggttcgttggattttggatcatgtagaaggtgctcaagagcgagcagaaaaaggggaattgctctttggtactatcgatacttggttggtttggaaattgactgacggtgcggctcacgtgactgactactcaaatgcagctcgtaccatgctttataacattaaagaactcaaatgggatgatgagattttggaaatccttaacattccgaaggctatacttccagaagttcgttctaactccgaaatctacggcaagacagctccattccatttctacggtggagaggtgccaatctcaggtatggctggggaccaacaagcagccctctttggacagttggcttttgagccaggtatggttaagaatacttatggaacaggctctttcatcatcatgaatactggggaagagatgcagttgtctgaaaacaacctcttgacaaccattggttacggaatcaacggtaaggtttattatgccttggaaggttctatcttcatcgcaggaagtgctattcagtggcttcgtgacggtcttcgcatggttgaaaattcaccagaatctgaaaaatacgctcgtgattctcacaacaacgatgaagtttatgtcgttccagcctttacaggtctaggcgctccatactggaaccaaaatgctcgtggttccgtctttggtttgactcgtggaacaagcaaagaagactttatcaaggcgactttgcaatctattgcttatcaagtgcgtgatatcatcgacaccatgcaagtggatactcagaccgccattcaagtactgaaggtggatggtggtgcagccatgaacaacttcctcatgcagttccaggcggatattttaggcattgacattgcacgtgctaaaaacctggaaacaacagctctaggagcggccttcctagcaggtttgtcagtagggtactggaaagacttggacgagttgaaactcttgaacgagacaggagaactctttgagccatctatgaacgaatctcgcaaggaacaactctacaagggctggaagaaggctgtgaaagcaactcaagtctttgcggaagtagacgactaatactggcagaataaagcgatttatttagaaagtgtgtaaatatggaattttcaaagaaaacacgtgaattgtcaattaaaaaaatgcaggaacgtaccctggacctcttgattatcggtggaggaatcacaggagctggtgtagccttgcaggcggcagctagcggtcttgagactggtttgattgaaatgcaagactttgcagaaggaacatctagtcgttcaacaaaattggttcacggaggacttcgttacctcaaacaatttgacgtagaagtggtctcagatacggtttctgaacgtgcagtggttcaacaaatcgctccacacattccaaaatcagatccaatgctcttaccagtttacgatgaagatggagcaacctttagcctcttccgtcttaaagtagccatggacttgtacgacctcttggcaggtgttagcaacacaccagctgcgaacaaggttttgagcaaggatcaagtcttggaacgccagccaaacttgaagaaggaaggcttggtaggaggtggagtgtatcttgacttccgtaacaacgatgcgcgtctcgtgattgaaaacatcaaacgtgccaaccaagacggtgccctcattgccaaccacgtgaaggcagaaggcttcctctttgacgaaagtggcaagattacaggtgttgtagctcgtgatctcttgacagaccaagtgtttgaaatcaaggcccgtctggttattaatacaacaggtccttggagtgataaagtacgtaatttgtctaataagggaacgcaattctcacaaatgcgcccaactaagggagttcacttggtagtagattcaagcaaaatcaaggtttcacagccagtttacttcgacacaggtttgggtgacggtcgtatggtctttgttctcccacgtgaaaacaagacttactttggtacaactgatacagactacacaggtgatttggagcatccaaaagtaactcaagaagatgtagattatctacttggcattgtcaacaaccgcttcccagaatccaacatcaccattgatgatatcgaaagcagctgggcaggtcttcgtccattgattgcagggaacagtgcctctgactataatggtggaaataacggtaccatcagtgatgaaagctttgacaacttgattgcgactgttgaatcttatctctccaaagaaaaaacacgtgaagatgttgagtctgctgtcagcaagcttgaaagtagcacatctgagaaacatttggatccatctgcagtttctcgtgggtctagcttggaccgtgatgacaatggtctcttgactcttgctggtggtaaaatcacagactaccgtaagatggctgaaggagctatggagcgcgtggttgacatcctcaaagcagaatttgaccgtagctttaaattgatcaattctaaaacttaccctgtttcaggtggagaattgaacccagcaaatgtggattcagaaatcgaagcctttgcgcaacttggagtatcacgtggtttggatagcaaggaagctcactatctggcaaatctttacggttcaaatgcaccgaaagtctttgcacttgctcacagcttggaacaagcgccaggactcagcttggcagatactttgtcccttcactatgcaatgcgcaatgagttgactcttagcccagttgacttccttcttcgtcgtaccaatcacatgctctttatgcgtgatagcttggatagtatcgttgagccaattttggatgaaatgggacgattctatgactggacagaagaagaaaaagcaacttaccgtgctgatgtcgaagcagctctcgctaacaacgatttagcagaattaaaaaattaagaaaaaataaaagaggtggagggcagcattccttgtcgcccgtcccttctttttaatggagacagaaagatgatgaatgaattatttggagaatttctagggactttaatcctgattcttctaggaaatggtgttgttgcaggtgtggttcttcctaaaaccaagagcaatagctcaggttggattgtgattactatgggttgggggattgcagttgcggttgcagtctttgtatctggcaagctcagtccagcttatttaaacccagctgtgaccatcggtgtggccttaaaaggtggtttgccttgggcttccgttttgccttatatcttagcccagttcgcaggggccatgctgggtcagattttggtttggttgcaattcaaacctcactatgaggcagaagaaaatgcaggcaatatcctggcaaccttcagtactggaccagccatcaaggatactgtatcaaacttgattagcgaaatccttggaacttttgttttggtgttgacaatctttgctttgggtctttacgactttcaggcaggtatcggaacctttgcagtgggaactttgattgtcggtatcggtctatcactaggtgggacaacaggttatgccttgaacccagctcgtgaccttggacctcgtatcatgcacagcatcttgccaattccaaacaagggagacggagactggtcttacgcttggattcctgttgtaggccctgttatcggagcagccttggcagtgcttgtattctcacttttctagtttatactcttcgaaaatcaaattcaaaccacgtcagcgtcgccttaccgtactcaagtacagcttgcggctagcttcctagtttgctctttgattttcattgagtattagaaaacaattatgttgatagagcttgggcaagagcccaatttcagcaaaaaatgaagtaaatcttctcataataaaacgcatcatatcaagcacgaaaattccacgaggtcaactacagtcagaaagctgaacaacaagccaaaacgcccaaaaaaggcggcaaaaagcaagcacctgcaagcaacgtgccgaaatggtcaaatcctgattatgtcaacgaattagacccaaaaatcgttgatatgctagtagaatttcacaagtcacaaggcactttggaaactcccgaggcgcaagcagaaatcgcccaaaaacgtgaagaaatcgagcaaaggagagctgagcttgagggtaaaaaacaagagcttttgaaccgcttgaacaaatagagtttcgcaagtattatgcttacaaattacttgagcaattaactaaaatataaaccctgcctttatatctaggcagggtttatattttagaaattcacgtaggttgttacggtttttacatacccagtatagtttgagtttctatagtattcagtgataaacttccattttctttgagcaacatggatataagtacttgttatgtagtatggatatgggctttgtgaatccaagtaagactgataagcttgtataccaaaatatgctccaccaattattgcaccccatggaccccccaataaagcacctatcctaccaatcatataactgattccagcaccagtcatgaagttagcgaatgtgttagcttgtttattcccatgtattgtgttgacgtaattccaaacattaggatcgtatgatctaaaagatatatttaggtcgatttcattcttttgataagccatataaaatgccccattgatatagacgccgtcagcacgtcgttcaatagtgtctacacttccatctggattgacaacctcaagaacttcatcgcttaaaatatttacttgcgtatctccgaaccgcactgatgagccattctcaaactgagcctcaccagatacaactttagagtttgccgataagctatcatcagcaaaaacaaacaagcgacggggaaatgctagacatacagaaaacagacataactagcaaacacatgcatttaaacatcttagacataacggaaactcctttgtatttttgatttttttcaacttttattatacaataaaaccaaataaaaagaaagcggtaacaatatgcttaatgcgaaaattttttatatatttttatgtttgatcgttatcgaaactacaggcttgttgttgttgaaaagaggtctcgaaatgggttatttagacacagaagctattatcctcgcagttttttcatttgctttttacaacctatgttcattcgcttgggtctgctctacaataaaaaacaataaaaaataaatagacgtattttcaaaaaaaacmaaatgcatatttatattagcaaaacgacgatttaaatcgtcgtttttttgtagtacgacgggcatgtcgtatatctgaggtgtaagtcctcagcctgactatcgtgaggtagcagggagaggaagggatagcgaaatcgtggctctacgaacaggaacgtgatagtaaggcgtatatagcggataaggaggcttcaaactctaaagtccaaaaaggtagtcgtaacctatatgtgtaaatcacgagagtaattgaattcggactaaggtttgtgtgaaaaagataaatctttctagagtctaaagactctgcgtcagatttcctattttcactgtaaccttttaacgtcctcatatcttgtataaacgaggaaagatgtacgacttatcccgtgaggtttcatgagcgtgaaagcgtagtaacaacgaatcatgagaagtcagccgagcccatagtagtgaggaaacttccgtaatggaagtggagcgaagggg

SEQ ID NO: 135 - DNA, 5305 bp; double-stranded, linear
cgctaatcactacaatcattttattgtactttttcactctcaagaaaagcaagaagtattcattttagtttcatttagtattattttgcatacctaaaatacagtaaaaaatcagtcatcttggtatgctcctgctttcactattcaacacgtttttgacttatactaggctcatttccaaaagcattatataatagtgatatgaaaccaactaaactaaacaagaaatataagcaataaaaattcgtttaaaagatcttactaaagctaatactaaataaaaataaaagagtaaactaggaagtttatttcaaacaacctaaaatactgattttcggctgaagataatactggagtgcaaattaatggggttataataaatagctgatagcttgtgttggttttggattttttaagagtagatgagtattaaaactataaggaggacgaaggtggctaaaaatttaaaattaaaattagctcgggtagagcgtgatttaacacaaggtcaactggcagaggctgtcggggtgacacgccagactattggtttaatagaggcgggaaaatacaatcccagtctctcgctctgccagtctatttgcagatgtttagggaaaaccctagaccaactattttgggaggaagaagatgaaaaatagattttattattctcaattactagacgaaagagaagaacaactgttcaataaagcgggctctgaaagtttctatatctgcattgctttgtcgctcctatcttatatcatttcagtattagcaccaagcctttttaattctaatatgctgctaatcgttatcatcatagggacattttactttttcaatcgtgcccgttatctgggagtgacctactatggtcgttttcattttacgattttgggttgttttttcctaaccttggctattacggctcttttgatgttgcagaattatcaattcaacatagaaatttatcagcacaatcctttgaattttaaatacctgtctgcttgggtcattacttatatcatttaccttccgtggatctttattggcaatcttggtcttaagagctatggcgaatgggctcagaaaaaatttgaacaagatatggatgaattggagagtggagaatagcttgttactcttttctcaatccagctaaaatgtgatataatagtactaatttattggaatacatgaaagttcttgaaaattttcatgggtttctagctaaggaagtaggaaaagtatgtatccagatgatagtttgacattgcacacggacttgtaccagatcaacatgatgcaggtttactttgaccaagggattcacaataagaaggcggtctttgaggtgtatttccgccaacagccttttaagaacggctatgcggtttttgcaggtttagaaagaattgtgaactatcttgaagacttgcgtttttcagatagtgatatagcctatttggagtcgcttggttatcatggggcgttcttggattaccttcgcaatttcaagttggagttgaccgttcgttctgcccaagaaggggatttggtttttgctaatgaaccgattgtgcaggtggaaggacctctagcccaatgtcagttggtcgaaacggctcttttgaacatcgtcaactaccagactttggtggcgacgaaggcagctcgtattcgttcggttatcgaagatgaacccttgatggagtttgggacacgtcgggctcaagaaatggatgcggccatctggggaacacgcgcagctgtgattggtggcgccaatggaaccagcaacgtgcgtgcgggtaagctctttgacattcctgttttgggaacccatgcccatgccttggtacaggtttatggcaatgactatgaagctttcaaggcttacgctgcgacccacaaaaattgtgtctttcttgtggatacctatgacacccttcgcatcggtgtaccagctgccattcaggtggcgcgtgagctgggtgatcagattaactttatgggtgtgcggattgactctggggatattgcctacatttctaagaaagtccgtcagcaactggatgaggctggatttacagaggctaagatttatgcttctaatgatctagatgaaaataccatccttaacctcaagatgcaaaaggccaagattgatgtctggggtgtgggtaccaagctgattacagcctatgaccagccggctcttggggcggtttacaagattgttgcaatcgaagatgaaactggtcagatgcgcaatacgattaagctgtctaataatgctgaaaaagtttctacgccaggtaagaagcaggtgtggcgcattaccagtcgtgaaaaaggcaagtcagaaggcgactatatcacttatgatggtgtggatattagcgacatgacagaaatcaagatgttccatccgacctatacatacatcaagaagacggttcgtaattttgatgccgttcctctcttggtggatatcttcaaagaaggaatattagtttacaacttgcctagtttgactgacattcaggattatgcccgtaaggaatttgacaagttgtgggatgagtataagcgtgtgctcaatccgcagcactatccagtggatttggcgcgtgatgtatggcaagataagatggacttgattgataagatgcgcaaggaagcccttggtgaaggagaagaagaatgagtttgcaagaaacgattatccaagagctgggtgtcaaaccagtgattgatgcccaggaagaaatccgtcgttctattgatttcttaaaaagatatctgaaaaaacatcccttcctaaaaacctttgtactagggatttctgggggacaagactcaaccttggcaggacgtttggcgcaattagctatggaagaactgcgagctgaaacgggagacgatagctacaaatttatcgctgtccgcctgccatacggagtgcaagctgatgaagcagatgctcaaaaagccctagccttcatccagccagatgtcagcttggttgtgaatatcaaggaatcagctgatgccatgacagctgcagttgaagcgacaggtagtcctgtttcagacttcaacaaggggaatatcaaggcacgttgccgtatgattgctcagtatgcccttgctggttcccatagcggagcggtcattggaacagaccacgccgcggaaaatatcacaggtttctttaccaagtttggtgacggcggtgcggatattctccctctttaccgcctcaataaacgccaaggaaaacagctcttgcagaaacttggcgcagagccagccctttatgaaaaaatcccaacggcagacctagaagaagataaaccaggcctagctgacgaagtcgcacttggagtcacctacgcagagattgacgactacctagaaggcaaaacaatcagcccagaagctcaagcgaccattgaaaactggtggcacaaaggccaacacaaacgccacttacccatcaccgtatttgatgacttttgggagtaaaaaggtccgggggacctttttagcttcttgccctgaaattaaaaagcaagaaaaacctccactggaggttttcagcctctcatcttgaaataagaaagtgagagaaggtctgggggatcttgaaccccgagtttagaaataagaaaatgaggcagattcagtaactcgaagagttcgatttcatcgtcttacccctgcaacgatgactaggtttgaaaaagcttgctagagcgcatttcaaaccaggcagcaactgcgtcaagaaattagaagacaaactcgttttctagctgttactgagttgagcctttttactacgagtatagaaataaggaagtgaggtagcatcatgaaatctatcggtacgcaaatattacagacagaacgtttgattttaagaagatttgtggagagtgatgcagaagccatgtttcaaaattgggcttcatccgctgagaatctgacctatgttacctgggatccccatcctgatgtcgaaatcactcgaaactcgatttgcaattgggttgcttcctatactaatctcaactattataaatgggccatttgtctaaaagaaaacccagagcaagtaataggagatatcagcattgttaagatagacgaggctgatttaagctgtgaaattggctatgtgttaggcaaggcttactggggaaatggtatgatgacagagactttgaaagctatcttggacttttgttttactcaagcaggttttcaaaaggtcagagcacgttatgccagtctcaacccagcttcaggtcgtgtcatggaaaaggctggaatgtcctatctacaaaccattgttaatggtgtagagagaaaaggctatcttgcggatcttatttattatggtataagtagggaagaatgttgaattctattttctgtttctatcgaagtcaactatttattgtaaatataataattagcattccaagtttatttgaaactttaaaatagcatattgattagtacaagacagatgttctagttccttctttaatctggtttagtgttagttaaaaaatcgctttaagcttgtaactaagagggagctaatcgactagattctccagccgaacaggtggtaatgtactttttatagtgtaatcctagctgttgttaaatttaaaatagaatcctctatcgagttagggaattaaattcaaccaattttattcatgttttttctatcaaattatctaatattaaaatagtctcattctgatgagaaaactattcccaaatcattcatacctctctcaactagatgtaacttacaaaacccctgacctcatgagccactttcttcctcctcatgaggtcagttttactttctgctgttccagtatcgtttttcctcgctagatttcctcaaaagggcagactcctcccttggtgcgtcacacgattttttcatctcgactgttctttaatgcatcattaacgacgcttttcttctaggtggttcataaggaacaggaagattcaggttgacttttctaatcctagaataaagtgctgaaaacaattcggaataggcatagagactagacaatttgaggagctgcttgcgtcctgttcgaacacattttcccaccacgtgaagaaaaagatggcggaagcgtttgattgttaaagtttggaagtcacctccagctagatgtttgagaaaaagatagagattgtaggcgatacagctcatcatcatacgaacttcgtttttgattaaggttgaact

SEQ ID NO: 136 - DNA, 3964 bp; double-stranded, linear
tggcagctcgtcgtcgtaaaggacgcaaagttttggctgcataatccaaacgaattctatcaaaaatcagtaggaactcgagtctactgatttttatttttgtaaaaaagttcagtagatgcaaatggattcggaagcgatgttacagtagattgaaactagaatagtacacctctgtttctaaaacattgttagaaatcgatttgactgtcctgatcgatttgtcctgttattattttattttactataaagttgaagtaggtggagatggtacagcaacaatcgtctttaaagatggttcagctattacaattccaggaaatcaattggtagcacaagatccaaaagcacaagatagcactaaactgactgctgaaaaatcaactgttaaagcacctgctcaaagagtagatgtaaaagatataactcatttaacagatgaagaaaaagttaaggttgctattttacaagcaaatggttcagcattagacggagcgacaatcaatgtagctggagatggtacagcaacaatcacattcccagatggttcagtagtgacgattctaggaaaagatacagttcaacaatctgcgaaaggtgaatctgtaactcaagaagctacaccagagtataagctagaaaatacaccaggtggagataagggaggcaatactggaagctcagatgctaatgcgaatgaaggcggtggtagccaggcgggtggatcagctcacacaggttcacaaaactcagctcaatcacaagcttctaagcaattagctactgaaaaagaatcagctaaaaatgccattgaaaaagcagccaaggacaagcaggatgaaatcaaaggcgcaccgctttctgataaagaaaaagcagaacttttagcaagagtggaagcagaaaaacaagcagctctcaaagagattgaaaatgcgaaaactatggaagatgtgaaggaagcagaaacgattggagtgcaagccattgccatggttacagttcctaagagaccagtggctcctaatgctgctcctaagacaacaagtgcaccgcaagcaactgcaggaacaatgcaagatgttacctaccagtcacctgctggcaaacaattacctaacacaggttcagcatcaagtgcagcacttgctagtcttggtctagtggtggcaacaagtggttttgctttgctaggaagaaagactagacgtagaaaatagaacagctagaaaattctattctctacttaaagttagattataagggggattttgagaagtcatcaatcctagtgatgggtgagaaaagtgagaacccaagataatcacatactttagctgaataggaatattctatcaatgtagccaatctcttctgtctctaactgtggaataggagatgggcaatatcggatagaaaagatagcagaatagctctctattgaagagaggaggggaaaccgaaaaattaggtgcccctcctcttttttggtataatagaagatagaaaacgaggttagaagagatgatttttgatacacatacacacttgaatgtagaagaatttgcaggtcgtgaggcagaagaaattgccttggctgctgagatgggtgtgacacagatgaatattgttggttttgataaaccgacgattgagcatgccttggagttggtagatgagtatgagcagctctatgcgactattggttggcatcctacagaagctggtacttatacagaggaagttgaggcttacttgttggataagttaaaacattccaaggttgtggctttaggtgaaattggcttagattaccattggatgacagcgcccaaagaggtgcaggagcaggtttttcgccgtcagattcagctatctaaggacttggatttgccttttgttgtccatacccgtgatgcgctggaagatacctatgagattatcaagagtgagggcgttggtcctcgtggtggtatcatgcattcattttcagggacgcttgagtgggcagagaagtttgtggatcttggtatgaccatttccttctcaggagtggtgacttttaagaaggcaactgacctccaagaagcagctaaagagttacctttggacaagatgttggtggaaacagatgcgccttacttagcacctgtacccaagcgtggtcgtgaaaataaaacagcctatactcgctatgtggtcgactttatcgctgacttgcgtggtatgacgacagaagagctggcggtagcaacgactgcaaatgcagaacgaatttttggactggacagcaagtaatgaaagagaaaatttctcaagttatcgtggttgaagggcgtgatgatacggtcaatctcaaacgttatttcgatgtggagacctatgagactcgaggttctgccatcaatgctcaggatatagagcggattcagcgcctgcaccaacgtcatggagtcattgtctttacagacccagattttaatggggaacggattcggcgcatgatcatgatggtcattccaacagttcagcatgcctttctcaagcgagatgaagctgttcccaagtccaagaccaaggggcgttctctgggaattgagcatgccagctatgaagacctgaaaacggctctagctcaagtgacagaacaatttgaacatgagagtcagtttgacattagtcgtagcgatttgattcgccttggttttctagcaggggcagacagccgtaagcgtagagaatatctcggagagactctccgaatcggctattccaacggcaagcaactcctcaaacgcctagagttgtttggggttactttggcagaagtggaagaagctatgaaatcttatgagtaggaaagatgtagccgttacaattttttaagtttcacagtatttttcgaagcaggtagaagaggaggcgtctgatgttaattggtcaaaaaattaaagagattcggatagaaaaaggaattagtcgtccagatttttgtggagatgagcaagaactgacagttcgtcaactgtcgcgaattgaaagtggagcttcgcaaccgagtttgcccaagttagactatattgctcgccggctaggagttccagtttatagccttatgccggatttttcagctcttccttctgcttatttagaattgaaataccagattttacgtgaaccaatctatggtaaagaagaggagtacgataagaaggaagcgtgtttggaagagatttataaaacatactttgataatcttcctaaagaagaacaattagcatgtgaagtattgcaggcgtgtttggatacttctagaactagaaggcctgaatatgcagagttaatacttgaggaacatatgcctcagattatagaaaaagaagcttattcaataaatgatatgttgttgattcgtttgtttttttatcaaatgctcattagaaaagatcttgccaaatttataaatcaaatcgaaaagctaatgctctttcttttggaacagaagaaggtaactcaaatagagaattactttataattagagatactcttatttcaggaatgtgttgtcttgaaaaggtaggagtaactgattgttttaatgattatctatcgtgtttacaagaaattatggataaaactcaagattatcaaaagaaacctcttgtatttatgtttttgtggaagcaagcattaagagaagaaagagattttagtttagctgaatcattttatcagtcttctaaaacatttgcgcagctaattggagatgaatttctagtaaagaaattgacagaggaatggcaagaggatgtcaaaaaatatttataaacatagtgaatcagtgacaaagatgtccttgtcctcgtatcaaaacagttctaaagttcgtctttagggatgtttttttagatataagctaaaaatgacacgaaatggttagattttaaggacattgatgtccg

SEQ ID NO: 137 - DNA, 12666 bp; double-stranded, linear
tgagaccgttatttgtattagggaaatgggtatctatttttaatgctgtggggattttgattgtttctattattcaaaccaaaagcttgtcaggtattggagcaggattgtttaatctatataacatttcatcttatataggtgatttagttagtttcactcgattgatggcattaggattatctggagcaagtatagcatcagctttcaatttaattgttggtttgtttccgggaatattggctaaactgacaattggattagtattattcattcttttacatgcgatcaatatttttctatcgttactatcaggatatgttcatggagcacgtctgatatttgttgaattttttggtaagttttatgagggtggaggaaaaccatttcaacctttgaaggcttctgagaaatatattaaggttattacaaagaattaatggaggatatatataatggaacatttagcaacttatttttcaacctatggaggagctttcttcgctgcattgggaattgtattggcggttggattaagcggtatggggtctgcttatggagttggtaaggctgggcaatctgccgcagctttactgaaagaacagcctgaaaagtttgcctcagctttgatattgcaattattgcccggaacacaaggattatatggttttgttattggaattttaatttggttgcaattaactccagaacttcctttagaaaaaggcgttgcttatttctttgtagctcttccaattgctattgtaggatacttttcagctaagcatcaaggaaatgtagcagtagcgggaatgcaaatcttggctaaaagaccaaaagaattcatgaagggagcaattttagctgccatggtagaaacctatgcaattcttgcttttgtcgtatcattcattttgacccttcgtgtataagaaataaatttgcaattcaaaggaggtgtctaaatgagcaatttagaaaacttacgagagtctgttattgaacaagctcatgaaaaagggcgtatgaaattattggattccaaaaagaagattgatgatgaatttgaaatgcaaaagtcgctcattataaagaaaaaagaagctgaacatgaacgaaagttaaaagaattgcaacagaaatatcaaataatttttcaacaattaaaaaataaggaacgccaatcaacgttagtatcaaaacagaaaatattaaaagaactttttcaatctgctttactagaaatggaatcttggagtgcagataaagaaatggagttcatctatcgaattctggaacgatattcacaacaagaggtcatagtaacctttggggaacggactttagctaaattcaatttggaacaattagagaaattgaaattctcttttccaaattatttatttagtgaacaacctatctcaaatgaatcaggcttacttatttcaataggtaaaattgatgataactatttgtataaaacattaattggatcgatttctaaggaagaaagttcaagtatcgcaaatcaaatttttatcaattaaggatgaaattggttaatccttcttagaaatttggagtattccaataaaattagaaaggtattttatggatactaatcttttttcaaaaataaatacgacgatttcggtaaaagaaaacgattttattacagaagaaaaatttcaaaaaattatacaatccaaagatacggagacattggcatttatcttagaatcaactccctatcatttatcgattgacatcttagaagatcctagtcagacagagatttcgctaatgacaaaattagtcaatgattatagatgggcctatgctgaaagtccgtctgatataattgtgactttatttgctttacgatatgtttatcataatatcaaagttttattaaaatctaaggcggcaattaagaaagatttttctaaattattaattccaatagggatttttgatatagaaagtttaaaacatttagtttcttccttacattcagatacacttcctgattttatggttcgtgaagtagaatcaatttggaatgagtatgaaacttttaataatattcgtgtacttgatgtcggagctgatctagcatattttaaacatctgaaacttttatctaatgagttagatgaggtactgtctcaggttattgtcgaaatgattgacttttataatattattactgtaaaacgtggtttatctcaaaataagagtcatggggatattttacaattactttcagatgaaggaagtatttctgctaaagaatttatatacattgtagaaaatcaagaaatatttgtgtggttcaataaaataaatccaagcttagattcaatcttttcaacttatgaattgaagatgcaggacgcaacaatttcatcttctgagttagaatttttatgtgatttactattgtataaaactttagatcaaggaaggtacaatgtagaggggccgttagttcttgctagatatttattgggatgtgagtttgaagtaaagaatctcagaatgatcatatcagctcttcaaaatacaattccctttgaatcaataaaagaaaggatacgcccacattatggaagctaataagtataaaattggcataattggtagccgtgatattattttaccatttagcatgattgggtttgatatatttcctgcctaccaagaacaagaagctataaatacactaagaaaattagctcaatctgattatggtgtcatttatatcactgaagacattgcttcaatgatattagatacaattcgccattatgattcccaagttgtgcctgctattattttattaccgactcataaacaaggtttaaatttaggattaaaacgtatagaggataatgtagagaaagcagtaggacacaatattttataataatgtacaaaattgtctgtaatattattctataatttttggacttagtaaggagaataactttgactcaagggaagattataaaagtatcgggacctctagttattgcatcaggtatgcaggaggctaatattcaagatatttgccgtgtaggtaagctagggttaatcggtgaaattattgaaatgagaagagatcaggcatctatccaagtctatgaagaaacatctggtcttggtccgggagaacctgttgttacaactggagaacctctctcggttgaattagggccaggattgatttctcaaatgtttgatggcatacaacgcccattagatcgatttaaattggctactcataatgattttctagttcgtggggtagaagttccaagtttggatagagatattaagtggcattttgattccactatagcaattggtcaaaaagtgagtacgggtgatattcttggaactgtcaaggaaaccgaggtagttaatcataaaattatggttccttatggagtatctggagaagtcgtttctattgcatctggcgattttacaattgatgaagttgtatatgaaataaaaaaattggacggtagtttctataaaggaacgcttatgcaaaaatggcctgtccgcaaggcgcgtcctgtttctaaacgtttaattccagaagaaccattaatcacaggtcaacgagttattgatgcattctttccagtaaccaaagggggagctgcagcagttcctggaccgtttggagcaggaaagacagttgtacaacaccaagtagctaaatttgccaatgttgatattgttatttatgtcggttgtggagaacgtggaaatgaaatgacggatgtactgaatgagtttcctgagttgattgaccctaataccggacaatcaattatgcaacggacagttctgattgctaatacttcaaatatgcctgttgctgctcgtgaggcttcaatttatacaggaattaccatggctgagtattttcgtgatatgggctactctgtcgccattatggctgattcaacttcacgttgggcagaagcgctacgtgaaatgtcaggacgtctagaagaaatgcctggtgatgagggttatcctgcttatctgggaagtcgtatcgctgaatattatgaaagagcaggacgttctcaggttctagggcttccagaacgtgaaggaacgattactgctattggagctgtatcgccacctggtggagatatttcagaaccagttactcaaaacactttacggattgtgaaagttttttgggggcttgatgctccgttggcacagcgacgtcattttcctgcaattaactggcttacatcttattcactatataaagacagtgtgggcacttatatagatggtaaagagaagacagattggaatagtaaaataactcgtgcgatgaactacttacaacgggaatctagtttagaggaaattgttcgtcttgttggaattgattctctgtctgataatgaacgactaacgatggaaattgctaaacaaattcgagaagattatttgcaacagaacgcttttgattcggtagatacattcacttcgtttgcaaaacaagaagcaatgctaagtaatattctcacttttgctgatcaggcaaatcatgctttagagttgggttcttactttacagagattatggaaggtaccgtggcagttcgagaccgtatggcgagaagtaaatatgtttcagaagatagattagatgaaatcaaaattatatcaaatgagattacacatcaaattcatttgatattagaaacaggaggtctataaatgagtgttataaaagaatacagaactgctagtgaagttgttgggcctcttatgattgttgaacaagtaaataatgtgtcttacaatgagttagttgaaattcaacttcataatggagaaattcgtcgtggacaagttttagagatccacgaagataaagcaatggttcagctttttgaaggatctagtggaataaatttagaaaagtctaaaattcgttttgctggtcatgcattagaattggctgtatctgaggatatggttggtcgtatttttaatgggatgggaaaaccaattgatggtggaccagatttaattccagagaaatatttagatattgatggtcaagctattaatcctgtatctagagattatccagatgaatttattcagacagggatctcctctattgatcatttgaatactcttgtacgtggtcaaaaattaccagtattttcaggttcgggcttacctcataatgaattagctgctcagatagcaagacaagcgactgttttaaattctgatgaaaattttgcggttgtatttgcagcaatgggtattacttttgaagaagctgagttttttatggaagaactcagaaaaacaggagcgatcgatcgttcggttttatttatgaacttggcaaatgatcctgcaattgagcgtattgcaactccccgcattgctttaactgcggcagagtatctagcttttgaaaaagatatgcacgttctagttatcatgacggatatgactaactattgtgaagcgttacgtgaagtctcggcagctcgccgtgaagttccagggagacgaggctatccgggatatttatatacaaatttatcaactctatacgaaagggctggtcgcttagttggtaaaaaaggttcggtgacacagattcctattttaacaatgccagaagatgacataacacatccaattcctgatttaactggatacattactgaagggcaaattattttgtcgcatgagttgtataatcaaggttatcgtccaccaatcaatgttttaccttctctctctcgattaaaagataagggatctggagaaggtaaaactcgtggagatcatgctccaactatgaatcaactgtttgcagcctatgcccaagggaaaaaggttgaagagttagcagtagtattaggagaatcggctttatctgatgtagataaattgtatgtgaggtttacaaagcgttttgaagaagagtacataaaccaaggattttataaaaatcgaaatatagaagatacgttgaatcttgggtgggaattactatcaattcttcctagaacagagttaaaacgtatcaaagatgatttgcttgataaatacttacctttggtagaagtttaatccggaaatggagtgattatctatggtacgtttgaatgtaaaaccaactcgtatggaattgaataacttaaaggaacgtttgacaacagctgaacgtggacataagttattaaaggataaaagagatgaattgatgaggcgatttatttctttgattcgtgagaataatcaacttcggaaagaagtggaaagttatctaattgataatctaaaatcctttgcagttgctaaatcattaaagaattctcaaatggtggaggaattattttcaattccatcgaaagaaattgaattatttgttgagaaagaaaatatcatgagtgtaacagttcctagaatgcatatgaatattacttctcaaaatgagaacagtgaatacagctatttatcttctaatagtgaaatggatgatgtatttgctacaatgaatagtttaatttataaattactaagactggcagaagttgaaaaaacgtgtcagttaatggctgatgaaatagaaaaaacacgtagacgtgtaaatggtttagaatactcgattattccaaacttgtcggaaactattcattatatagaattgaaactagaggaggcagaaagagccaatttagttcgtattatgaaagtgaagtagatcctttatttagattattaattagatgaacaaatatcagcttggataaggctttaagcctttctaagctttttttattgacagtatcaggatatctttttcaaaattttggtttgttagataatgaaaatgtttctactaatctagatttaggattagtaaatcgtaaatgtaattatatagaaagtaagcgcgtcataacaaggtatctatcattcatggagctcctcctgtatactattagtaaagtaaaactattggaggatattttaatgccacaacctattgttcctgtagagattccacaatctcgtcgttttgattctaaaaagagaaatgatattctgcttaaaattcgtattggcaagcttgaagtaagtttttttcaatctctcaatctcgaaatggtagaacagcttttggataaggtgttgctctatgacaattcatctatctagcctaggggaggtctatctcgtgtgtgggaaaactgatatgagacaaggaatcgattcactggcttatctggttaaaacccactttgaattggatcctttctccggtcaagtctttctcttttgtggtggacgtaaagaccgctttaaagtcctttactgggatggtcaaggattttggctactatataaacgctttgagaacggcagattgatttggctaagtacagaaaaggatgtcaaagctctcacaccagaacaagtagactggcttatgaagggcttttctatcactccaaaaatatagtagattgaaactagaatagtacacctctgcttctaaaacattgttagaaatcgattttactgtcctgatcgatttgtcctgttcttatttcattttactataaatccatcagaaagtcgtgatttctattgaaatgaggactttctttttatactcatctgctttcaaaaagcattctagtccatctccgattaacgatggactttatcacctccttctccagtccttgtataacatcttggagttgattcatgacatcttccaaagtttaaaaggctttattcttaaatccacgtttacgaatctctttccacacttgttcaatggggttcatctctggtgtgtatggaggaataaatgcaaagccaatattagtcggaatctttaaggtacttgatttatgccatatagcattgtccataacgagtaaaagataatcatctggataagcttgtgaaatctcctattcctaaagcccctttagcgcataactttggctcagcttctattatcgctcacaccatccatcagaagtttaatctgaaggtacccaattatcgccaagaagaagattgggctaggatgggtttaccaatcacacgtaaggaaatctctaattggcatatcaaggcgagtcaatactatttggagcccctttataacctcttgcgagagagactattgactcagcccttacttcatgcggatgaaacttcttatagggtgctagagagtgatagtcagctgacttactattggacttttttgtcaggtaaagcagagaaacaagggattacgctttaccaccatgatcagtgtcgaagtggttcagtagtacaagaattcctaggagattattctggctatgtgcattgtgatattttgcggcagtaacttaggactttagtcctctagttctgcctatgcgatagcagtccaaggtttaggagcaaggcgacgctaagcttggtaaacttcgaaccgctcgtctgcttatcgtcaactggaagaagctgaacttgttggatgttgggcgcatgtgagaaggaagttttttgaagcgcccccccaagcaagcggataaatcatccttaggagctaaaggtttagcttattgtgatcagttattttccttggaaagagactgggaggctttgccagctgatgaacgactacagaaacgtcaagaacatctccagcccttaatggaagacttctttgcttagtgccggcgtcagtcagttttagcaggttcaaaactaggaagggcaattgaatacagcctcaagtatgaagaaacctttaagaccattttgaaagacggacatctggtcctttccaataatctagctgaacgcgccattaaatcattggttatgggacggagtaaaagagtccagtggactcttttagcctaagctcagtttaaaaaagcgagggtggttattttctcaaagttttgaaggagctaaagcaagagctattattatgagtttgttggaaacagctaaacgtcatcaattaaatagcgagaaatatctatcctatcttctagaatgtcttccaaacgaggaaactctcgtaaacaaagaggttttagaggcttatttaccatggactaaagttgtacaagaaaagtgcaaataagaaatctccagattaggaactatccgtgagttctccagtctggagatttttcaatagacttcctgcgaaacaaaatatggtataatagttctatgaatgatgaagcaagtaaacaactaaccgatgcacgatttaagcgtcttgttggtgttcaacgcacgacttttgaagagatgttagctgtattaaaaacagcttatcaacttaaacacgcaaaaggtggacgaaaacctaaattaagtctagaagaccttcttatggccactcttcaatatgtgcgagaatatcgaacttatgaacaaattgcggctgtttttggtattcacgaaagcaacttaatccgtcggagccaatgggttgaagtaactcttgttcaaagtggtgttacgatttcaagaactcctctcagttctgaggacacggtaatgattgatgcgacggaagtaaaaatcaatcgccctaaaaaaagaattagcgaattattctggtaaaaagaaatttcacgctatgaaggctcaagcgattgtcacaagtcaagggagaattgtttctttggatatcactgtgaactattgtcatgatatgaagttgttcaaaatgagtcgcagaaatatcagacaagctggtaaaatcttggctgacagtggttatcaagggctcatgaagatatatcctcaagcacaaacttcacgtaaatccagcaaactcaaaccgctaacaattgaagataaagtctataaccatgcgctatctaaggagagaagcaaggttgagaacatctttgccaaagtaaaaacgtttaaaatgatttcaacaacctatcgaaatcatctaaacgcttcggattacgaatgaatttgattgctggtattatcaatcatgaactaggattctagttttgcaggaagtctattatcaaaaataccatcaagattatataagattgatacaggaaaagttttatttgatggtgtaaatattaatcaaatagataaaaaaatattaagtcaaaatttaggagtagttccacaggattcatttttattgaaccgaagtattcttgataatataactttaaagcacgaagttacttcacaaaagatagaggaagtttgtaaagcagttcaaatctatgatgaaatcatggctatgccgatgaaatttaatactatcatctcagagatggggtcaaatatttcaggtgggcaaaggcaacggatagcactggcacgtgcattaataaataatcctagtattgtaattttagatgaagcaactagtgcattagacactattaatgaggaaagaataacaaagtatatacaaagtcagggctgtactcaaataattgtagctcatagattgtcaacgattaaggatgcggatgttatttttgtaatgaaaggtggtaagattgttgagtcaggaaatcataagtacttaatggatcttggtggagagtactacagcttatatacaaaaaggaaatgaggtgtaaagaaaatgaagaaagaaaatgaatatgtaattttaacaacagcctcactaggggtgatgattggaatagtgtttgcaatttttttagattttccagttgaatatggtatttctttaggcttgttgaatggaatagtattgggttcgctgattgtttacaaaaacaataagaattaagcataattttttgctgtaaactaaggagtagagatggctatagttgaaattataaatctaacaaaaagctttaaagatattgaagttattcataacacttaaataatagagcaactacagtagtagcttaaaaacatgattaaatcgctattcttaggagtagcggtttttctttttgtttaatactctttgaaaatctcttcaaaccacgtcagctttgctttaccgtactcaagtacagcctgcggctcgcttcctagtttgctctttgattttcattgagtataaaaagggtcaagtaagtatagtaaattgaaataagatatgaacaaatcgattagaaaagtcaaattaatttctagaaatatgttagaaattggtttgaattccgcaatcaatttgttcagtttttatttcatttcattttatttaattagattttccaattttttaattcaagctaaaaatccccaatcgtagtgattgaggattgagtaaataaatcttaaacaataccttgtgcaatcatggcatttgctacattttcaaaggcagcaatgttagctcctgcaaggtagtctttatcaagaccgtatgtttctgaagtcgttttagctgtgttgaagatgtttgtcatgatgtctttgagacggccatcaacttcttcacgagtccatgagaggcgaagactgttttggctcatttcaagagctgaaacggctacaccaccagcgttggcagcttttgcaggtccgtagaagataccattttctttgtaaactttgatggcatcaaggtcgctcggcatgttggcaccttcagatacacagataacgccttgagcaaccaaacgtttagctgcttcaccgttgatttcgttttgagtggcacatggaagagcaatgtcatagtttccagcgtaagtccatacagtaccttcgtggtaggttgcagttgctttttcagctgcatactcagtcaaacgagcacgacgtttttctttaacatcaaccaaaagatcgaagtcgataccattttcatcgatgacataaccatttgagtcagaaacagaaataacagttgcaccgagttcagttgctttttgaagagcatattgagcaacgttaccagaacctgaaataacgactttcttaccagcaaagctgttaccgttagctttgagcatttcttcagtatagtaaaccaaaccgtaaccagttgcttctggacgaatcaagctaccaccaaatccaagaggtttaccagtcaagacaccagcatcaaattggttaagacgtttgtattgaccgtaaaggtaaccaatttcacgtccaccaacaccgatatcaccagcaggtacgtcaagtgatggtccgatgtgtttttgcaattcagtcatgaagctttggcagaagcgcatcacttcagcatctgttttacctttaggatcgaagtctgatccacctttacctccaccgataggaagtccagtcaagacatttttaaagatttgttcaaatccgaggaatttcaagatcccttggtttacagttgggtggaaacgaagtccacctttgtatggtccaacagctgagttgaattgaacacggtaaccacggtttacttgaatttttccatcacggtcaacccaaggaacacggaaagaaaccacgcgctcaggctcagtaatacgtgccaagatattttcttcgatatactcagggtgtttttcaaatacaggttctaaagtgttgaaaaattcttcaacagcttggaggaattcagcctcgtgccgg

SEQ ID NO: 138 - DNA, 3083 bp; double-stranded, linear
agcaactgttgtgaaccaattccgataaattccaagaattggttaatagagccattttgaccaaaaatcccgataaaagcataggctttaaggagcaaattgatccaggtaggaaggataatcagcatgagccagagttgacggtgtttgagacgggtcaaaaagagggccgtcggataactgataagcagtgccacaaaggtcacaatgcctgcataaagcactgagttgaaactcattttaagataggtcaagttttgtgacgcaaagtaagatttgtaattttctaaactgaactggccttcgatgttgaaaaaggattgaccgaaaatcaagaccaagggtgccaatacaaagagcgcaatccaaagcatgtagggtactacaaagagtttagagcttgttttcttcatctctttcctcctcgattgcattgatcaaacctgcttcttgctcttcgatttctacgtactcctcaatacgagcatcgaactcttcttcggtttcattgagacgcatgatgtggatgtcttctggttcaaagtccagaccgatttcctcacccacgatagccttacgggttgagtggatcatccattcatttccaagttcgtcataggcgataatttcataatgaactccacggaaaagctgggtatcgaccttaacttggagcttgccttcttcaggaagggtaatgcgcaagtcctctggacgaataacgacctcaacaggttcatttggcttcatcccaccatcaaccgcttcaaagcgtttgccgttaaattcgaccaagtagtcctcaatcatggtacctggcaagatgtttgactccccgataaaggtggcaacaaagtggttgattggctcatcgtagatgtccacaggggttccagactggacaatctcgccatcattcataacgaaaatccagtcactcatggcaagagcttcttcctgatcgtgagtgacaaagacaaaggtaatgcccaatcgttgttgtaattcacgcaattcgtactgcatgtctgttctcaatttcaagtccagcgctgataaaggctcgtccaacaagaccacacggggttggttgatgatagcacgggcgatggccacacgctgacgttgtcctccagaaagtttgcggatggaacgtttttcataaccttccaactgaaccatcttgagaacttccgctacacgctgctcgatttctttcttatcaattttacgcaagcgaagtggaaaggcaacattttcaaacacattcatatgtgggaacaaggcataggattggaagacggtatgtacgtcgcgcttgttggttggaatatcattgatacgaacaccgtctagcatgatatctcctgtcgtcgcatccagtaaacctgcaataatgtttaggatagttgatttccccgaaccagatgcacctagaagggtgtagaatttcccttcttccaactcaaagttgatgtctttgagaaccttggtgttgctgtcttcaaaaactttagagacgtttttgaattcgataattggctttttcaattggcataaattccttctttttcatagattaaccgatcggggctctgtcaggtccccactacctcttgcagggagtaaaaccacctgcatacatcttcgctaccgataggctttcacccaagatccggacttctctttcaagcgtaatacctgagtgttccttgactttttcgataaccgattggatcaagtcctcgtagtctttggccgttccatctgcgacattgatcataaatcctgcatgcttttctgacacttctacgccaccgatacgatagcctttcaagccagcttctgaaattaactgacctgcaaaatgcccgactggacgcttaaagaccgagccacaagatgggtattccaaaggttgcttgagttcacgtaggtgcgtcaagcggtccatttcctgcttgataacctgatgggttcctggagctagggcaaatttaactgacaagacaactgcaccagactcctgaatagctgaatgacggtaaccaaaagccaagtctttagcagacagggtttcgatttctccatccttggtcaagaccttacaagactgcaagatgtgagcaatctcgccaccataggcacccgcattcataaagacagcaccgccaacgcttcctggaataccacaagcaaactcaaagccagttaaactatgacggagggcaatgcgagttgtttcaatcaagttagccccagcttctgcttcaatggtatagccatcaacagaaacgttattgagcttgtcacacaagatgacaaatccacgaatcccaccatcacgaacgatgatattgcttgcattgccaagaaccatccaagggatattttcttggttggcaaatttcacaacgcgagccaactcaaaacgatttcgtggaaagaccaaataatcagcctctccacctacttttgtataactatagctatgcaagggttccttaaaacggatatcaattccttctaagatttcaagcattttttctcttacagacatgtcactcttccttttacaaaattcattccattataccatttttagagacatttgacgaccataaaaataccttgtttggattttgcataagaaaaagaggttcccccctttttatgattttttacaaaagatttccttggttccataggcgaccagaacgagctccagtgctagaatcacttcaaccaagactggatttgtcaaccagcctacttggaaaagagatggtgccagatcaaagaaggcatgcaagccataggctgctaggagataaatccatttcttctggcgaacagcttggtaaacccaaactgtcaaaagtaattggaaaccaagcgccaagattcgctcaaaaccaagcaaataaatctgccagaccgaaagtgactgaatggtttttaacatattttcagacagtaattgcataacctgtggattctgagtttgaactgccgaaagaacaatgtaaagattgagtaaactagtaaggcctagaaaaatcaactccaagccaccatgcccc

SEQ ID NO: 139 - DNA, 15363 bp; double-stranded, linear
ccggaggatattgaccaccaccaaaagcagggggaaaatcgaaatcaaccaatagtaggctactgcgacactggtcaactcactatctgatgcttgataataatgcaaaaaagcttttaataaaggtttgtctatcagctctttccaccactttttcatgtcatactccttcacttataatcttatactcaatgaaaatcaaagagcaaactagaaagctagccgcaagctgctcaaaacactgttttgaggttgtagataagactgacgaagtcgatcacatacatacggtaaggcgacgctgacgtggtttgaagagattttcgaagagtattaactaatttcttcttaccaattccaccatatcatacggtagggtattggcagcttccttcaaggaatagttctctaagttatttacattttgtcgtaatttcttggcatacttagtcgtaatcaatcgtttttcttcgtattcgaaaatcaacttgcgctccagataatagcctctcagcatttcatcgatattgttgggtttgacacgattgataacccgttcgacaaaggcaccactgctgataatagctgtttctcgaagacgagactcctgcataaaactaatcaaagagcgtctgtagactcccttcaggttttccaaactttcaataatcatctctgtattggcaagatagagctctgcaatttggtcataatcaagagcacggagacggctttgctccttgttcttccagctacggaaggtctttccgagagtaaaaacttcatgaaggagaaaacgtaaaatcctcaaggaaacaagaaaataataggtcagtcttgaggcaagtttacgattgattccttgttctatatttttcagataacgttggtaaactcggtaagcacgattgctaatgttcccctcttcataggcctgttccaaaccatcactttcaatactaagaatcaagagtttcaaagcagcccagtcttcttgatcatcctggttttcttggcttaaaatgagattttcaatacgtccatgataattgtcaatagccgcatagaggggaagtttatttctggtgtcttccaactctttttccaactctagcgttacttcattcaaaatggcgatatgcataagataatccttgctttcttcctcttcatcagaaagatgaggcaagaccaagagacctgttaaaaagctaacaagcgtcacacctgcaacaaggaaaagcaaaagaggatactcctgttctagattacttggtatcaagagaatcgtagcaatcgacaccgttcccttaacacctgaaaaggtcaagagaaacatgtccttcatatacttatttagctttttcttgaggcgtcgggttctataggcataatagccatagatcataataaaacgaatgacaaaaaggacaaaggtaagggcgataagagatagcaataaaagtagaggattatagattggattggtcaagataggttctgctatcatttccaactccatccctaaaatcacaaagacagaaccgttgagcataaaggtcactgtatgccagaccgtctcggtcaccgtatccacttgggcttcgaggagcgtgattttcttgaagcgacttgcctttaaaattccagcaactacgacggcaataatacctgaaacatgaacttcttctgccagaaagaaggtcactagaggcaaactcaattctaataaaagttcactggcaatatccgttgcgcgcacacttagcaagaaggtatggaggaagcggttggtcatggctgttaaaaatccaattaaaaaaccgcctaggattgaaaagatgagcgaactgctagcttgccccagagaaaaagctccagttgtccaagctgtcaaagctacctgaaaagccaccaaaccagaagcatcattcaagagtccttcgcccttaagaatattggacacgcgcttaggaaagctaaaacgctccgaaagagaggcaaaggccaccaagtccgtaggaccaagggctgccccaacagccaagcaagctgccaagggaaggctgaaccaaagaagatgggccaagccacccaaactcagggtcgagataaaaatcactggaaatatgagataaacaatgattcgccagtgttttaaaatagccgtaacatctgcttcttcagcctctcggaaaagcaagggtccgataaccagtgccaaaaacaactccgtattaaggtgaaagtcagtattgggtaaaaagagaccaatcacaattcccaaaagaatttgcaccaaagggagaggcaaaaagggcaggagcttattggttgtacttgagacaatcaaaaccagtaaaaataggatgaggtaaatcagtaattccacgcacgtcctccttaatcttttttacaacaggattcaaatatctccttctgctctttgattttttggtcaatcttggaacagtctttgtgctcaatttttctctggcaccgttccatttcaagagcaactaattttttcttgattttaagcatttttttgctcatatgcgcttggtctagcacgcccatcgctcgttcgtggtgggttgattcaacaaaattctggcgcatggcatccagcttttcgtgtaagtattgtttatccatgtctgtatctctctaatttttcaatcatcactaaaaacggcgggttgttgacttggtttaaagttcggtaaatggcagctgtgtactcttgttggttcaactggatcacaaaatccaagacagcatctctctcgagatcgcctccttcatgaccatagtaaatcataatagcaattcgtccacctttgacaagtaagccacatagcttttctaatgcctcaatcgttgtctgcggtcgggtgatgacagacttatcagctgccggcaaatagcccagattaaaaatccctgccttagcttttatcacaaactggtccagtgtctcatggccttgcaagattaactgggcatttgtcaagtcagcctgatgcaaacgctcttgggtcttttccaaggcttgcttctgaatatcaaaggcatagacttgcttggctagcttggctaaaaaaagcgtgtcatgaccatttcccatagtcgcatccactacgacatcctcttttgtcacgacctcagccaaaaaatcatgtgccatctcaagtggtcttttcattttcaaactcctgttttacagccttgcatccttgaacacttccacgacgtcgcatctccatctcaatgctgttgaggacttcccatttattgaggctccacataggaccaagcagcatatccctaggcgcatctcctgtaattcgatggatgacgatatgtttgggaataatttccagttggtcacagatgaccctgacatattcgtcctgactcatcaattgtaaacgcccctcatggtaatctcgttgcatacgagtatttgtcataagatggagcaaatgcagtttaatcccttgaatatcgttatccgtgacacaacggcggacattttcaaccatcatctcatgggtttcaccaggcaaaccattgatcaaatgggaaacaatctcaatttttggatactttctcaaacgcttgaccgtttccacctacaattcataagaatgcgcacggttaatcaggtcagaggttgcttcataagtagtttgcaagcccaattcaaccgtcacatgcatgcactccgataactcagccaaatattcgatggtttcgtctggtaaacagtctgggcgcgttccaatattgattcctaccacacctggctcattgatagcctgttcataacgctctcgaataacttccaccttttcatgggtgttggtaaaattttgaaaataaaccagatacttccgaacatccggccacttgcggtgcataaagtcaatttccttataaaattgctcacggataggcgcatccggtgccacaatggcatctccagaaccagaaaccgtacaaaaagtacagcccccatgagccacagtcccatcacgattgggacaatcaaatcccgcatcaatagggactttaaaagtcttttctccaaagagttttcgataataatcattcaaggtattataagatttcatgactttcattataacaaaaatcacccacaatctcaaaagcctgactttcctataaattcctctgtttctcgtttccattagcctttttttatgatacaatatgggtatgattttaatgaaattagcatctattttattattgatactgaccttagtcgtctgcattatcctaaccaaactttttagattaaaaaaactaggacgaaactttgcggatttggcttttccagtcttggtatttgagtattacttgattacagctaaaacctttacccataatttcctccctagactggggctagccctctcgatcctagccattattctcgtctttttcttccttttgaaaaaacgcagcttttactaccctaaatttatcaaattcttctggcgtgcaggattcttattaacccttatcatgtatatagaaatgattgttgaattgttcttaatgaaatagtcgaatccctaagcattttctagggatttttgctttctctacaaaatagtatagacaataacactatacaattttatacaaagaaaagagtctgggacaatagtctcttatatccaaaaaggcaacggatttgccgttgcttttttggatggttacgatagtcttggtaaaatagaattgcccaataaaccatttagaaaggctatcccatgcatattcactataacacaaatcaaacaactttaccactagaaatcagttccttcttaccacaagatcatctcgtttttactattgaaaaagtggtgaataccttggaggaacgtcacttctacacctcctatcatgcctttgatcgcccgtcttatcaccctaaaatgcttgtatctactcttctatttgcctattcacaagggattttctctggtcgaaaaattgaaaaatggaagagttagtgaccttagattgtttgtttattgacagaactaagattgaagccaatgccaacaagtatagttttgtgtggaagaaaacgacagagaaattctccgccaaacttcaagaacagatacaggtctattttcaagaagaaatcactccccttctgattaaatatgccatgtttgataagaaacaaaagagagggtataaagagtcagctaaaaacttagcgaattggcactataatgacaaggaggatagctacacacatcctgatggctggtattatcgttttcaccataccaaatatcagaaaacacagacagactttcaacaagaaatcaaggtttactacgccgacgaacctgaatcagcccctcaaaagggactgtatatgaacgaacgctatcaaaacttgaaagctaaagaatgtcaggcgcttttatctccccaaggtagacagattttcgctcaacgcaagattgatgtggaacctgtctttgggcagataaaggcttctttgggttacaagagatgtaatctgagagggaagcgtcaagtgagaattgacatgggattggtacttatggccaataacctcctaaaatatagtaaaatgaaataagaacaggacaaatcgataaggacaatcaaatcgatttctaacaatgttttagaagtaaaagtgtactattctagtttcaatctactatacaataagagaatgactcaaaattaaaaagctagagttccacaattggaaatatctagcttttttgtggttgagaactattttgtctcaggctctttatcttctatttaggacaagagtttttctttggtctttaatgataaagaaggtatcaaaatttctagtcttcttttttacctttagtaactactaatcctgcactcaaacctagaagagttaaacctgctgctactgctgcttggcttgccgcactacctgtacttggtaactgggctttattagtttgactagcttcacttgaatcaattggttttgtatctgctttttctgacacttgtggttttttagcttcttgagctactggtttggttccaaccaagacgatgcggtctgtcggaacttctaccacttcacggagtttttcttccttacttccatcaggattaatcgctgtaaagatacgttcttttccaacttttccttcttgttctacacgagtttcacctagatacagtgttgaatcttttttctcaactgtcttgtatgccaaatctttttcaacaaattcgatttttggaagatcttcttgtacagcagcaactgtcttctcagaaactggtttttccttagtcaagtggatacggtattccttgacttgttttccactttctgaaacgaggcgaacaagtactggaaagctatcttctccactatctaccacagttgaagctacttgattgttttcttcaactgagacttttggccgttgacctttataggtaatttgatagtcttgacgattttcagcgaaatcagcaagttcttttccatctacaagaatctttgattgagtgctttcttgaggcaattcacttggtgcaaggaaggtcatctcaatcatcgcaacaccgctcttatctgctttacgctccatacgccatctcatagctttggctttgatagctttaaatgttacgttgatttcatcaccagctgcaatgtctttatccgcacgataaggaacagcttcccaattttctggattgttgaatggatggtctgcgtcgtaggcttggtagtttgaatagtaggttggcacttcaaactctggaccgacatagcgttctaaaacgagtttagatggtgcatccgtaccactatctgcaaagaactgaacttttccttgtgtaacagtccgttctacaatcttaccattttcacggaaaatcacacccgctgatacttctggattagaagatggtgttggtgaccagtttgtccaacgacgattttctgaatgatctccgtcattgagatagtcaacgcggtcatgagagtttttgtcaatatcattggttgctgaagcaaaggcctggttactgttttcatcatagttagggttatctgaaagagtctcaccaagtttgtctgtcactcgtacagtgatctcagcaacaaggttactaccaaggacacggcctcgaacagtaaattgacctgcttttgtcagattttccgctggaacttcttcccattcaactgtcaggtcttttgtttcgtagccgtctttacctgtgaagtaaactggaaccttagtcggcaattcaagtgcttgacctacttgtagcaagcgagcttgtttaaccgcagcaactggtttatgagaaagtaagctcttatccttagtgaagtgcagacggtattctcctaagatgtcgccattttcagctttcgcgatgacacgaactggctcaccttcacgaacgcttggaacgacggtagcgagaccattgttgctaacacttgctgtgactgccggaacttttccatctacagactcaaggtagtagtctgtcaaatcagggttgaagtttgctaagtctttgccgtcaacttggattcttgtttgtccttgcttggctgccgcaacttgtttcgcaaagatttgtacctctgtgatagacgttccacgcttgttatctgctttaaccatgcgaatacgaacagcataggtttcaactttatcaaagctaaagtggttcatttctccagccttgagttgagcaggggcttttagattagtaactggtttccagttggcagaatcattaaagacatggtcctcattaccaacaaaactagggtttttaggagctgttgggacagtcttaccaacataatactcaatcacataagacttcggtacaccaactccatggtcttcatggaatccgacacttagattatcaacggagcgtttgctcaagatacctgaatctccaaacagaacaccgactgaagcttctggattagtacgattccagtttgtccaacgattggctggttggttattgtaggaaatgagcttgtcattaacatttgaaactgggtcgcttggatttgagtctgaagcaaaggcaagtggcaattctgaaccggtccattggtcagaaatgtttgcaccttgctcagtttgagcagatacgcgaacatgaagtttagttgttaattgcgtaccttctaagcgaccattaactgtaaagacaccttccttagcgtattgctctggacgaatcgcatcccatgcaaccttagctgatgaaacgtgaccatttgaatcatatgtccgaacactttctggtaattgtggtgcttctgcgattggagttgtcacactgacttcttcaactgaaacgataccttctacagagacttttgcacgcgcttcaaggtcaattccttcaactttacctagtacttcaaatgtttgataggagtctagtttttctttcggaatagcttgccaagtgactttatgagttttagggaaacctttgtcatactcaactgttactgttgctggaagacttggttcctgatgcaaatctgtcactacatttacaggacggatggattgcgcaatcttcttctcagtattggcttggatagtgagttcaacttggtctttagctccctcatattcagcgttcagagtgactgctcctggcttatgcaactcaagcattcctttacgaattgcgacttccccttcaccacttgtagagaaggttactttatcagctggtaatacagcttgcgttccatcttgatagtgagctcgaaccgacaatttgacagtttggtcttctttgagactgtcagctttttccacttgcaagctcaagtgagcaatttttggcgcttcttcaaggaattgaattgcataggtttgaagagggccaccatctttaggctgaataaagatgctcgcacgcatgccgtttgctgcgcttgcttgaagaactgtaacagctgcatttttagcacttgctgtgacttctggcaacttagctccataagcaagagtgcggtattgcattggtttttgactagtaagacctgttactgcctcaccaccaaccgttacagttggtactgcaggtgccgcaggattgccttcttctaccacaagggttgcatgaattggttgaccttctaaataaccggtcgcttgaatacgagaacctggaattgctaacttagctttatcttcttcggcaatctcccacttgtccacttcatactcttcaacacttccatcaatcaaaacataggaaacagatttgtctacagaattcaagtcagtatttggagcaatacgtttcacaactggtagctctgatttaagagcaatcacttctacacgagcttctacttctcgtccgtcagccatacctttcaccgttacaataccaggcttgctcacatctactgaagaccaggttacaggacgttctgcacggctaccatcactgtatacaaacggaacagtggtaggcatttcaggtgcctctccaataatggtctgtacttttggcacttctgtccccaaaacagtcttctcttgtccttctttcttaccagtaaagacagtgacttggttcgatttcaagagatcagagtgggcagtcagggtgaatttccctgcttgttcagttgatttgacaatggcaacacctttaccattaaatgctttacgaatccaagaaccatctgcttgcgccttatagcgttcacggctggcttgttctccgttatctacaccgaccagttgaccttggccatgcaattggaagcgaaccagattattagcagttggaaccacattcccctggctgtcaacaatttcatagtagatgtaagtcaagtcttttccatctgctgcaatcgcatggtcttccttaataagacgaactgccgctggcttaccagcagtcgtaatcttatctcgagcaatttccttgccagattcatcacgagcaattgcttccaaggtacctggttgataggcaactttccattcaagataaagttcattagcatttgcaccttcttggtaagtccgcccatcgctggtttgttttttattgaaagtcttaagaccaagagattttccattcaagaacaattctacactagaagcattcgaataagcacgaactggaatcttaccttctgagtcagctactttggatgctaattctttgttttcccagttccagtgaggaagaaggtgtaccatcggtttcttcttaacagaaacccattggctttggtagagatagaagtcatgttttggaatgccggctgtatctacgataccaaagtaagagctcttaacaggagtttgattttggttgtgccatggtgtaggttcaccaatatagtccgtacctgtccagataaactgtccagcatagccagcgttgtcacggtcaaaagtccatgaagcggttgctgttttcccccaacccacacgatcatttccataatctgactgttcataattacgctcaggtccattgctatgtttcaattcacgttcagggcgatagtaacttccacgtgtacgggtagctgaagatgtttctgatccataaatcaaccattttggatgcttagctctaagggctttgtaattatcttcagaatagttaaatccaacagcatcgagttcatcagcaattttctcatgccctccgctaccattaccgaaacggaatttatctgctcccatggtaacatagcgagtcttatcaacatccttgataaccttaaccaaacgtttaacagttgctaaagagtgggcatcaccattagcttcacctatttcattaccaattgaccacatgaagatagcagggttgtttttgcctctttcgaccatggtacgtaggtcaaaatcagaccatttttcaccttttcgagcttctgggtgagtggcatctttttcaaagaaacgtccatagtcataaggtttcttgccaccataccacgtatcaaaggcctcttcctgaacgagtaaacctagttctgctgcgatttgcaaggtttgctcactagcagggttgtgggttgtacggatggagttaactcccatctccttcatttgtttgagacggcgatattctgctttatagttttcttctgctccaagcgccccatggtcgtggtgcaaggatactccatggaatttaatacgttcaccattcaaagagaaaccttcatttggagtccagtgatagtaacggtaaccaaacaaatccttcttagcatcaaccaattgaccgtcacggtaaacacgcgtaatcaattcgtacaaggcaggtttgtcatttaaaacagtccagagttttggtctttcaacttctaaaatcgcatctaggcttgttgattcatgtgcttttaaggtacgactcgctgtacgaactaagcctgttacagcatgaccacctcgttcaacgatttgatattcggctacaagttcatggtctttgtcgtccgtattgacgattttgctggtcacatgagtttcaaccttgccatgttgttgttcttcaagttttggtgttaaaatagttgtcccatttttctcaacatgcaccttatctgtcacttgtaaagtcacatcacgatagataccacttcctgaataccaacggctacttggctgtttgttgactgcatggacagcaatcacattctcacgaccatctttttgaaggtatttggtgatatcatatgagaactggttataaccatttggataatgccccactaactgaccattgacataaacttgagaatccatgtagacgccatcaaaagtaaggcgaacatttttcttgaggtctttttcatctagtttgaaagtcttgcgataccaagcttccccaccgttgagctgtccaccttcattttgtgcaggagattcatgatcgaaatcgttaaagatactccagtcatacggtaaatctaattttttccacgtagatacgtctgcatcaggtttaatggcttccttagaatttgcattgagtttaaagtaccaattttgattaaaatccactttcctgtcttcaatcatttgattcacttcttcatttgttacagctttagcatcttccttgagcggtttttcttgatttgaagcttgtgattctatccttggagctttttcttccggtttagcagacactttttcctcttttggagttacggcttcatcttctttcttctcagatgcaatagcctcagttgaactaggttcactttgttctgtcctttcaactatatttttagtttccaaagctttatcagccttttcttctactatcattttttcctctttaggtttctcagcagtatgagtaataagtgtttcatccgcataaactacagattctccagctatatttcctcctaataaaactgcacaagtcccaatcattactgagcaagctcccacagcaaacttacgaatgctataaactcttttccgattccaatggcctttccccataaaaccctccttatattatatttagtgcagttagctactaccaaagcccaagtggtatacatggtatgacaacctagtttcaacaatttacactctgcgaaaatccaattcaaacttcgtcagtgtcgccttgccgtagatatgattactgacttcgtcagtttcatctacaacctcaaaaccatgttttgagctgacttcgtcagtttcatctacaacctcaaaaccatgttttgagctgacttcgtcagtttcatctacaacctcaaaaccatgttttgagctgacttcgtcagtcttatctacaacctcaaaactgtgttttgagcaacctgcggctagcttcctagtttgctctttgattttcattgagtttatattttataggagcgcattattttgcttttgctgcgtactcttcgttacgtttgatcatttgttttctgtaccaagcaaagataccgatatagaatacaaggaagactactgcaccaaggattgctttgatatcaccagttgtagtgttaccaattgtccaaccaagaagtttttcgattggtccttcaagagtagagtgagtaatcaattgagtttggctcacaccttctgggaaggcacctacacctttagcaagttctgttgcaaatggtgcaataagtgtacctgaaagaaggaagagtggcaacaagagtgttccgaagataatcatacggagcaatttaccacgagttacaaccaagagagctggagtaacacccatagcgatgatacctgcaagtggcaagataccatttccaacttttgaaagaagcactgcttcaatcaacatgattggtgcaagtacgttggcacaagcccagatttcagcacgaccagcgatgaatggccagtcaagaccgatattgaatttacgtccttgaagacgtttagtagcaacgtttgtaataccttgtgatagtggttctacggctgcgatgaaccatgaaccgataagtgagaagagttccaaagatacaccggcagtcaaaccaagagacaaccatcctttgataacaagacgccatttatctgcatctgcaacacctgcaattggatgtggagttcccataataccgataacgataccaaggatgaaaccgatgaagaatttagatccccagaaaccgattttcttgttcaatttagcagcatcaaagtcatatttatcaaggcctgggaagaatttttcaaaaatcttatccaaaaccatgataactgggttcatcatgtagttcatgtgagttgatgtcattggtgatgaacttggggcgttaagaaggtcatcaaatgtaggtttcatcaagtcagagttgataattttcaacacaccgacaaggacgatagctgctgtagcaataaagagtgaaaccccttgactcacaccattgttatcagcataccatttaatcaagagacctgtgatagacaagtgccagatatcaaagatatcgacatcaagtgtatctgttttcttcatagctagcatcactatgttgacaatcaacatgatgagcaagaagtatagtgtccaagcagaaccccaagtgattgtagcaagtggtgcccaaccaacgtcggtaatactcaattggataccagtgttttcaacgaattttgctagtgatgctgagaaagcagtgtttagcataccgatgatagcaccgatacctgtaagagcgatggcaagtttgataccaccttcaagcgctttggagaatttcactccaaaaagtaaagccaatactgtcaaaatgattaacatgatgacaggtccacccatttctaagatgggattgaaaacctttccgattaggtcaaagattgcatccataacagttcctccctttttgatgttatatgaatgttaacaaattagaattagcttaatccgtgttctttaatagctgcttcaatattgtcaaatactggagcgctcattgctgggatacggaataagattggcccagcttcgataactgggatacctggttcaaaaccaaggtctgttgcagcgattggtgtaaagatatcgtaacctttcataaggtcttcgtttacatctttcaccatgactgcatcacagtgaacatcataaccacggtttgaaagttcttcttctagagcacttttaatttggtgacttgagttaacacctgcaccgcaggcagcaagaattttaatcatttagatttcctccgattttattttttaatagacaagattaagcggttgcttcagcaatgtaagtataaagggcttctggttcagaaatttttgataggtcttcaagatgaccatttcctgtgaagaagtccattaactgagcaagaatgttcgtttgacttgaacttgaattattaatgataaagaagagtagggatacttctacttccttatcaggagctatcatattgtgaaaagttattggtttttctaatcgaacaaccaccactttctcagctagattatgaacaatatctgtgtgaggaatcgctacatttggcaagtcctttcctagaaattccatatctaaaccagttggaaatgacttttcacgcgtgatcaaggcttcacgataagttggagtgacaatttctcgttcttccaataaagttgcaacctgatcaaagagttgttcttgactatccgcttctaagcaaaacacaaggtttttgtcaaagaaataatctaataccataagtttttccgg

SEQ ID NO: 140 - DNA, 28882 bp; double-stranded, linear
taagactatttaatagtggagtgaaataggatacgaacaaattgattaggaaaatcaaatgaatttatagaaatcttttagcagttatgttatcctattctagtttcaaaacgctatagaagcagcattgtgctagtckagattcagtttactatactaaaacgagtagcttgaaatcaaaaaacccaccctcacaggcaggttttatctgtattattcagctagattatgctttaccttctgaaccgaatacgtcgatacgttcttcaaccgatgcttggatagcttttacaccgtcagccaagaatttacgtgggtcgaagagttttttcttgtcgtattctgcttcgtttgcttcgtagtcacgagcaaatttacgagttgcgttagcgaatgcgatttggcattctgtgttaacgttaactttggcaacaccaagtttgatagctgcttggatttgctcatcaggaatacctgatccaccgtgcaatacgattgggaatcctggaagagcttctgtcaatttttgcaagtggtcaaggtcaagaccttcccagtttactgggtaaggaccgtggatgttaccgataccagctgccaagaagtcgataccagtttcaaccattgctttagcgtcttcgattggagccaattcacctttaccgatgattccatcttcttcaccaccgatagtaccaacttcagcttctactgagatacctttagcgtgtgctttttcaacaacttctttagccaatttaaggttttcttcaactggaaggtgtgaaccgtcaaacatgattgaagtataaccaacttcgatacactcaagtgcatcttcgtagtgaccgtggtcaaggtggatagctactggtacagtgatacccattgattcaacaaggttagcgatcaagttgcgagcaactttgtaaccacccatgtatttagcagcacccattgaagtttggatcaaaactggagcttttttagcttctgctgcgcgcaagatagcttgagtccactcaaggttgtttgtgttaaatccaccaactgcataaccgttgtcacgggctgcttggacaaatttttctgctgaaacgattgccattttatcaggcctcctgtatatttttatgggtcatcccatttacattgttcattttatcactttttgccaaaaaaatctagtttttcccgcagtttcgattgattttcttctaactccatctatgtaaaccctttctctccctagtcttggacgacttttggaaaatctataaagaaggttaaactattctcctccatctcgaaacgataagctaatttttcatgttctaatagactcttaaccacaaagagccccataccagaccccttgaccttgcgactggcattgtcagaaaaagactgggctagtttttcttgttcctctgagctacagctattttcgataaaaagttctccttctctttctccaattcgaactaagccacctggaacagagtgcttaatggcattgctgatgagattagaaagaatcaacttcataactgatgggtttagataagcctgctgatgggtcaaactattgtctatctggagctctctttccttggctagcaaggcataatctttgaccagattttgcgtcatctggaggaggtcaattgtttccctatcatctcgcaattcctgcacagaagagagggaaagtatctgcagaacatggtgattgagttcatccacaatccccaaggcaactcccagatactggtctctatccttataacgaccgatattctctctcatattttcgattaggattttcaaactagccagcggtgttttcaattcatgagaagctcctcgtaggaattcgaccttcatcttctccagctggagaatggcttcattcttttcatgcaagtccgcaataacagtcaagagatgctggtagaggctattgatttgttccttgagattacctatctcatccttagaatccacgcgcaatcgcacttgggaatccaggtccatcatccgacgggtcacccgcttgatttccaaaatcggtgcaacaatagtccgagcgtagatgtaggccaccaaaagggaaatcagaaaggaggccagcaaggtatagggaagaaactggagactgatttgctccgcttccttttgtaaatccatggaagctagaaactggagaatcatagtaccaccgtcttgcgttttcacctcgcgctcctcaataaagagagaggttgtctggcggtctgtgtccagaggaagactgtccttgacttctaacttgtcctcggtcatctcacctttgacggtccccttgatatcactagtctgggaatacaagtctaacacttgctcgatactctgcctatctttcccttctagggactgggcaatggctgttgccttttgaccaatggtttcctgacgatgactcagataagtcgaaggaaaaagaaaataaatagctaaatgaaggcagataaccagaacactaaatatcgagaaggtatagataaatatctttgcaaataaacctgttcgtttcattttcgctccaatttataaccaacattgcgcacagtgaggatacaatccaagtctagctttttccgcaattccttgatataaacatcaataacacggtcaaagggaacctcatctgtcgctttccagacggcatcgataatctgagatcgagtcaaggcccggccttcatttttcactagatagtccagaatttccaactctttggcattgataggcacttcttgacctgcgaggcttgcactgtagctttcaaagtccaccttggtatccttgtaagaaaagattcgtcctgtatcgtagtagcgcttgaaaatcgcgtccaccctcacttttaaaagggagagggagaaaggtttttccagatagccatctgccaaagaggcaaaggcactcatcttgtattcctcatcttgaaaagctgtcaacatcaagacaggaacctgactggttttacgaatctcagctaggacttctaagccgttgagcttgggcatctggatatccagtaaaaccagggccacctcatagctagaaaattgctccagagcttcctgaccgtccgctgcctcaatagtttcatagccacaatccgtcaaataatcactgaccccctcacggatcatctcttcatcttctacaattaaaattttcatactttaactgctctctattttttatttttcttagaataaatacctaccctattttctattatagtctcttgctggccttttgtctgcaagcaactgaccactagataaaacgttgtgaaattcctttctcataaattccataactttagtatattatatttaagcactaaagtacaaagaaagcaactgaaagcaatgattttcaccactgctttcggatttattttgaattgttaaatagccattcctatccactattcttgaatagaaacacaagatgcaatctttattctagactcattttttcaaatttattcaccatccagcaagagctcttttggttgttttctaaggagattgcttgaagcaagcgccataacgagaaccactagaaccaaggcaaggacaaaaatgatgataaagtctgatgtctgaatggaaatgtctaggctcgacaaggtcttgctaaagccatctacttctgcaccaccaccaaggttagaggcttgagccgccttactagcctgtttggcaacacctgaagtcacattggcaaggacagtgtttccaattgcacgggcagtgtaattagctaggaagtaagcagaaactagagcagggatagcaatcaagatagattcggtgatgaattgacccaagatacttgcctgcttgaggccgatagagaggagaattcccacttccttgcgacgggcgttgatccaaaggctgagcaagagggcaaggaggagaactgagaagctcaagctaccccagaagaggaggttggccatcttgtacataccagagatagattgctcaagagctgggtagttagaggagctcttgacgagtgtgtagctcttccagttgataccactgatgccattcaactctttcataacatcatccaagttcttgtctgctgttacaaagaaggttgcgtccccataaatggctgtgtcttctgtgtatccataaagttttgcagcagtgtgaatgtctgtaatagctgtgttttcgtaaagttcttgtgagtaggttactgctgacttattatgaccatcaaagagtcccttgattgtcacttcaactgtttccttggctcctttttcattatctgcatcgtagatattagagtccagtttaaccttgtcccctactttccagccgtgtttggctgccaagtccttgtgcaagaggattttatccttgtcgtcgttggttaagtgctctccttcgactagtttataagaaccagagacaaacttgtcttctttagaggagtcattgacacctgtaatcatcaagctacttccaaaacgcttggcacgatcagcagtgagattcttcttggtttctggcgtttcaatcaggtcatatccagtcaaatctccgatagcgttgatacgtttgacataagactcaatggccttgttttcggtgatttttttgatgtcttcacccttgatattcccagcaccacgaggcgttccttggttgacgcgacgattgatttgcatggagaagctattggtgatatttttaaaggtctcctgagaagccttggcagtagctcccttgattgacaagccgaccaaactcaagctcgccatgaggagaataatcaggaagatgacaatcgatttgaaaaacttccttgtaacataggcaaatgcgttgtgtaacatagattccctttctagattttgttttaatcattctattaaaataagctcaaattatttactagtattgcgcgtttcagtcagtttcttatcctttaattcaagtgtaatatctgacgcttgtgccacttctttactgtgagttacgacaatcacacatttacctgttttctgggcaagtgatttgagtagttcgacaatatctccagcagttttaggatccagatttcctgttggctcatcagctagaataactggagcttctgagaccaaactgcgagcaatggcaacacgttgctgttgaccacctgataactggagaacattccgcttgatctggctttcatccaaaccaagctcaagaagtgtattcttgcttgcctttttgttgaccaatcggatattttccagcggagaaagataatctatcaagttataattttgaaagaccagggaaatatggtgcatgcgatggtaagaatagcccttcttacgaatatcctctccttgaaaaaggatagaaccttcaacaggactatctagaccagcaagtagggacaagagtgtggattttcctgctcctgactccccaataatactgtaaaattttccgggttcaaaattataattgatctgatataggactgcttcagcagtattcttataacggtaggtaacatcttgtaattgtaataaagtcatgatttctccttcttaactaatagatgataaaatttctttcggtgattttctaaataagaataggaaacaaagggctacagataagcaactaagcagaactagaaaaacataggattctgcaaaagataagatgctagttgataaactgcttgctttggctagtgtatcttgtaagcttgcctgatctccacttgctagtagagtttggagtaggtaagttgtgattgcgtttcctgcaacaaatgctggaagcaaagctccaagagataccaaaactacctctaaacagaattgtaggaagatcgagctcttgccttttccaagtgcaagtaaaatccccacttcatagacccgttctctcaaccagagagacaaaaccagaattaaggctccagctcctgctatcaacatcccataaaggaagatggtcaggaaggtttggaaagttgcaactgagtctttgatttgttcaaaagccttgttttccttttcgacttggtagccttgattttccaaggccaagttttctacctgcttcatgagtccgtccatttccttaggattttctacatagaagcgtgctgcactgacttgagcttcactattgcccaaaagggtttggctactttcatagtctgtaaagacttgattttcactgaagtcagaagacaagcctgtgaatttctcttgttttttaccagaaaagatgccgataatctcaaactctactgtttgtccttttccagattcagactgaccagcatccaagccaatcttgtcatgaagcgaaagaccgttcttcttagccaattcttcgtggataaggattttcttggaatcccctttttgaaggtgtcgcccttcttttagattgaaagccgaactggtaaaggttacatccttggatgaatcctcaagagccgttaagctaaccaagttattgtctgcagctgataaatcatcacgctccacgctctgctcgccagtcactgcttccttgtcttttagttttgcgaccgtctcaagttcaggagagacattttccagccccttaatcttgcttacagatgctaggtctgacaacttgaatgtctgaccattctctatcttcttaatagaaaaagatgtattgagtgatttataaagattgctttctactgttttgttggacttcatcagagtcaaacaggctgaaattccggccaataagaccaataaaatcagaaataaaataaaacttctcagtcgctttctgctgacataagcccaagatctttggattggattcatttgtcacctccatatttgtaagactattataaaacccaaatatgaaatatttatgaaatacgaaaaaaaaatatcgagtaggggataatctctagcccctctcacaccaccatacgtgccgttcggcatacggcggttcaactaacttttaacgcatgtcgttcaaggtaataatccaaacacgaaaccagtccacgtttttcaaggactggttttgatatagcacgtttaagtaccgacttctgagctactatagtagattgaaactagaatagtacacctctacttctaaaatattgttagaaatcgatttgactgtcctgaacaattcgtcctattcttatttcattttactataattgatagtggtcgccccagccagataccttatctgctatccatttaggaacccctaacttaagcaatccccataatcgtctcgatttcttcttccattgcttccagataatcactcgtaggcgagtacgcaagcgctcatctatgctagtgactatacttttcatatttataattcattcctttcgtttcactcaaggcacaacacagaatgaaaaagtgttgtgatctttattttgttttataataatagtgagaaaacctatcactactacaaatcacggggaggtgaataagtgagtggtacagccactacctcgcatattttgtcacatcatttaacggtacataataagttgtaccatctgaataagttgctacaatatcatttgcatgctctccttcacctttagcaaaggttggagctcctgctggatgatttttatttgcctctttcaatttttcaataatggcattttttctgtatcttttatattatcaggatttttcactaagattttgtctggatatgtcggtttagcagaaacaatttttactgttacttcttttttattcgaagcacttgtccagtttccagcattatctttagcatttaattttacagtaattcctgaactaggaacttcagtagcaggttgattatcaacattattcaactttaatttcaaaagagctgttgcatcagacgttttatcaatcgttatatataatgatgaattgttattataaacagttccttcatatttagctgtttgtgagctacttgaaacagaactgaaattatacccactacctccctgattatcttcaatgcttacgtctaaatgaacttccccactattatttggcttagcaacaactgttatagtaaaataacataaaatttgcataaatagattagggaaatcaaagcagcttctaggaatgttttagcagtcacagtgtactttcccagcatcaagccactataactctgcacataaaaatggagaagatggcaatcctcttctccaaatattaacttctttacaaaccaactatagttgacaaagaacctaaaatcaattgataacacaaggtcaggtcggtcaactctttcaactgaagccctgtcaactcttcccatttatcaatcttgtattggagagaattgcggtgcagatagagttgctgggctgttttagtgagaacagcactattttcccaaagagagagaatgatttcctgaatctgatcttgatccaaaatcatctggtgtagacattccttgattggcttcaagtccacgagtctttctcccatactccaaagatagagctgagaaaaagtatgaacaccttggtgaccctgacgccaccatgtcttgaacaaatcccgctcagctttgattaagtctgatagggcttgatgtcccgtctgagaccaaacctgacccaacatgatagaaagacgaagtccaaagtcatactcaaccgcttcaatcgtatcacttaaaatatctcttacagaagtgtatttgtcttgttgaagcacgaaaacataatcctgagctccgacctgtagcactgtctgacaattcggaaaaagagtccgcatcatatctagccaagaagccagattttcctgctgaaaataagaaagatggcaataaaccaactgaatctttttaaaaacttgcggtgcctgtcccttgccctcaaccagataggaataccaagggtttagcgaacgagcctgctcctgctgggtcaaaagggcaaccaactgcttttcacgctcgctgagcccagcttcctccagcaaaatccactgctgagaagctaaagggagcgtgagatagccctctttctctactggttggtctgaaatccgagcctcaggaaaccagtcttgtagttcttttgccctcatgttctagccctccactttttggatgcaccatgaaaccaaactctcaagacgttccagattctcagtcatatggagatagcccataaccgcttcaaatcccgtggacatacgataagtcacgacatctgcatttttagcctttgtgtggctattggtattgcggccacgtttgtagatttcttcttctttttccgttaggacctgctcctccaacatgagagcaatcaggcgagcctgagccttggctgacacgtacttagttgcttcttgatggagtttattgggtttggtcatacctttgaggatgaggtgacggcgaatatacatagaatacaccgcatccccctcaaaggctagcgcaatcccgttaatgagattgacatcaatcacgtgtccacctcactccatccttggtatcaaggagcttaattccttgagtaaccaattggtcacggatttggtctgctgtcgcaaagtcacgattggcacgcgcctcttggcgtttttgaatcaagtcttcaatctctgcatccaaaacttcctcaacaaagacaattccaaaaatttctaacatatctgcaagagcttgcttgacacttgcatcatagttccctgagttgatccatttggccatttcaaagacaactgtgataccgttggcagcattaaaatcttcatccatagctgctacaaacttatctttaaagttttgtaactcttgggcatccacatttcctgtaaatggttgttcgtaagtattcttgagatacttgagattggtctcggcatcgcgaactgccttttccgtgaagttgataggcttacggtagtgctgggtcgcaaagaagaaacgaagtacttgcccatcaagagttttaagggcatcgtgtaccgtaatgaagttacccaaggacttagacattttgacattgtcgatattgacaaagccattgtgcatccagtagttagcaaaagccttgcctgttttagcttcagactgggcaatttcattggtgtggtgtggaaactctaggtcagctccaccaccgtggatatcaatggtatcacctaaaatctctgtcgacatgactgaacactcaatatgccaacccggacgtccaggtccccaaggactatcccaagaaatctcacctggtttggaagatttccatagagcaaagtctacaggattttccttacgagccgtttcttcatcggtacgacctgaagcacctagctccaaatcttccaaggttttattagccaatttagcatagttgtgggatttttctacacggaaatagacatccccttgactctcataggcaaagcctttctcgatcaagtcttccacaaaacggatgatgtctgccataaactccactacacgcggatggcgagtcgcaggtttcacgcccaatgccgtcacatcctcacgaaaggcagcgatgtacttatccgcaacctcctgaggcgtgataccttcttccctggcacggttgataatcttatcatccacatctgtaaaattggaaatataggcaaccttatacccacggtactcaaaatagcgacgaatcgtatcaaaagctaccgtcgaacgggcgtttcctacgtggatatagttgtacaccgttggcccacaaacatacatcttgatcttgccgtcctcaatcgggacaaattctcgcaaatcacgagacatggtgtcatagattttaatcataaatcataatcaggaaagctgaaatccaagaacaattagtttcatcactaaaagttcaagtaaatttcagtccgaatatctctacacttcggaatcccttgctcctttctcattcagataaaccacctgagtctgtttgacaaagccaattttttcatacaaacgtttggcacctacattgctatcttccactgcaatctgaaattccttgtcattttgctcaattagttggttgacgagggattttgctaagtagcttccatagccttttccacgttcaggttccaatattgctaaaccgtagaggtaattcgtattagtcgataaatcaaccgtacaagttccaataacctgaccagcttttaataaaatatatagtcggctttctggatctttcagagcttcagcgacatatctatccacaacttctctcgattcatgttcctctgaaaatgcctgaaattttaattgactaatttgatcctgatacgaactatctgctaacaaaacttcaagatgggaaacatttgctaacggataaggtcttctatccttacctaaccaagtttctgtctcttcatcctcgattagtccccagttactggcaaagtcaggatgattctctaaaaaaatacgttctgtctgaaaagtgactgaccgaatggggaaagaagctgtttctctctcaaaactagtaaacaatgcacgcgcaatcccctgacggcgatgacctggatgaaccagtatcgtcacttctacatcttggtcatctgcatagacagttaataaaccaacaagttcgcctttttcataataaaggaaaaaggcgggcatgtttgggtcaaaattaagcatgttagagagatagggatcgcgataggtaccgtcatagttttggcaacagttaattacttttttcgcctcagatagctcctcttggcttaacttgtttcttgcttgaatcatataggtatcctctacaaaccagacgatctgtgactggcatctttagcctgctcgagtttattgacataatactctcgtttttcttcgacttcgtgaatgacaggctcatctttcttaccatgaagacggacaatcttggccggaataccgacaaccgtcacgtcactaggtacatctgctacgacaactgctgcagcaccgaccttggcattttcaccaatttccacaggcccgataacttgggcatgggctgatatgagggctccctttcgtacagtcggatggcgtttgccacagtctttccctgttcccccgagagtcactccgtgatagagaagaacgcctttttcaacaatcgctgtctctccaatcaccagaccagaaccatggtcaataaaaacacctgaatcaatctgggctcctggatgaatctcaatctgagtccaaaagcgccaaaactgactgtacatacgagctaatagtttgaagccgtgcttccagagaaaatgcgagagacggtgggccgccaaggccttgacacctggataagtcagcaaaacctccaaagtggtgcgggccgctggatcattttcttttacaatatcaatggtttcgcgccaccaccccatacatttctccttttcttattctgaatcttttgatgtttctgtaaattctttcttaggtttgtaatccttttgatgacgtgggcggtgagggcgctcagacttttcacctttttcatcatgctcaggttttggcggacgaggtagaagagccttcatagaggcatcgatacggcctttttcatcaattttgataaccttaacatcaacttcatccccgatttctaccaaatcctctacacgattggtacgagtccaagccatctcagagatatgaacaagggcatctgtcttatcaaagaggttaacaaaggcaccaaatttctcgatacgaacgactttagcacggtaaacttcatccactttggcttcacgaaccaaaccagcaataatttctttggcacggttaatagcatcttggtcactagagtagatagacacatttccttcttcgtctatatcaatcttaacacctgtttcagcgataatcttgtcgatggtttctccacccttaccgatgacaatcttaatcttgtccacatcaatcttgatcgtatcaattttcggagcagttggagccaattctggacgaacttctggaatggttgcttcaatgacatcaaggatttcaaaacgcgctttcttggcttgagcaagagcctccgtcaagatttctgcagtaatcccttgaatcttgatatccatttgaagggctgtaatcccatcacgagtacctgcaaccttgaagtccatatctccaaagtgatcttccaaaccttggatatctgtcaatactgtgtagttatttccatctgagataagccccatagcaataccagctactggcgccttgattggcacaccaccagccataagggcaagagttcccgcacagatagaagcttgagatgaagaaccgtttgattccaaaacttctgctactagacggatagcgtaggggaattcttccaagcttggcaagacttgagcaagagcacgctcaccaagggcaccgtgaccgatttcacgacgacctggcgcaccgtaacgacctgtttcccctacagaatattgagggaagttatagtggtgcataaagcgtttcttgtactctggatccaaaccatcaatgatttgagtttctcccatcggagccaaggtcaagactgaaagagcttgagtttgcccacgagtaaagagacctgaaccatgtacacgaggaaggaagtcaacaaccgcatccaaaggacggatttcatcgaccttacgaccatcaggacgcaccttgtcttctgtaattaaacgtcgcacttctgcgtgttccatttgttccaagatttcagccacatcacgcataatacggtcaaattcttcgtggtccgcatatttttcttcgtaaacggcagtcacttggtctttcactacttgagtcgcagcttcacgggccaatttctcttctacttgaactgccttttggaggtcactgttgtaggctgcaatgatttcagcttgcaattcagcatccacgtgaagcaattccacttctgctttttctttaccgacagcagcaacgatttcttcttggaaggcaatcaattctttgacagcttcgtgccctttaaggagcgcttccaacatgatttcttctgacaattctttggcaccagactctaccatgttgatagcgtgcttggttccagctactgtcaattcaagaagagattgctctgcttgttcttgacttgggttgatgatgatttggccatctacatatcccacttgtaccccagcaattggtccgtcaaatggaatatctgaaatagacagtgccaaagatgaaccaaacatagcagccattggtgcagatgcattttcatcataagaaagcactgtattgatgacttggacttcattacggaaaccttccgcaaacataggacgaatcggacggtcaatcaaacgcgctgtcaaggtcgcatctgttgaaggacgtccttcacgtttcataaagccaccaggaaacttcccagccgcatacattttttcttcgtagttgacttggagtgggaagaaatccccagttgccattttcttagacataacggcagcagtcaagacagttgactcaccgtaacgtacgacaacagatccatttgcttgcttagcaacctgaccagtctctacaattaactcacgacccgcaaaagtcgtttgaaacacttgttttgccattttaatcccctttggattgatgaaattatacgccttgcctacaaagatcaagataccaaggacgtcaaaagcaaagtaaaaataggaaactgacgaagtcttcgatgaagacaagacagtttatcttttttacacagcttttcggccgtgttcaattacacaagatattttggacggttcggcttgccgaacatttctgtagaaaaataggaaggtgacgtcgcactcgacgagtgctaggaagcttatcttttttcctaagaaatgagaccaaaattcaagtcatcaagataccaagccgtcaagcaactcaaaggaagataggaaatcgaacgacggagcgactactcctagggagatttatctttttccacagagttgtaggcaagttcagttttcaagatacatcattagaaaggtttaatactaaagtatctaaagctttcacgctaatcgctatcgggcgattagctaaatgctttactaactctctcgtcaaataacatcgatttgactcactcgtgtcgttaaatcttacagtttaaatgcattgtattatttaataccttcatctttgtatcaagtacgtacagaatttattttatcatatttttcttaaaaagtgaggtctttaccattaaaaaggaaccattcccctcacctgagaagaatggtttgcttttattatcctagagactggtgattaaacaaggcatgggttgcttgatggatgtattttgctgtatcagcattattcatcgtatagagatgcacaccggcaacatcctgagttaccaagtccacgatttggtccactgcataggcaagtcctgctgctctgagcgactcagggtcatgctcatacttgtctaagatggctttaaatttgcgtggaagatggatattctcacaagtcttcaagagtcggagagcctgatttcgattcagaattggcataattcctgcatgaatgggaacatcaatcccagccaagatacacttgtcctgaaaatcatagaagcgctcattgtcaaagaagagctgagttacgaggctcgaacagcctgcatccactttcttcttaagattttgaatatctgaaatctgatttggcgaatctggatgcccttctggatagcaagctccaataatatcaaagtgaggggtttgttccttgataaactcaatcaagtcggttgcatagcggaaatccttttgtggttccacgtctggaataatatccccacgaagagccaagattttctgcaccccaactttgtccaagtcagcaatagtttcagcaaccttgtccttagttagataaatagctggcaagtgggcaatggtcggaatcgccaaatcattttggataaagtcagccaaacgaaccgtcgtttccttgatattaaatttattattgctggcagttacactgataaaatggggagccaactcctgcatatcctgcaaggctgaaataatgttatcattacccacggctgggtttggagggaacacttcaaatgagagtgacggtgtttggcgtgacatatgtaataaccttttctagttgatttctttttgaacaaccactgtatggagagaaatccaatcttacaatttctcacgcgcagctttagctgcttcaacaaggcggatcaagctttcttttgtttctgggataccacgtgttttcaaaccacagtcagggttgatccaaactttcttgcttggcactttagcaaggatggcttcgattgtgttgtcgatttcgccttcatttggtacacgaggtgagtggatatcgtaaaccccaggtcccacttctgtttggaagtttttcgctttgagttcgtccaagatttcaaggtttgaacggttagcttcaaaggaaataacgtctgcatccatgttatcgatagctgggatgatatctgtaaattctgagtaacacatgtgagtgtggatttgtgtgtctggcgctactgttgagtgtaccaagcggaaggcaggaatagcccagtcaaggtagtcttcgtaccagtcgctacggcggagtggcaatttttcacgaagagcagcctcgtcgatttggatgattttcacaccagcagcttcaaggtcaagtacttcatccttgatagcaagggcgatttggagagttgaatccttgatagagatgtcttcacgtgggaatgaccagttaaggatggtaacaggtccagtcaacatacctttaacaggtttgtttgtacgactttgtgcatagctagaccatttaacagtgatagggttaagacgagtgacatcaccccagatgattggtggttttaccccacgcataccgtatgattgtacccatccatttttagagaagaggtatcctgacaagttttgaccgaagtactcaaccatgtcattacgctcaaattcaccgtgaacaaggacatcaaagtcaatatcttcttgccacttgatccattcgtcaatcgtttcagcaaggaaagcgtcgtactctttttgagacaattcacctttacggtaagccaaacgtttggcacgaacttcttttgtttgagggaatgaaccaatcgttgttgttggaagagctggaagtttgaaagcttcttcttggatagcttcacgttctgcaaaggctggcaaacgagtgtagtctgcgtctgtcaagccagcgatacgcgcacgaagttcagcattttcaccaacacgctcagtcgcaaagagttctttgttggctgcaagagcttctgaaccttgaccatttcggatagcatccaagtcacggatttcatccaatttttcaactgcaaaggcaaagtggttcaagagtgctggttcaaattcttcattagcagttgtaaatggcacatgaagaagtgagcaagagcttgtcaaaacgatgttttcagctggaatttgctcaagaacagccaagctcttttcgtagttgttgcgccagatgtttttaccattgacaatacctacatagagagtcttgtcagctgggaagccacctttaacgagttcaagagttttcttaccttcaacaaagtcaagaccgatagcatctactggtaagtttacaaggtcagcgtatacgtcacgaacatcaccgaaataagtttgaagcaagacttcaagaccttttttgtcagccaagagtttgttgtaaaggttcaagaagagagctttttcttcagctgtcaagtcttttacaagagccgcttcatccaattggatgcgagtcgcaccaagttcagccaatttagcaaaaacttcttggtaagcagccactaagctatctacgaagtcgtctgctttcacgccttcttcaaagtctgacaattgaaggaaagtgaagggacctacaagaacaggacgagtgttcaatccaagttctttggcttcttggaactcatcgaaaatcttgtgaccagccaattttacttgagtgtctttttcaaatttaggaacgatgtagtggtagttagtgttgaaccatttcttcattggaagggcgcgaacgtcccctttttctccctggtaaccacgtcccaaagcgaagtagcgctcaaggtcagacaagtccaagttttgaacggatgcaggcaccacgttgaaaaggaaagccgcatctaggaagttatcatagtgagaaaagtcatttgatggaatttcagtgatgcctttttctttgacaatgttccagtgtttagcacgcaagtcttttgctgctgctaaaagttcttcttctgagatttcttttctaaagtatttttcagttgtaaattttaattcacggaattcgcccaaacgagggaaaccgatgattgtagttgacatgatgtgtcctccaaaatttgttgttgaaactatcttaacagaaaagaaagcgtctgtataattgtaaaaaattagggtttgatatagtttgaaactatatatctgtttcggacaaaagaaaaagacttgaagcaaacgtctcaaatcctttgtaattcttactttacagctatattccaattagaatactaaaacatgttattagtaattcttataagtgactatgacctgttattagaaaagactataactgattctagtcaactttttccctgttcaagtgggacgattgctagtgtctttcctaaactggctaggacttttaagactgtatccaactgaggactagtctttcctgtctccatcctagctatgacaggctggcttattccactgacttcttccagctttttctgactgattccttgttcatacctagcctcaatcaactcgctcatgatagccactcgcatatcactttcaaggatttcctccttgctaaagagctcagatggacatccttccaattactcccaatagcactattcttcatcacttaaccctcttttttttacgtctatgtatttttaaaaaaatgagcgaattatgattcgatagattgaccagtgggtttaaagttggtgctagcctatttcttaagcgattttccttttctaggataaagcagttcctgcttgcttaaccccaattttccacgatgaatccaatagtaaatggttgaaattcccacgttaacccctttagccatcaccatcatttcaggcgaaaatttttggttatgtttttggttatgtatagtggagaatcttttcctttagtttcttaagactgttgagcgtagtcggcagaataaatctctttgaagcgcccttttccaagacattgtcggactgtcccacgcttgatttcagtgtggatagtttgaggagcttttccaagtagagaggcaatttctctatttgattttccttcttttttccatcgttcgattaagcgacggctatcgattgtcaaatgtttgccttttgtagtataattgtcttgcatttctgtgccttttaatcatttcaatcttaaattggactttttttacttgggttgtacttaatctatgaggaagacaagaaaaagaatatcaatcaagtaaagtcacaaagtcacattagctccgagcaaccattgcaaattgaggtactcacacaatgattaaaacatttctctctgccctttcggtcattctcttttctatccctatcataacttattcttttttcccatcttctaatcttaacatttggctatctacccaacctatcttggcacagatttatgccttccccttagctactgcaactatggctgctattttaagtttcttattttttttcctatctttttacaagaaaaataaacaaatacggttttactctggcattttgctcttactatcgctcatattactattattcggaacagataaaaccctttcttctgcatcaaataagactaaaaccttaaaattagtaacttggaacgtcgctaatcaaatagaagcacaacatattgagcgaatttttagccattttgacgccgatatggctatattccctgaactagctaccaatatcagaggtgagcaagaaaaccagagaatcaaactattgtttcatcaagttggactttctatggccaactatgatattttcacttctccacctaccaatagtggaatagctcctgtgactgtgattgtcaagaaaagttatggtttctatacagaagctaaaacttttcatacaacacggttcgggacaattgtattacattcgagaaaacaaaatataccagatatcattgccttgcatactgcgcctcctctgccaggtttaatggaaatctggaagcaagacttaaacatcattcataatcaattggcttcaaaatatccaaaggctattattgcaggtgattttaatgcaactatgcgtcatggagcacttgcaaaaataagctctcatagggacgcattaaatgcactgccaccttttgaaagaggaacttggaatagccaaagtccaaaactttttaatgcaacaatagatcatattttattgcctaaaaaccactactatgttaaagatttagacattgtaagttttcaaaactctgatcatagatgtatttttacagaaatcacattttaattattttatataaaatcacccctctaatgttcataaactagagggggaatttgtatcctactatcgtttaacgcacttctgcattgactttttcttcgagagacgcttggattttttccatatagcgtgcgacttcttcgtccgttaagctgtcttctggattttggaaggtcaagctataagccattgacttcataccaagtcccagtttttcacctgagaagacgtcaaagagtttgatatctgtcaaacgtttcacgccggcagcttggatagcatctacaacttcttggtgagtcacttctgccttgaggagaagggcaacgtcacggctgactgctgggaatttggtgatttccacaaatggaacagcaggttggagcgccccttcgatggctgaaaggttaagctcagctacatacgtttctggaatatcgtaagccttggcagtgactggatgcacttggccaaggaaaccaagaacttggtcaccgagtgaaatcacggctgtacgacctggatgaaggctaacgatttcagatgttgctgtataggttacttggagtcccaaacgagtaaatagggcttcaaggattcccttagcatagaagaaatcaactggaactgctgctgtttggaaatctttttcagcaaccaagcctgtcaaggcaaaggcaaagctgttgatctcatttggaagttcttcttttggattacctgtttgttcaaagacttttccaatctcataaagggccaagtttttattcttacgagccacgttgtaggcaacggtatcaaggatccctgaaatcatattttgacggaggactgaacgatccacagtcattggccacatgagttcagtaaggttacttggttgagctgtgaactcaactgctttttcaggagttgtcagagcataggtgatgatttctgtcaaacctgctccttcagcaatggtacgaacttgacggcggagtttttgtatcacagtcaattcaccagctgtaccatcgtcttttggaaggctggttggcaagcggtcatatccatagatacgagcgatttcttcaaagagatcagcttcgattgtgatatcccaacgacgacgtggtacgctgactgtaaagctgtctgcatttccagaaagaccaaagccaagacgacggaagacgtcttctacatcagcataagacagctcagttccgaggacacggttaacatcagcaagggttgaagaaacttccacatcagaggtatcaagctcacccgctgaaacgatacccttacgcaccgtcgcgcctgcaagctctgcaatcatgctagctgccgcatcaagggcttcattaactgttgccacattaattcctttttcaaagcgagaagatgactcagaacgaaggttcaggcgaccacttgtcttacggatagatttgccattaaaaacagcagcttcaaggataacacgactagatttttcagaaatttctgtagcctgaccacccataacaccggcaagggctactggtttgtcagcaactgtaatcacgaggtctgtctcagccaagtctcgttcttcaccgtccagggtcactaatttttcaccatcacgcgcttcacgcacacggatgtcagtcccttcaaatgtgtccaagtcaaaagcatgcataggttgaccaaagtagagcaggatgtagtttgtcacgtctacaacgttattgatgggacggatgccttcgttcatgagaaggttttgcaaccattgtggacttggtgcgatagtcacattgtccaagatacgagctgcatagtaaggcgccttgtctgtctcaatgctgacagaaagggcatctgccgcagcttcattagtttctgttagagtaaattttttaaagttgactgccttgtcatagatggctgccacttcgtgagccactccacacatagaaagggcatctgcacggtttggtgtgatggaaagttcgatgatttcatcatccaagtctaggtaagaaaagacttcctcacctggcacggcatcttcaggcaagatttggatgccatctgcgaattccttaggcacaactgagtcagaaattcccaattcaccaagtgaacagatcattccaagtgactccaaaccacggatttttccttttttgattttgtagttatcagcgatacgagctcctggaagagccaccatgaccttgatcccagcacgcacatttggggcaccacaaacgatctgacgctcttcttcttcgccaacgttaatctgacaaacatggaggtgagtctctggcacatcttcgcaagacaagacctcaccgacgacaatttttgagagaccagcagctggtgattcgacaccctctacctcgatccctgtagttgacattttttcagccaactcttgtgatggcacatcaatgtccaccaattcttttaaccatttataagatacaagcataatttagttctccagaatgacagttgtcactctagttcttttcctttcctatcatttcaatagaagaatcctcttcttaccttaatttctttctcagtaaccaatccgtatctactttttgaccaaccataaaatgatgttggctaaatttttcaaaaccatatcggttataaaacgcttgagcttttgtattatgctcccaaacacctagccaagcccaagaaaaactattttttgtagcaagttcaagtgcgaattcaaacagttgcttacctagtccaaatccttggaatttttgtagcacatagagacgttgaatttcaaaagcgtcctctaattctctctcagtttgagcacttccccagttgactttgagaaaaccagctatctcctcctcatgcataatgaaataggtttcagagtcaggatttcccaactcagttgacaaagttttcagactataagcctcttcaaagtattcctgtaactgctcttccgtattatcatacgcaaaggtttcacgaaaggtttgtttggcaattttagccaacacctcaacatctgccatttctacttttctaatcattatttaaactgttctgagaagcggacatctccttggtagaatccacggatatcgttgattccataacggagcatagctacacgctcttgtccaagaccaaaggcaaagccagagtatacagtcgcatcgataccactcatttcaaggacacgtgggtgaaccataccggcccccataatttcgatccaacctgttttcttacatacattacagccttctccaccacacttgaagcaagaaacatccacctcaacagatggctctgtgaatgggaagtaagatggacgcaaacgaatttgacgctcttcaccaaacattttttggacaatcaactgaagcgttccttgaagatcagccatagagatatttttcccaactaccaagccttcgatttggtggaattggtgactgtgggtcgcatcgtccgtatcgcgacggaagacacgccctggcgagatcatcttcaaaggacctttagaaaaatcatgggcatccatagcacgcgcctgaactggagacgtgtgggtacggagcaagatttcttcagtgatatagaaagtatcctgcatatcacgagctgggtggtcttttggaaggttcatacgttcaaagttatagtagtcttgctccacttcaaaaccatccacgacttgataacccataccgatgaagatatcttcgatttcttcactggtttgtgtcaaaacgtgacggtgaccagtcgcaactggacgacctggaagcgtcacatctatactctcgctagccagttgagccgcgactttcttttcttccaagagcttagctgtttcttcaaaagcagcagtcaagacatcacgagcttcattgacgtgtttcccgatgattggacgcatctcagcagaaacatctttcatccctttgaggatttcagtgagcgaaccctttttaccaaggacagagacacgcaaatcttgcatctctttttcatttccagcagtaatctgcttcaagctagccagcgtttcttcgcgaagcgcttttaattgttcttcaatagttgacatatttcctccatcagtctctcgtagataaaaagaaaaccacatgccaaaaactccactcggagcgttgacacgcggtaccatccgttttcatctgacaagtcagaccttcatttctaaatccatgcgcaagtgaattcacccagctttcatatagagagcttgcagtcacggctctcctccctgatatacttcccttgggctactagtctttcagattcctattcaattactacttagtttatcagatttttaccattcttgcaagacctatcttacttctgcttgttagcttattcttatctaaatttatataaaccttatctaaattaactatttataatttttgtaacaaaattaaattaattgacactcccctataaaataaagaagtttagaatttaatgtcttccaaacttctttattccatatttaatgaaatgccaccttaaccgtgataatagctagtcatcaataaaaaactatttgaataaggattctccatttgattcaatcacttctttataccaagtaaaagacattttcttatatcgatttaatgtaccacttccatcatcgtttcgatcaacataaatgagaccgtaccttttagaaagttgtgcagtggacatagaaacacagtcaatacatccccaagacgtatagcccataatttcaacaccatcctgtagagcttcagcaacttgcaataaatgttctttcatatactgaattctataatcatcttggacggttaagttattaagttcatcttttattagttgatctttagcacctaatccattttctactataaataatgggatttgataacggtcataatatctatttaaaattatacgtagtccaattggatcaatttgccatccccactctgaagactctaaataaggatttactaaaccaccaataatattcccttctcctgaattatactgtgttggaagagcagattgagtcacactcatgtaatagctaaaggataaaaaatctacggtataattttttaataactctgcatcttcagctgcaaactctatgttaatgtcattttccttaaaatatctttttgcataattcggataataacctctaacatgcacatctgaaaatagataatttagattctcatactcatgagtcgcccatacatcttttggatttggagtcattggataagctggcatagctaataccatacatcccaccttaaactctgaattaatctcacgagcaatttttgtaaccaaacttgaggcgactaattcatgatgtatagcttgatataattcttgtttcgaaagattctccttaggtatatctattcctccactagtaaatggtaattccaaaacagagtttacttcgttaaatgtaagccaatatttaactttatctttatacctttctaaaactgttcgagcaaatttttcataaaaatgaatcattctcctatcaacccatccatgatattttcttgctaaatataatggagtctcatagtgtgaaagagttacaagtggttctatcccgtgagcatgtagttcatcaaacaattcatcataatatttcaacccagcttcgttaggttcttcctcatctccttttggaaaaattctactccatgcaatagaagtacgaaaaacattaaagcccatttcagaaaacaaggatatatcttccttatatttatgataaaaatcaatacctatcaattttaagttatcttctgtaggattttctgttgcttctcctaatccacctttgggtaacacatcctgaactgataagcccttaccatcttcattatatgctccctctacttgattagctgcaacagctccaccccaaagaaaatcatctggaaaaatggtcataactttcctccattataatattaccagtaattccttagaatgctcgattgtctgattattaggtaatactaatacatctagaaaatcattggtattcgttacaattactggtgtaactgtttcgtagcctttagtcttgattaaattcaagtccatttcaaaaatcaactgatttttgaaaactctgtctccttcttctacatgactaataaaaccttgaccttttagctcaacagtatctaatccaatatgaattagtaactcaacaccctcatcactcttcaatccaattgcgtgcttagtcggaaaaatatttgtaattttcccatcaaatggtgcataaaccttaccttcacttgggataatcgctactccgtctccaattagtttatctgaaaatgttttatcctggacatcgcttaacggaatgatttctcctgatataggagaaaatatcatttttttatttgaaactccagcttcaacttctaaattgctagaactctcttcttcatcgattccaaatatataagctaatacaaaggtaataacaaccgaaatgaccgccacaattaaagcatttacaatatttgatggcacatcagaataaataaattgaggcaacgctatcaaagatgggacagcaaatagatatgctttaacactagtaagacctgcaaataatcccgctaatccaccaccaatcatagctgcataaagcggttttttatattttaaagtcacaccatataatgcaggttcggtaatccctgcaagtaaggctgagaaacctgctgcaaaagcaatttgttttgtattattatttttactctttaatgcaacagccatcgaagcagccccttgagctaagtttgaccctaacattgctggaagaattaatacgtctggagtagcaatagatgccgccaaaaaaataggtgcaaaagcccaatgcattccagtcataacaataaatggcataatagcaccaagaatagctaatgtaagccatccagctacaccatacatttgcccaactagatttgataatccttcaccaacaattactccaataggtccgactacaactaaggcaatacagcttgatactaataatactagcgtaggttgcaaaaaactcttagtaatagctagtgttaatttagcaattattttttcaatatatttcatcaaccaaaccataataagaattggaacgactgatgaaccataactagctggtgtcacaggtgcaccaaataaactaagaggattccctgattgcaccatttgaacaaaatttggatggagaagtacacctgctacagacatagctaatgtagatgttacttttaatttttgtgatgcagaataagctaataacagcggtaagaaataatatggagcatccccaaaaaatgtcaaaaaagcaatagtctgagaatctgattgcaatataccaagcattggtaaaatgattaccaagactttcaacatacctccccctaacattgctggaatgattggagtcatggaaccagcgatatactcaatgattctttctaaaatattccctttgtgcccttgaacaactgaatcggattcaaaattgccaagtttaacgaattctttataataattagctacatcattaccaagtataatttgatattgtccattctttttcataatacctattacacctggtatcttcttcacatcatcatcattgactaaattttcatcttttaattctaatcttaaacgtgttacacaatgggtaactctattgacatttttttcacctccaattacatcgaggattttttgtaccgtatctttataactcatggtattctcctattctattaatctaaattttttgttaagcgacgaatatgagccatcaaataaactaattcactagaagtcagcaaataattgtactccgtttgtataaacattgctacctgttcaccacattcatattctctaggatatttatttttcattaatgctaacaagtcttcatcatcatcgtcgg

SEQ ID NO: 141 - DNA, 12835 bp; double-stranded, linear
gcctatgtctttttcaaaaaaatgcttgacttgagacgggaactagggaagtctaaaggcggaaggcattgatttatactcttcgaaaatctcttcaaaccacgtcaacgtcgccttggattatatatgtaactgacttcgtcgatgcttatctacaacctcaaagcagtgctttgagcaacttgcggctagtttcctagtttgctctttgattttcattgagtattatattactttctatttgtaggaggtggcttatgaagattcctctcttaacttttgcaaggcataaatttgtttatgtcttgcttactttgctttttcttgctttggtttatcgtgatgttttgatgacttatttcttttttgatattcatgcgcccgatctagctaaattcgatggacaagcaattaaaaatgacttattaaaatcagcattagattttcgtattctccagttcaatctaggtttttatcaatcatttattattccaatcatcattgttttgctaggttttcaatatattgagctgaaaaataaagttttacgattgagtattggaagagaagtgagttatcaagggttaaaaagaaagttgactttgcaagttgcaagtatcccttgtttgatatatttagtgactgtgctgataattgcaattataacctatttctttgggactttttctcctcttggatggaattctctattttctgatggaagtggtttacaaagactcctagatggagagataaaaagctatttgttctttacttgtgtcctactaatcggtattttcatcaatgcaatctattttttacaaatagttgattatgtggggaatgtgactcgttcggcaatcacctatttgatgtttctttggcttggttctatgctgctttatagtgccttgccttactatatggttcctatgacgagtttgatgcaagctagctatggggatgtaagtttgatgaaactctttactccttatatcctttatattgtcccttacatggtgcttgaaaaatatgaagataatgtttaagaattttaacaatattttgctaaatagaaagattgttttactacttcgtatagttctgatgatgattttgataaaccatctattgtcaacagcggttcaaaagcaggatgctgttatctttttcaagagagaattgatttcaattttttcctataatgactattctgaagcgaatttagaaatccccaaactattgttaaacctttcgcttttcatggtaggatggctctctgtcattttacttgaaagtgatttggcagaccattaccatcacttgattcgctatcaatcaagctcctttttcgattatacaaggaaacgattggttgtcatttctaaattttttactcaagatttgtttgtctggtttcttggtttacttcctctaggaattcatttcaaaacagtcgcacttttctttttacttgctcagttaatgatgttgtacttactactgtcttatctgatagcactgattagtgcgggcgctggtttttccttttttctctattttttagcatttgtgggacaagaatggatgatggatcatattgtaacagtgtatttagtactcttaagtttattagttatgttgattgttagtcgcttggaagagaaatttaagaaaggataaacgatgagacttgaaattataaatggacagaaaatttatgggaaaagacctattttaaatcagttgaatttggtgtttcaatcaggaaaaatttatggacttaaaggtgataatggatctggcaagacggttcttttaaagatacttgctggttatattaagcttgacaaaggaaaagttcttcaagatggtaaagtttacggggtaaaaaatcattatattcaggatgcaggaattttaattgaaaaagtcgagtttttatctcatttatccctgagagaaaatttggaactgttaaggtatttttcatctaaagttacggaaaaaagaattgcctattggattcaatactatgatttacaggaatttgaagacattgaataccgtcatttatccttaggaacaaagcaaaaaatggccttgattcaagcctttatttcctctccttctatactctttctcgatgaacctatgaatgctttggatgagaagagtgtgaggttaaccaaacaggtcattttatcttacctgaaaaaagaaaatggtctggttatcctgacgtcgcacatatcggaagatatttcagacctttgtacagatgtattagttgtcgaaaatggacatatacaaatgtaaaggatatacaatcctaggagatggcttatggcacatctaaaatcatttattacacgatattccaaggtttatattggtttagttctgctgatctggctgtctttcttctttatcccttgggataaaccacttctggggataaggattgacatcttcatcatacagaaaatcttgctagcttttggaattctgtccattctcatggccttgctgtccaagaaagtcagtctctttgtttttggactgatttgctgtctttctctttggattaacttatttatcacatttgccattttgccgatttttggcaattaaacagtcataaaagtcggagaggttagcttgaaaactaacctctttttccttttcaaaatggggattcttccttgaaaataatcagtaattgtgctaaaattaaaggaacattctaaaatattcggaatttaaagtaaggaaaaacatggctaatattttaaaaacaattatcgaaaatgataaaggagaaatccgtcgtctggaaaagatggctgacaaggttttcaaatacgaagaccaaatggctgctttgactgacgaccaactaaaagcaaaaacagttgaatttaaggaacgttatcaaaatggagaatcactggattcattgctttacgaagcatttgcggttgtccgtgaaggtgccaaacgtgtcctaggtctcttcccttataaggttcaggtcatgggggggattgttcttcaccatggtgacgtgccagagatgcgtacaggggaagggaaaaccttgactgcgaccatgccggtatacctcaatgccctttcaggtaaaggggttcacgtagttacggttaatgaatacctgtcagaacgtgacgcgactgagatgggtgaattgtactcttggcttggtttgtcagtagggattaacttggctaccaaatctccaatggagaaaaaagaagcctatgagtgtgatattacttactcaactaactcagaaatcggatttgactaccttcgtgacaacatggtcgttcgcgccgaaaacatggtacaacgtccgcttaactatgccttggtcgatgaggttgactctatcttgattgacgaggctcgtacacctttgattgtatcaggtgccaatgcggttgaaaccagtcagttgtatcacatggcagaccactatgtaaaatctttgaacaaagatgactacatcatcgatgtgcagtctaagactattggtttgtctgattcagggattgacagggctgaaagctacttcaaacttgaaaacctctatgacatcgaaaacgtggctttgactcactttatcgataacgcccttcgtgccaactacatcatgcttctcgatattgactatgtggtgagcgaagagcaagaaatcttgattgtcgaccaatttacaggtcgtaccatggaaggtcgtcgttattctgatggattgcaccaagctattgaagccaaagaaggtgtgccaatccaggatgaaaccaagacatctgcctcaatcacgtaccaaaacctcttccgtatgtacaagaaattgtctggtatgacgggtacaggtaagactgaggaagaagaattccgtgaaatctacaacattcgtgttattccaatcccaacaaaccgtcctgttcaacgtattgaccactcagaccttctttatgcaagtatcgaatctaagtttaaagcggttgtcgaagacgttaaggctcgttaccaaaagggtcaacctgtcttggttggtacagtagcggttgaaactagtgactacatttctaagaaattggttgcagctggtgttcctcacgaagtcttgaatgccaaaaaccactatagagaagcccaaatcatcatgaatgctggtcaacgtggtgccgttaccatcgcaaccaacatggcgggtcgtggtaccgacatcaagcttggtgaaggtgttcgtgaacttggaggactttgtgttattggtacagaacgtcatgaaagtcgtcgtatcgataaccagcttcgtggacgttcaggtcgtcaaggagatccaggtgagtcacaattctacctatctcttgaagatgatttgatgaaacgttttggttctgaacgcttgaagggaatctttgaacgcttgaacatgtctgaagaggccattgagtctcgcatgttgacgcgtcaggttgaagcagctcagaaacgtgtcgaaggaaataactacgatacccgtaaacaagtccttcaatacgatgatgtcatgcgtgaacaacgtgagattatctatgctcaacgttacgatgtcatcactgcagatcgtgacttggcacctgaaattcagtctatgatcaaacgcacgattgaacgtgtcgttgatggtcatgcgcgtgccaaacaagatgaaaaactagaggcaattttgaactttgctaagtacaacttgcttcctgaagattctattacgatggaagacttgtcaggcttgtctgataaggccatcaaggaagagcttttccaacgttccttgaaggtttacgatagtcaggtttcaaaactacgcgatgaagaagcagttaaagaattccaaaaagttttgattctacgagtggtggataacaagtggacagatcatatcgatgcccttgatcaattgcgtaacgcggttggacttcgtggctatgctcagaacaaccctgttgttgagtatcaggcagaaggtttccgtatgtttaatgatatgattggttcgattgagtttgatgtgacacgcttgatgatgaaagcacaaattcatgaacaagaaagaccacaggcagaacgtcatatcagtacaacagcgactcgcaatatcgctgctcaccaagcaagtatgccagaagatttggatttgagccagattggacgcaatgaactttgcccatgtggttctggtaagaaatttaaaaactgtcacggtaaaagacaataaaatgagatagtttagaggcggatatcttgtgaaaagtaaatttttactgggtatccgtttgctttataaggagatgagttatggtatttacagcaaaaagctctaaaataaatatagaagaagttcgtgccttgtcaaaattagaaggtcaggctttggagaggaaatcacagcgagatcaagagctagaagccattatacgtggagaagaccagcgaattctcttggtaatcgggccatgctcatctgacaacgaagaagctgtccttgaatacgctaagcgtttggcagtcctacaagaagaagtggcagatcgtatctttatggttatgcgtgtttatactgccaaaccccgtaccaacggagatggctataagggcttgattcaccagcctaacgcgacagaagcgcctagtcttatcaatggaatcaaagccgttcgccatcttcactatcgtgtcatcacagaaacagggatgacaactgctgatgaaatgctttatcctgaaaaccttccgcttgtagatgatttgatttcttacatggcagttggtgcccgttcagttgaagaccagcaacaccgctttgtggcaagtggggcaggattttctactggttttaaaaatccaacctctggaaatctcaatgtcatgtttaatgggatttatgctgctcaaaacaaacaaagtttccttttcttaggaaaagaagtagaaacaactgggaacccgctttcacacgctattcttcgtggtgctcttaatgagtatggaaaaaatattcccaactactattatgacaatttaattgataccattgcccagtatgagaaaatgggcttggaaaatccttttatcatcattgataccaatcatgacaattctggtaagcagtatattgaacagatccgaattgtccgccagaccttgattaaccgtgcttggaatgaaaaaattaagcagttcgttcgtggttttatgattgagtcttatctggaagatggtcgacaaaatgagccagaagtatttggtaagtctatcacagacccttgcctgggttgggataacacagaagctcttgtcagagaaatttacaaaacgttaggagaataagatggcatttattgaaaaaggtcaagaaatcgatatggaagtcatcaaggctgaaacccaattgtctgcggaagccttgagactcaaggaaagccgtgacagggaattggcagatattatttcaggggaagatgaccgtattctcttggtgattggtccttgctcttctgataatgaagaggcggtcttggaatatgctcgccgtttatctgccttgcaaaagaaggtagcggataagattttcatggtcatgcgcgtgtatactgctaagcctcgtaccaatggagacggctataaaggattagttcaccagccagatacttctaaggctccaagcctgattaatggcttgcaggctgtgcgccagttgcactaccgcgtgattacagagactggtttgacaacggcagatgagatgctttatccgtcaaatctgatcttggtggatgacttggtcagctaccatgccgttggagctcgttctgtggaagaccaagagcaccgctttgtggcttctgggattgatgcaccagtagggatgaaaaatccaacctcaggaaatttgggtgttatgtttaacgccatctatgctgctcaaaacaagcaaaccttcctttatcatgggcaggaagttgagacatcaggtaatcctttggcccatgttatcctccgtggagcagtcaacgagtatggcaattatatgccgaattactactatgaaaatctactccaagccattgaacgctatgaaaccatgggacttgaaaatccttttatcctcattgacaccaaccatgataactcaggcaagcaatatatggagcagattcgaattgttcgccagaccttgcagaatcgtgattggaatgagaaaattaaaaagacggttcgaggatttatgattgaatcttacctagcagatggtcgtcaaaaccaaccagagatctttggttgctctattactgacccttgcctaggttgggaaaatacagaggccttggtagaagagatttatgttaccttgacaaaataagtgaaaaggatggagttggggaatctcaactccttttgatgagaatgatagttggacacggaattgacatcgaagaattggcttcgatagaaagcgcagttacacgacatgaaggatttgctaagcgtgtactgaccgctcaggaaatggagcgcttcaccagtctcaaaggacgcaggcaaatagaatatttagctggtcgctggtcggctaaggaggccttttccaaggctatgggaacgggcattagcaagctcggttttcaggatttggaagtcttgaacaatgaacgtggggcgccttattttagtcaggcaccattttcaggaaagatttggctgtctatcagccacaccgatcagtttgtgacagccagtgtcattttggaggaaaatcatgaaagctagtccacatagaccaaccaaggctctgattcatctgggagctattcgacaaaatattcagcaaatgggggctcatatccctcaaggaacgctcaagttggctgtggttaaggccaatgcttatggtcatggagctgttgccgttgccaaggcaattcaagatgatgttgatggcttttgcgtttccaatatcgatgaagccattgaactcagacaagctggactcagcaagccaatcctcattttaggagtttctgaaatcgaagctgttgctctagctaaagaatatgacttcaccttgacagtggctggactggagtggattcaagcactcttagataaggaagtggacctaactggattgacagtccacctcaagattgattcagggatgggacggattggttttagagaggcaagtgaggttgagcaggctcaagatttgctccaacaacacggtgtttgtgttgaaggaatctttacccactttgctactgctgatgaggaatcagatgactattttaatgcccagttagaacggtttaaaactattttagctagtatgaaggaagttccagagctggttcatgctagcaattctgcaacgactctttggcatgtagagactattttcaatgcggttcgtatgggagatgccatgtatggcctcaatccaagtggagcggtcttggatttgccttatgatttgataccggccttgaccttggagtctgctctggttcatgtcaagacagttccagctggagcttgcatgggctatggagcaacttatcaagcggatagcgagcaagtcatcgcgaccgtgccaatcgggtatgcagatggatggacaagagacatgcaaaatttctctgtcttggtagatggccaagcttgcccaattgtcggcagggtttcgatggaccaaatcactattcgattgcctaagctttatccgctaggaaccaaggtaaccttgattggctccaatggggataaggaaatcactgcaactcaggtagcgacctaccgcgtaaccattaactatgaggtggtttgcctcctcagcgaccgtattccgagagaatattattagaaaagaaaggagtggagcatgaatctacatcaacccttgcatgtcttgcctggtgtgggaccaaagtcagcagaaaaatacgccaaactaggaattgaaaacttgcaagatctcttgctctactttcctttccgttatgaagacttcaaaaccaagcaggtgctggagctggaagacggtgagaaggcagttctttctggtcaggtagtgactcctgctagtgtccagtattatggtttcaagcgcaatcgcctgcgttttagtctcaagcagggagaggtcgtttttgcggtgaatttctttaaccagccctatctggctgataaaatagagttgggagcaacccttgctgtctttggaaaatgggaccgcgctaaggctagtctgactgggatgaaggttctggctcaggtagaagatgacctccagcctgtctatcgtctggctcagggaatcagtcaggccagtctggtcaaggtcatcaagacggcttttgatcagggactggacctcttgatagaagaaaatctgccccagtctttactagacaaatacaaactcatgtcccgttgtcaggcagtccgtgctatgcattttccaaagtatttggcagaatacaagcaggctcttcgccgtataaagtttgaggaactcttttatttccaaatgcagctgcagatgctcaagtctgaaaatagagttcagggaagtggtctggttctgaattggtctcaggaaaaagtgacagcagttaaagtaagtcttccttttgccctgacccaagctcaggaaaagagtttgcaggaaattttaactgatatgaagtccgaccaccacatgaatcgtctcctacaaggggatgtggggagtggaaaaacggtagtcgctggcttggccatgtttgcggcagtgacagcaggttatcaggctgccctaatggtaccaacagaaatcctcgcagagcaacactttgagagtttacagaacctttttcccaatttgaaactggctctcttgacaggttccttgaaagctgcagaaaagagagaagtcttggagaccattgccaagggtgaggctgatttgattataggaactcacgctctgatacaagatggggtggagtatgctcgtcttggtttgattattatcgatgagcagcaccgttttggtgtagggcaaaggcgtattttacgggaaaaaggtgacaatccagatgtcctcatgatgacggcgactcccattccacggacgcttgccatcacagcctttggagatatggatgtttccattatcgaccagatgccagcaggtcggaagcctattgtgacgcgctggatcaaacatgagcaactacctcaggtcttgacttggttagagggggaaattcaaaaaggttcccaagtctatgtcatctctcctttgattgaagaatcagaagctctagatttgaaaaatgccattgccttatcagaggagttgacgactcattttgcaggcaaggcagaggtggctcttctacatggtaggatgaagagtgacgaaaaagaccagatcatgcaggatttcaaggagagaaagacggatattctggtttcgacgacggttattgaggttggggtcaacgttcccaatgcgactgtcatgattatcatggatgccgatcgcttcggtctcagtcaacttcaccagcttagaggtcgtgtcggtcggggggacaagcagtcctacgctgttctcgttgctaatcccaagacggattctgggaaagaccgcatgcgtatcatgacagaaacgaccaatggatttgtccttgcggaggaagatttgaaaatgcgtggttctggtgagatttttggaaccagacagtcaggacttccagagttccaagtggctgatattatcgaagattttccgattttagaagaagcaagaaaggttgctagctacattagttctatagaagcttggcaagaagatccagagtggcgcatgattgcccttcatctggaaaagaaagaacatctggattaagctttctctaaggaaaacttatactcaatgaaaatcaaagagcaaactaggaagctaaccgcaggttgctcaaaacactgttttgaggttgtggatgaaactgacgaagtcagctcaaaacaccgttttgaggtggcagatagaactgacgaagtcagtaacatatatatacggtaaggcgacgctgacgtggtttgaagagattttcgaagagtattaagctagtttttaggtttggctcttatactagagtcatcaaaaagaaacgaggactctcatatgacagtaacgattaaagtaaattaccaaaccactttccaaaagaaggaagcaaaaaactagtataaacagaagagagagcgaaatgctcttttttcgtttctaaaactactttcagcccatcatcctaaaagtaaagaatctaaattcactttctatttacccttctttcttgcattgattacatagatatgctacagttgtggtaacgattacaaaataaaaggagcatgctatgaaaaatccagctttgctagaagaaattaagacctatagaggaagggatgaggttccggaagactttgatgatttctgggatggggaagtgaaaaatgtttccacgcttccatcctaccacttggaggaaagagatttccacattcctcaagtcaagtgctatgagttaacatttgaaggaagcaaggaaggaaaggtctatgcacgcattgttcttccaaagagtgaggagaaggtcccattaatcttccattttcatggttatatgggacgtggctgggactgggccgacatgctgggcttcaccgtagctggttacggtgttgtttccatggatgtgcggggccagtcaggttactcacaagacggcttgcgttctcctttaggaaataccgtgaaggggcatattatccgtggtgctgtggaaggtcgggaccacctcttttataaggatgtttatctggatatttaccagttggtcgaaattgttgctagtctgtctcaggttgatgagaagcgtctttctagctatggtgcctcacaaggaggggctctagctctagttgcagcagcgctcaatcctcgaattcagaaaacagttgccatttatcccttcttgtcagacttcagacgggtgattgagattggtaatactagcgaggcttacgacgaacttttccgttatttcaagtttcacgaccccttccatgaaacagaggaggaaatcatggcgacccttgcctatatcgatgtcaaaaatcttgcccatcgtatccaaggtgaggttaagatgattacgggcttggacgacgatgtttgctatcccattacccagtttgcgatttataatcgtctgacctgcgataaaacctatcgcatcatgcctgagtatgctcacgaagccatgaatgtatttgtcaatgaccaagtctacaactggctctgtggaagtgagattccttttaaatatctaaaataaggagtcgactctaagcacaaaatcttaaaaattacaaacacgcatagtatcaggggattaagaaaactttatactatgcgttttatcatggaaatatagtaaaatgaaataagaacaggacaaatcgatcaggacagtcaaatcgatttctaacaatgttttagaaacaaatgtgtactattctagtgtcaatctattatatttatagaattttttgttgctagatttgtcaaattgcttaaaataatttttttcagaaagcaaaagccgatacctatcgagtagggtagttcttgctatcgtcaggcttgtctgtaggtgttaatacttttcaaaaatctcttcaaaccacgtcagcttcgccttgc

SEQ ID NO: 142 - DNA, 5020 bp; double-stranded, linear
ggggatatgaagaacaaaagaatatttaaagacttccaagcttcaaaaatgagtttaaacatttacacaagccccttgttagcctttgtttttgtcttcataggagagtttgtggcttttactttgtatggtattggcttgttagctctcatcggacttgctagaaattttggagaggctggtcaaaatcttgcaagctacttgcagaccttgcatcagagcttgacggataaaacaagtgactttcgtttaattttaggattactggcctttggttattcttaacactgtgttcagatggacaagaaaagttgagaaaagacctattcgaaccttgggattttatagagagaatttcctcagcaatcttctgaaaggatttagtctaggcctggcactttttcttctgaccttgttaggtttagtggtcttaggtcaatatcgtttggaatccattcacttgaatccttattctcttgcctttgtcgtctttactatcccattttggattttacaggggacagcagaagaagtggtggcccgtgcttggctacttcctcaattggcctcaagaaccaatctaaaactagctattcttatatctagcctgttctttaccctgcttcatatgggcaattctggtctcacccctctatctctagtaaatctctttttattcggagttgccatggctctttaccttctcaaaactgatacagtttggggtgttgcaggtattcatggtgcttggaattttgctcagggtaatctctttgggattttagttagtggtcaaccgtcagaacgtctctgatgacctttttaccacaaggcaatcaagattggctatcaggtggttcttttggcatagaaggttccattatgacaagtctggtattactactgctgattgtctatcttgctaataaattaaagaaagaaaatgaaaggatgtgacttcggtccgtccttttcttcgtgaaaatactataagtatgctaaaataggaatagcacatggagagaggattcttatgatcaatcacattacagataatcaatttaaactagtatcaaaatatcaaccatcaggagatcaaccccaagctatcgagcagttggtggataacattgaggggggagaaaaagctcagattctgatgggggcgactggaacagggaagacctatactatgagtcaggtcatttctaaagtcaataaaccaactctggttattgcccacaataaaactctggctggtcagctctatggggagtttaaggaatttttccctgaaaatgcagttgagtatttcgtatcctactatgattattaccagccagaggcctatgtcccttctagcgatacctatattgagaaggatagttctgtcaatgacgagattgacaagcttcgccactcagctacctcagcccttttggagcgtaatgatgttattgtcgtggcctcagtctcttgtatctatggtttgggttcgcccaaggaatacgctgatagtgtcgttagtctccgtcctggtctagagatttctcgtgataaactcttgaatgacttggtcgatattcagtttgaacgtaatgatattgatttccaacgcggaagatttcgcgttcgtggggatgtggtagagattttcccagcttcccgagatgaacatgcctttcgagtagaattttttggagacgaaattgaccgtattcgtgaagttgaggctctgacaggtcaggtgttgggagaagtggatcatttagcgattttcccagcgacacactttgtgaccaatgacgaccacatggaagttgccattgcaaagattcaggccgagttggaagaacaattagctgtctttgaaaaggaaggtaaactgcttgaagcccagcgtttgaaacagcggacagagtatgatatcgaaatgttgcgtgagatgggctataccaatggggttgaaaattattctcgccacatggatggacggagcgaaggagagcctccttatacgcttctcgacttcttcccagatgatttcttgattatgattgacgagagtcatatgaccatagggcaaatcaagggcatgtacaatggagaccgttcgcgtaaagaaatgctggttaattatggtttccgtttgccgtctgctttggacaatcgtcctctccgtcgggaggagtttgagagtcacgttcatcagattgtttacgtttcagcgacacctggtgactatgaaaatgaacagaccgagacagtgattgagcaaatcattcgtccaacgggactcttggatccagaggtggaagtccgtccgactatgggacagattgatgacctcttgggtgaaatcaatgcccgcgttgaaaaaaatgagcgtacctttatcacaactttgaccaagaaaatggcagaggatttgaccgactacttcaaggaaatgggtatcaaggtcaagtacatgcactcggatatcaagaccttggaacggacggagattatccgtgacctgcgcttgggtgtctttgatgtcttggtcggaattaacctgctccgtgaaggaattgacgttcctgaagtgagcctcgtagctattctcgatgctgacaaggaaggtttccttcgcaacgaacgtggactcatccagaccattggacgtgctgcacgtaatagcgaaggtcatgttatcatgtatgcggacacggttacccagtctatgcaacgtgctatcgatgaaactgcccgccgtcgcaaaatccagatggcctataatgaagaacatggtatcgttccacaaaccatcaagaaagaaatccgtgacttgattgctgtgaccaaggcagttgctaaggaagaagacaaggaagtcgatatcaatagcctcaacaaacaagagcgcaaagaactagtcaaaaagcttgagaaacaaatgcaagaagcagttgaagtgcttgactttgaactagcagctcagattcgtgatatgatgctggaagtcaaggccttggattaggggaatagtatgatttatttaagaaagttaaagaaagaagatttgatgtctttatgggaaatggcttattcacagcttaatccagtttggaaacagtatgatgctccctattatgatgattatcagtatttttcaaattttaaagaattcgaactacaaaaatcagaatccattttaagcaactcaaatcgccttggtatttttgttgatgataaactagttgggactgtttcgcgttattgggtatgtaaagaaacaagatggatggaattgggaattggtatttatgataaaaaattctggaacactggtattgggaaagttgctatgttgcagtggatagataggacgtttcaggattacttggagttggagcatctgggtttgacaacttggtcaggaaatattggtatgatgaaacttgctgaaaaattaagaatgaaaaaagaagctcatattccaaaagttcgttattatcaaggtaaatattttgacagtattaaatatggtattttgagagaagactgggagaaaataaatgacggttattatcaaatcaatggaaactcctgaagagatagaaggtaaatccttcgttcactggcaaacgtggagagaggcttatgatgaccttttgcctgcggaatttcaggagacaatgacattagaaagatgtcgactctttagtcaaaagtatccagaaaatacattgattgcgatggatggtgtgaagatagttggttttataagttatggcaactgtcgtgatgagactattcaagctggtgaaattattgctttatatgttttaaaagactattatggaaaaggaatcgcacaaaagttagtgaaagcagctttgactgatcttaatcatttttctgaaattttcttatgggtattgaaagataacaagcgcgccattgctttctatcaaaaaatgggttttacttttgatggacaagaaaaaatacttgaacttggaaagcctataaaggaaaaacggatggtattctattctaaataattctcaaaagtaaaagctaatatggtaccaagtctgaaaatttaataaattagaaagcgagtaaatttatgtcccgttcccaattaacaattttaacaaatatctgtctgattgaagacctcgaaactcagcgcgtggtgatgcagtatcgcgcccctgaaaacaatcgctggtctggttatgcctttcctggaggtcatgtagaaaatgatgaggcttttgcggagtctgtcattcgtgaaatctacgaagaaacagggttgactatccaaaatcctcaacttgtcggcattaaaaattggccactagatacaggtgggcgctatattgtcatttgttataaggcgactgagttctctggtacccttcaatcttcagaagagggagaagtttcttgggtgcaaaaagaccagattccaaacttaaatctggcctatgatatgctaccattgatggaaatgatggaagctcccgacaagtcagagtttttctaccctcgccgtacagaagacgattgggaaaagaaaatcttctagtcttttactaaataacctagctgatccaaggcctcctcgatatagtggaggtcttgttgtgtctcggcttcaactaggtgataatgaataccatctgttaactcagaaattggcttaaagtcagaacgttcaacttgttctagaaaatgttgcacgtcgcggcgacaggtcagttttagtaaggtttcaatctctccataaacaggatgatcaatcaagatattttgaacgcgaccaccattatctacgatagcaagtaattctcgtccaatttcttcaacttcatgcttgaccttaaataatttgtgatgataagtatttgcattagcatctttatagatataaccacgattggtagatagaattggagatccatcagctcttaaaattgcaatatcttgaacaataacttgtcgagtgacatgaaagtgctca

SEQ ID NO: 143 - DNA, 4965 bp; double-stranded, linear
aaaaagtggcaatccattgattggccacttcatttagagaattatcgtctcgcccttgaagaagaaggtcgtgtagtacttgagttactgctatcgctagaactactacttgaactgctggagctggatggagttggtagactccccacaatactagaccaagcattctgataatccgcatcacttccgccaatagcaaagcgataacttgtcgctggcgctcctgacttattagcccaatagctggtaacagtcgaacctgtgacctctacttcttttccttcaacagaaaccttctctggtttttgacctgttgatttcaagacttccgatttcactacactaggatctaaagcaaagcgctcgttcccccaaatgcttggggaagcttgctgaatcgcatttaccagatgagccatgtaattagagttattagaataacctgctctacgtgacaatgaatgattatcatcatgcccaatccagccacctagggttaatctaggtgtcgaaagcatgagccacatattttcgtcttggttggttgtaccagtcttcccaatccaatctgcattagccagagtaggatttaaagaagtcaggttagacttgaaggttgttgtcacacgagaggatagaacttctcgtagcaatccctgcataatcgtcgcagtagcttttgaatagacttgaaccggtttatcctgatactcatacaccactctaccatctgctgcttcaatctttgaaatcacatgcttctgatgataaactccattattagctaaggtctgatagccattggtatgctgggcaactgtgacttcaataccaccacccattggcaagctctcaataccgtactcaggaatctcgtaacccatcttttccatataacccttgacatcaacacccttttcacggagcatacgataggtccagtaagcagggatattccatgaatagttcagagcttctcccaaggtcatcattcctgttcccttgctattagcatacataatcggattgccattagcaaagtttgttggatagttagatagaatcgtttcacttcccatcaagccctggtcaatagcaataccgtaggccagcaagggcttggtagtagaagctggcgaacgtttggtatcaaaggcatgattattttgattttcttgataattacgaccacctacaaagcctagaatagcacctgtttggttatccatcaagacattccctacttctacacgacctgttccatcgtctaaaagatagccataatcagcaaccgcactttgcatggcagaatgaattttctgatctatggtagtagtaatcttataaccaccattttcaatttccttggctgccaaatctcgataaaacttctgagttgcctcatttttcaactccttagcggagacattgtctctctgagctagatagtcatacatacgttcttgagcttctgccaaagttgtaaagtataaatagtctcgtgaaattcctgtaaccgtgcccgatggtaaaaagtcctgtttaaggtcataatccttgtactgagaatactcgtctttgcttaatgcacctgtacgatacatactgtaaagaactgccttagcccgtcttaagccaatttctaggtcttcatcactcttcaactccccagtattttcataaggagagtaagtaatgggactctgtggaagtcctgctaaaaatgctgcttgaggaacagtcaactgactggcatctacaccgaaaattccctcagctgcttgccgagcccctgcaatattctgtcccttattatttcggccaaagggagccacattgagataggtcgttaaaatctcatctttattcatggcgcgttccaaggcaagagcatccacaatctctgccgccttacgagccaaggtcggcgcatccccaaccacctgctgtttaattagttgctgggtcaaggttgaacccccactagaggaacccaaacctacaaatttccccaaggtcgcacgaatcaccgccttgggtactacacccttatgttctttaaagtgttcatcttctgtcgcaatgatagccttcttcagattttccgaaatttgctcagatgagatagaagtgcgcaacaaatcactctctatggaagcaatcaccgtcccgtccgaataggtaatctctgaaatagaagagatgtccttgacctgattcaccaattcttctgtctgaggcacccgaaccttgtcaaataaggccactccgtatcccaaagcaatcccagctcccaacattcctcctagaaaaccgagtacaaagagtaagttaaataaggcttttatactcagtaaaatagctgggaaaatgactgacttatctaaggttttagattttttggtacttgaacctttcttgccaggtctagctgattttttatttttttgtttttgctggaaaaattccagcatttttcgttttaattcatttaattgattttgcatggatttcctcactttatctattataccacaaaagggaaattttcaataaaatagccactttcttccctattctgctaggctattgcccaagtttgtgatacaataggtagaaacaataattttaaaaaggagaaaaaacacatgcacatttttgatgagctaaaagagcgtggtttgatatttcaaacgactgatgaagaagctttgcgtaaagccctagaagaaggtcaagtttcttattatactggctacgatccaactgctgacagccttcacctaggccaccttgtcgcaatcttgacaagtcgtcgcttgcaactagcaggtcacaaaccttatgcgctcgttggcggtgctacaggtctcatcggagatccgtccttcaaagatgctgaacgtagtctccaaacaaaagacacagtagatggctgggtcaagtctatccaaggacaactttctcgttttcttgactttgaaaatggcgaaaacaaggctgtcatggtcaacaactacgactggtttggcagcatcagcttcattgacttcctccgtgatattggaaaatacttcacggtcaactacatgatgagtaaggaatctgttaaaaaacggatcgaaacaggaatttcttacactgagttcgcttaccaaatcatgcaagggtatgacttcttcgtccttaaccaagaccataatgtcactcttcaaatcggtggttctgaccagtggggaaatatgacagctggtaccgaattgcttcgtcgtaaggcggacaagactggtcacgttatcactgttccactaatcacagatgcaactggtaagaaatttggtaaatcagaaggaaatgccgtctggctcaatcccgaaaagacttctccatacgaaatgtaccaattctggatgaacgtgatggacgctgacgctgttcgcttcttgaaaatctttactttcttgtcacttgatgagattgaagatattcgtaaacaatttgaagcagcgccacacgaacgcttggctcaaaaagtcttggctcgtgaagttgttacacttgttcacggagaagaagcctacaaagaagcacttaacatcactgagcaactctttgcaggaaacatcaaaaacctttctgtcaaagagctcaaacaaggacttcgtggtgtgcccaactaccaagtacaggcagacgaaaacaacaatatcgtggaactgctcgtctcatctggtatagttaactcaaaacgccaagcccgtgaagacgtccaaaacggagccatctacgtaaacggcgaccgcatccaagagcttgactatgtcttgagtgacgctgataagttagagaatgaactgactgttatccgtcgtgggaagaaaaaatactttgtattgacttactaaactattcaacatttatctataaacaaaggagttaacctcgagaaaggtaactcctttttgctgttaataactctcatctatctatttttaatagacaggctacgcaggacaatgcgcaaggttgttagattatgtaagatagagagatttgaaggactgaaccaattaaataagccaaagccaatcaaactactatttacgacaacggtatcctgaatatttttcttgatgagtgtttgcaaagatgatgataacgaatccaactcttggaagaaatccaaacgattatctaacaataagatatcactcatctgcttagaaatatctgcactctcattcatcaccacaccgatatctgatagagttaaagccgctgagtcattcaatccatctccaaccatcaaaatagtgtgacctgctttctgcagtttctctactaactcaaatttcccatcaggtttcaagtctgtatagacctgatcaaagggcaaatctttgactaattcctctgtcctaatcaaggtgtctcctgttgccagaatcaattttttcccctgtgccttaagtttatccaaggctgtttttgcttcttttctcaaaggagtatgaatgcagaacattccaatcaattcattttgataagccaagaataagagattgtagtgactcttgtactcttcaattaaagcattttgttctgaactgatatgaatctgctcatcctgcatcaagacataattcccaataagaactggttggccatctatatgagatttgatccccttgcttgcgatatattggagtttcccatgcatttcctcatgttcaattccctctatctcagcttgcttgacgatggcattagcaataggatgataaatgtgttcctcaagacaggcactgattctgagaatatcttcctcactatagtctccaaaaggtaacaccttttcaactataggataactagttgtgattgttcctgtcttatcaaacaagaaagtatcaacttccagatatttctccctgttgtggcctctggctgtcatctctgtgctgg

SEQ ID NO: 144 - DNA, 3232 bp; double-stranded, linear
caggggcgtattacgtgacaattcaatgtaggctgtcgctacttgcgccaaaacaaggattcgataatgtcggatgatactaacgattaaaccgagcagaaaggatcccaaaattccccaaactgcaatatgcaaggtcagaaagaatgccttttgatatagtggtagatattgttcaacaatggatcaatccaaaaatagaacctcccatctagaaataatacagttattgtagcacttaaaatcttctttggataatatctattttttattgccgttataaggatttttatcatagacataaaatttctgaaatttccaaacaaaatattttaaaagttttgaaaaagagttaagatatttttgtaatacacaaagtaaacgcttacttattaaggaggacattttatgtcatacaaaacaagcaatgcagaaggtcatgtagatttcatcaatacctatgatttggagccaatggcgcaacaagttattcctaaagcagcatttggctatatcgctagtggggcgggagatactttcacttctttccagtgattttagcgtcaggttctttttagtttttaaagattatccgtgaatttcttgcttatttatgataaaatgggagtgtcgcaaaaaatgactcatcgtattcaattttgagtaaaactaggaggatcccatgtctacagaacatatggaagaactaaatgaccagcagatcgttcgccgtgaaaaaatggctgcgctccgcgaacaaggaatcgatcctttcggaaaacgttttgaacgtactgcaaattcacaagaattaaaagataaatatgccaacctcgataaagaacaattacacgataaaaacgaaacagctactatcgcaggacgcttgataaccaaacgtggtaaaggaaaagttggttttgcccaccttcaagaccgcgaaggccagattcagatctacgttcgtaaggatgctgtcggtgaagaaaactacgaaatcttcaaaaaagcagaccttggtgacttccttggtgtcgaaggtgaagtgatgcgtacggatatgggagaactctctatcaaggcaacccacatcacacacttgtctaaggctcttcgtcctcttcctgagaaattccatggtttgacagacgttgaaacaatttaccgtaaacgttaccttgacttgatttctaatcgtgaaagctttgaacgctttgtcactcgttcaaaaatcatctctgaaatccgtcgttaccttgaccaaaaaggattccttgaagtggaaacacctgttcttcataatgaagccggtggtgctgctgcccgtccatttatcacccaccacaatgcccaaaacattgacatggtgcttcgtatcgcgactgagcttcacttaaaacgccttatcgtgggtggtatggaacgtgtctatgaaattggccgtatcttccgtaacgaaggaatggacgctactcataaccctgagttcacttctatcgaagtttaccaagcttatgcagacttccaagacatcatggacttgactgaaggcattatccaacacgctgctaaatcagtcaaaggtgatggcccagtcaactaccaaggtactgaaatcaagattaacgaaccatttaagcgtgttcatatggtggatgctatcagagaaattactggtgtcgatttctggcaagacatgactttggaagaagctaaagctatcgctgctgagaagaaagttccagttgagaaacactacactgaggttggtcacatcatcaatgccttctttgaagagtttgttgaagaaactttaatccaaccaacctttgtctatggacatccagtagctgtatctccactcgctaagaaaaatcctgaagaccaacgctttactgaccgtttcgagctctttatcatgactaaggagtacggtaatgcctttactgagttgaacgacccaatcgaccaacttagccgttttgaagcccaagctaaagccaaagaacttggtgatgatgaagcgacaggaatcgactatgactacattgaagctcttgaatacggtatgccaccaacaggtggtttgggaatcggtatcgaccgtctctgcatgctcctcactgatacaacaactatccgtgatgtattgctcttcccaacaatgaaataaattcttatcctctgggtcttatcagaggattttttgattcaaaaagagactgaatttaaggagaaaatgaagtgtagtatattgaaattgaaatagtacactttgatttctaagacattgttagaaattggtttaaattccctaagcaatttgtgcatgttttatttcattttacgatagtacgctgaaacttttcaaaaagtactagaaattgacttggattccccaattgatttgttcagattcactataaataaaaaattaataagtgggataggaagttagcgtcaactaggatagtatcttgcttaaacagtatatatgggattgatataagtccataggtcctattagaggatgttctggtgtcttattcacttgttttttatagtattagtagatagaatcagcaaataaaaacccaaatcattcatacctctctcaactagatgtaacttacaaaacccctgacctcatgagccactttcttcctcctcatgaggtcagttttactttctgctgttccagtatcgtttttcctcgctagatttcctcaaaagggcagactcctcccttggtgcgtcacacgattttttcatctcgactgttctttaatgcatcattaacgacgcttttcttctaggtggttcataaggaacaggaagattcaggttgacttttctaatcctagaataaagtgctgaaaacaattcggaataggcatagagactagacaatttgaggagctgcttgcgtcctgttcgaacacattttcccaccacgtgaagaaaaagatggcggaagcgtttgattgttaaagtttggaagtcacctccagctagatgtttgagaaaaagatagagattgtaggcgatacagctcatcatcatacgaacttcgtttttgattaaggttgaactatccgttttatcgccaaaaaatccctccttcatctccttgatgaaattctcggcttgaccacgtccacgataaagctgaaactggtcttggcttgttccactcgtcatatttgtaacgagagaaataacatcgtagaac

SEQ ID NO: 145 - DNA, 10711 bp; double-stranded, linear
ccggagaaaatgatgaaaagttcaaaactatttgcccttgcgggcgtgacattattggcggcgactactttagctgcatgctctggatcaggttcaagcactaaaggtgagaagacattctcatacatttatgagacagaccctgataacctcaactatttgacaactgctaaggctgcgacacaaatattaccagtaacgtggttgatggtttgctagaaaatgatcgctacgggaactttgtgccgtctatggctgaggattggtctgtatccaaggatggattgacttacacttatactatccgtaaggatgcaaaatggtatacttctgaaggtgaagaatacgcggcagtcaaagctcaagactttgtaacaggattaaaatatgctgctgataaaaaatcagatgctctttaccttgttcaagaatcaatcaaagggttggatgcctatgtaaaaggggaaatcaaagatttctcacaagtaggaattaaggctctggatgaacagacagttcagtacactttgaacaaaccagaaagcttctggaattctaagacaaccatgggtgtgcttgcgccagttaatgaagagtttttgaattcaaaaggagatgattttgccaaagctacggatccaagtagtctcttgtataacggtccttatttgttgaaatccattgtgaccaaatcctctgttgaatttgcgaaaaatccgaactactgggataaggacaatgtgcatgttgacaaagttaaattgtcattctgggatggtcaagataccagcaaacctgcagaaaactttaaagatggtagccttacagcagctcgtctctatccaacaagtgcaagtttcgcagaacttgagaagagtatgaaggacaatattgtctatactcaacaagactctattacgtatctagttggtacaaatattgaccgtcagtcctataaatacacatctaagaccagcgacgaacaaaaggcatcgactaaaaaggctctcttaaacaaggatttccgtcaggctattgcctttggatttgaccgtacagcctatgcctctcagttgaatggacaaactggagcaagtaaaatcttgcgtaatctctttgtgccaccaacatttgttcaagcagatggtaaaaactttggcgatatggtcaaagagaaattggtcacttatggggatgaatggaaggatgttaatcttgcagattctcaggatggtctttacaatccagaaaaagccaaggctgaatttgctaaagctaaatcagccttacaagcagaaggagtccaattcccaattcatttggatatgccagttgaccaaacagcaactacaaaagttcagcgcgtccaatctatgaaacaatccttggaagcaactttaggagctgataatgtcattattgatattcaacaactacaaaaagacgaagtaaacaatattacatattttgctgaaaatgctgctggcgaagactgggatttatcagataatgtcggttggggtccagactttgccgatccatcaacctaccttgatattatcaaaccttctgtaggagaaagtactaaaacatatttagggtttgactcaggggaagataatgtagctgctaaaaaagtaggtctatatgactacgaaaaattggttactgaggctggtgatgagactacagatgttgctaaacgctatgataaatacgctgcagcccaagcttggttgacagatagtgctttgattattccaactacatctcgtacagggcgtccaatcttgtctaagatggtaccatttacaataccatttgcattgtcaggaaataaaggtacaagtgaaccagtcttgtataaatacttggaacttcaagacaaggcagtcactgtagatgaataccaaaaagctcaggaaaaatggatgaaagaaaaagaagagtctaataaaaaggctcaagaagatctcgcaaaacatgtgaaataactgttgcaaaatataagaaaggatttagtatttcccttgaatgctgaatccttttttacatttgtaaagaaagattctaaaatgtacggacccccaaaagttggagcctctttttgtcagaatagagaaaatttttgttaattttacttgtttcctattgctttctcagctattatttgttatattaaaagtataattattttttatttatcagagttaagcattgcactttcagaggaaggagtattttttaaaaagaaaatgtaaacgtttgctcaaaaatgaaaggatttagaagtttatgaataaaggattatttgaaaaacgttgtaaatatagtattcggaaattttcattaggtgttgcttctgttatgattggagctgcattctttgggacaagtccggttcttgcagatagcgtgcagtctggttccacggcgaacttaccagctgatttagctactgctcttgcaacagcaaaagagaatgatgggcgtgattttgaagcgcctaaggtgggagaagaccaaggttctccagaagttacagatggacctaagacagaagaagaactattagcacttgaaaaagaaaaaccggctgaagaaaaaccaaaagaggataaacctgcagctgctaaacctgaaacacctaagacggtaacccctgaatggcaaacggtagcgaataaagagcaacagggaacagtcactatccgagaagaaaaaggtgtccgctacaaccaactatcctcaactgctcaaaatgataacgcaggcaaaccagccctgtttgaaaagaagggcttgaccgttgatgccaatggaaatgcaactgttgatttaaccttcaaagatgattctgaaaagggcaaatcacgctttggtgtctttttgaaatttaaagataccaagaataatgtttttgtcggttatgacaaggatggctggttctgggagtataaatctccaacaactagcacttggtatagaggtagtcgtgttgctgctcctgaaacaggatcaacaaaccgtctctctatcactctcaagtcagacggtcagctaaatgccagcaataatgatgtcaatctctttgacacagtgactctaccagctgcggtcaatgaccatcttaaaaatgagaagaagattcttctcaaggcgggctcttatgacgatgagcgaacagttgttagcgttaaaacggataaccaagagggggtaaaaacagaggatacccctgctgaaaaagaaacaggtcctgaagttgatgatagcaaggtgacttatgacacgattcagtctaaggtcctcaaagcagtgattgaccaagccttccctcgtgtcaaggaatacagcttgaacgggcatactttgccaggacaggtgcaacagttcaaccaagtctttatcaataaccaccgaatcacccctgaagtcacttataagaaaatcaatgagacaacagcagagtacttgatgaagcttcgcgatgatgctcacttaatcaatgcggaaatgacagtacgcttgcaagttgtagacaatcaattgcactttgatgtgactaagattgtcaaccacaatcaagtcactccaggtcaaaagattgatgacgaaagcaaactactttcttctattagtttcctcggcaatgctttagtctctgtttctagtaatcaaactggtgctaagtttgatggggcaaccatgtcaaacaatacgcatgtcagcggagatgatcatatcgatgtaaccaatccaatgaaggatttggctaagggttacatgtatggatttgtttctacagataagcttgctgctggtgtttggagtaactctcaaaacagctatggtggtggttcgaatgactggactcgtttgacagcttataaagaaacagtcggaaatgccaactatgtaggaatccacagctctgaatggcaatgggaaaaagcttataagggcattgttttcccagaatacacgaaggaacttccaagtgctaaggttgttatcactgaagatgccaatgcagacaagaacgttgattggcaagatggtgccattgcttatcgtagcattatgaacaatcctcaaggttgggaaaaagttaaggatatcacagcttaccgtatcgcgatgaactttggttctcaagcacaaaacccattccttatgaccttggatggtatcaagaaaatcaatctccatacagatggtcttgggcaaggtgttctccttaaaggatatggtagcgaaggccatgactctggtcacttgaactatgctgatattggtaagcgtatcggtggtgtcgaagacttcaagaccctaattgagaaggctaagaaatatggagctcatctaggtatccacgttaacgcttcagaaacttatcctgagtctaaatacttcaatgaaaaaattctccgtaagaatccagatggaagctatagctatggttggaactggctagatcaaggtatcaacattgatgctgcctatgacctagctcatggtcgtttggcacgttgggaagatttgaagaaaaaacttggtgacggtctcgactttatctatgtggacgtttggggtaatggtcaatcaggtgataacggtgcctgggctacccacgttcttgctaaagaaattaacaaacaaggctggcgctttgcgatcgagtggggccatggtggtgagtacgactctaccttccatcactgggcagctgacttgacctacggtggctacaccaataaaggtatcaacagtgccatcacccgctttatccgtaaccaccaaaaagatgcttgggtaggggactacagaagttatggtggtgcagccaactatccactgctaggtggctacagcatgaaagactttgaaggctggcagggaagaagtgactacaatggctatgtaaccaacttatttgcccatgacgtcatgactaagtacttccaacacttcactgtaagtaaatgggaaaatggtacaccggtgactatgaccgataacggtagcacctataaatggactccagaaatgcgagtggaattggtagatgctgacaataataaagtagttgtaactcgtaagtcaaatgatgtcaatagtccacaatatcgcgaacgtacagtaacgctcaacggacgtgtcatccaagatggttcagcttacttgactccttggaactgggatgcaaatggtaagaaactttctactgataaggaaaagatgtactacttcaatacgcaggccggtgcaacaacttggacccttccaagcgattgggcaaagagcaaggtttacctttacaagctaactgaccaaggtaagacagaagagcaagaactaactgtaaaagatggtaaaattaccctagatcttctagcaaatcaaccatacgttctctatcgttcgaaacaaactaatcctgaaatgtcatggagtgaaggcatgcacatctatgaccaaggatttaatagcggtaccttgaaacattggaccatttcaggcgatgcttctaaggcagaaattgtcaagtctcaaggggcaaacgatatgcttcgtattcaaggaaacaaagaaaaagttagtctcactcagaaattaactggcttgaaaccaaataccaagtatgccgtttatgttggtgtagataaccgtagtaatgccaaggcaagtatcactgtgaatactggtgaaaaagaagtgactacttataccaataagtctctcgcgctcaactatgttaaggcctacgcccacaatacacgtcgtgacaatgctacagttgacgatacaagttacttccaaaacatgtacgccttctttacaactggagcggacgtctcaaatgttactctgacattgagtcgtgaagctggtgatcaagcaacttactttgatgaaattcgtacctttgaaaacaattcaagcatgtacggagacaagcatgatacaggtaaaggcaccttcaagcaagactttgaaaatgttgctcagggtatcttcccatttgtagtgggtggtgtcgaaggtgttgaagataaccgcactcacttgtctgaaaaacacaatccatatacacaacgtggttggaatggtaagaaagtcgatgatgttatcgaaggaaattggtcactcaagacaaatggactagtgagccgtcgtaacttggtttaccaaaccatcccacaaaacttccgttttgaagcaggtaagacctaccgtgtaacctttgaatacgaagcaggatcagacaatacctatgcttttgtagtcggtaagggagaattccagtcaggtcgtcgtggtactcaagcaagcaacttggaaatgcatgaattgccaaatacttggacagattctaagaaagccaagaaggcaaccttccttgtgacaggtgcagaaacaggcgatacttgggtaggtatctactcaactggaaatgcaagtaatactcgtggtgattctggtggaaatgccaacttccgtggttataacgacttcatgatggataatcttcaaatcgaagaaattaccctaacaggtaagatgttgacagaaaatgctctgaagaactacttgccaacggttgccatgactaactacaccaaagagtctatggatgctttgaaagaggcggtctttaacctcagtcaggccgatgatgatatcagtgtggaagaagcgcgtgcagagattgccaagattgaagctttgaagaatgctttggttcagaagaagacggctttggtagcagatgactttgcaagtcttacagctcctgctcaggctcaagaaggtcttgcaaatgcctttgatggcaatgtgtctagtctatggcatacatcttggaatggtggagatgtaggcaagcctgcaactatggtcttgaaagaaccaactgaaatcacaggacttcgctatgttccgcgtggatcaggttcaaatggtaacttgcgagatgtgaaacttgttgtgacagatgagtctggcaaggagcatacctttactgcaactgattggccaaataacaacaaaccaaaagatattgactttggtaagacaatcaaggctaagaaaattgtccttactggtaccaagacatacggagatggtggagataaataccaatctgcagcggaacttatctttactcgtccacaggtagcagaaacacctcttgacttgtcaggctatgaagcagctttggttaaggctcagaaattaacagacaaagacaatcaagaggaagtagctagcgttcaggcaagcatgaaatatgcgacggataaccatctcttgacggaaagaatggtggaatactttgcagattatctcaaccaattaaaagattctgctacgaaaccagatgctccaactgtagagaaacctgagtttaaacttagatctttagcttccgagcaaggtaagacgccagattataagcaagaaatagctagaccagaaacacctgaacaaatcttgccagcaacaggtgagagtcaatctgacacagccctcatcctagcaagtgttagtctagccctatctgctctctttgtagtaaaaacgaagaaagactagtatttagtaaaacctcttaacaagattacggaagcagtctctatcttttccaatgaggtttatagtacagaaaaagcctgagaagatgtcttctcaggcttttgttaagcacataaatacaatagtgctatgacaaaatcacccagaaaaatctgggtgataaatgttatggttgtgctggttgaggattctgattttgttgatcaggggttgtatttgattgttgcgtattattgttaggattggtagtcgtactattatttgtgcttggagtggttgagctagactgtgaagttgaactatctgatgatgagcttgaactttcagttgatgggggttgttgtggagcaggtgagttccacgtagaacgagcaccatttttaaatacgaattctccatttctgtagagcccctctggtatattccaatcttctggattgcttccttcagacaggtaggtcatcatagagcggtaaactttggcagcgaccgtaaggccattgcctacaagtggtgtcagacggttagaatagcctgtccatacagccattgaatatttacgcgtatagccagcaaatagttcatcaggtgctacaaattgagaggtcttgatgtggttttcaatttcctcgtctgtatagttagaggttcctgttttaccagcctgagggagccaagcaagataggcatttcgtccagttccataagtcaagactgttttcatcatgtcggtcatcatataggctgtcgtttccttcatggcacgagttccgacattagagaactctttttcactcccatcactaaagacgactttatggatatacattggtttatagtaagttccaccatttgcaaaggcagcgtaagcagcagccatcttttcactacttgctccatattttttgtctgattcggttgtgttacttgaaatggcatttgagtagtgaatacttgggtagtcgattcctagaccatttaggaaagtcttggcgcggttgagtccgaccttgtttagagtttccacggctgggacgtttcgcgattgttgcagggcgtattgcaaggtgatgttgccaaagtagcccctatcccagttataaacaggagtatttgtcccagggtagttatagggctcatcgtgaacgatagtagcagttgaatcgtagacaccgtactccaaggcaggagcatagtctgtgatcggtttcatagttgatccccagtcgcggtttgtttctactgcttggttaattccgaaggaaacattacttgactgatggcgtgctcctagctgggcaatgactttaccgttagaaacatcaacaatggtagaagcgacttgcaattcatcgtctggataggcaacgtattcgtctgtattgtaaatatcccacagatgtttttgagcttcttggtctacatttgtgtagacatccatcccagttgtgagtaggttatagcctgtttcttcttcaacttgattgatgacttccttgaggtaattatccatgtaagcagggtaattacttgctgatttgagactttgtagtccatcagtaattggtgtattgactgctttctcatactgttcagcagagatgtagccttgatttttcatttcagataagaccaagtttcggcggtcttgggctgcttctggatgtgaataggggtcatattggtttggtgcctgaggcattccagccagcaaggctaactgaggtaaacttaaattattgaggtctttaccatagtagttttgagctgctgtctgcattccatagttcccattagacatgtagaccttatttatatagtaggtcaagatttcttgcttggttgctttttgttctaactgaatcgctaaccaagcttcctgagccttacgagaaatagtctggtcggaagtcgaagttgaaaagtaagtcaacttaatcaactgttgggtgagagttgatccaccttggagggaattgctttgcagattgcgcaagaaagctcccaggatacggatggtatcaatccccctgtggtcgaagaagcgatggtcttcgatagaaacgattgccttaaccaaatctgtgggaatatcattagcttgggcattgacgcggcgttcagaacccaagtcagcaatgagttgatttttattgtcgtagattttactagaagttgttgcaactagtttactctcggataggctaggagccttgctaacgtagtagaaaaaaactcctccgcctaagacaatggctgcgataaccaagcttaagaagctaatgctcagatacttgattaggcgcagaatcgttggtttgttcatcttgttttaccacctaataaatgttctttgataacattgagataaggaatttgagggaaggcaccagccttgatttcatatccatattctcgaatatattcaagtggcattgatttttgtcccttatcttgatgatagaagcgaatcaaatcgaatgccggcaataagtaggtttcttgctgagaagaaaagtgaagaaggacaaagcagattccttgttgggcaaggacttgttccatatgctgaatctgatgtggatgaaaatttttcatcggaatcgcacgtttttgttttgtttccttgacttcaaagtcgatgtaatatccattataaacgccagaatagtccgtcgttgaagcttgtcgaaaataggcttcaacaatcttggcacgacttcgttgtggatagtccacttgtacgatttgaataggagttggtttcttatgtataacagccaagccctgagacaaatagtagtcgttggtagcattgatcatcttttcaaagggtaccgagctcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgc

SEQ ID NO: 146 - DNA, 11887 bp; double-stranded, linear
tacattcattccatcggctactccataatacttagataaaaccatagctgaagtcgaatacggatactgtaaagtattatcaattttaatcaaatcatcattaccgataatacttctgattgcttttggtagtatgaaccatacgttggtgaaatctcagataatgaagaatcattagactctggacctttttctagtgtctcacttacctcatattcttcacccttactagaaataacactcaaagcagatactgtcgataactggctagccaataaagtactcgcaataattgaaatacccaattttttataaacagttttcttcattattgtatcctcctaatgtaattatagcgtactattctaaatttcttaatctactatagaatcaagaaatctaccaccttctttaaataccctccattatcacataaacaggtaaacttttcaattaatgactgcgcttttcaatcacgctagaggtacttgcttgcttctttgatactaagttcagccattctttccttgtttttctcaataaagcatgttacccaagtgggattcgttttggagtagtctcgcagagtccagccaatggctttattgataaaaaattctgtttggttcaagttatgaaggagaatcttttccattaattgagtattggtcttctcttttcttaacaactggtggtcaatagcgacacgtctcagccagatattatctgataggctccattttatactcaatgaaaatcaaagagcaaactaggaagctagccgcagttgctcaaaacactgttttgaggttgcagatagagctgacgtggtttgaagagattttcgaagagtattaagattatttcttctagttcagggtgttcatacaccaaactccctactactcgatctaggatatctaccgtgtcccacaaggattttgtcacgactaactgctctagcttaggcaaatcggtttcctttagataagactgcattgctttcaaatagttagcagccacatattggtattttctaggatccttttcccagcaagtgtctgcaaaatcccaatcgataatctttgtttttttcgcttctggaaaatattttatagagtttatttctttcaggcaccgcaatacctagaaaagaaaattgatggcgcatataggcttccatggaccttgcttttttagagtcttttgctgcttctagctcctcaagtaaatctgctaaactcatctaaaactcctcttgccccaccaaatggtgctgaaaggcatagacagccgcctgggtacgatcgctgacttcaagtttggcaagaatattggacacgtgggtcttgaccgtcttgagagagataaagaggtcatctgcgatgcgctgattttcgtagcccttggcgatgagttggagaacatctcgctcacgcgcagtcaattcttcatgaagttccatatgattgcggtggtattcaaccttcttgctaacctcttgctcaatggccagctcgccagcagctaccttactgacggcatgaagcaattcatctgcactagaagtcttgagcatatagcctttggcaccagcatctaagactggcatgattttttcattgtccaaataagaggtcacaatcaaaatcttggcttcaggccattctttaaggattgctaaggtcgcgtcaatcccattcatctcaggcatgacaatatccatgacaatgacatctggacgcagttccaaggccaagtcaatcccttgagacccgttggacgcctcacccacaacttctacatcgtcttggaggtcaaagtagcttttcaagcccaatcggaccatttcatggtcatctactagtaaaattttcatctttactcctttatcattccttatctaacaggggaatacggatatcaaccgccagcccttgcttgggagctgtcaagagttgaactgttccagccatatcttcaacccgctccttgatatttcgcagtccataactcaagtcgtctaagctccctaactggaaaccaatcccattgtccaccaccttcagttgcaattcaacatctgtctgatagaggtagacatctaggcaagatgcctgggcatggcggagggtattgctaatcaactcttgcaggatacggaagatatgctcctcgattttcttaggcaatttcgtcatattctgcttgagactaaccctaagatcactcttgtcctcaagctcttttaaaagaatttgaatcccttctatcaagctcttctgctccagttcaactggtcgcaaatgcaagagcaaaacccgcaaatccttctgggctgtttctaaaatagctgtgacactctgcaactgggtctgcatcttttctctatccaatttcaaagcctgctgactgatacccgataaaatcatgtgggccgcaaacaactcctgactgactgtatcgtgcaaatcccgagcaattcgcttccgttccttctcgatgatttcctcttcctgagcaaggctctgattttcagctttttgaagagcctctgtcaaaaggttaagtttacctgataaggacttgaaactggcatccaaatctggatctgcaacctgaaccacttcttgccctgctaataaacgcttgagattagcctgcatttttcttagagaaagctcttcgatccctcgccaaaacagggctaagagacaggtcatggacatgctgaaaaccaacaataaaaagacaaatttttctgttttttcgacatcgtgcaaaaagatagaccagtcaaaatcaagtatttccagcaagctgtgggagaaaaaaaagacaaataggaaggaggtgagagcaataatgacataggcttgttttttcatcctctaaccacctccacatcaccaatcatagtggtcaagaaaatcttgacactcttgttactcttgagatagtcttttgtttcttgatgatagtgttcattgcggagggctcgcttgggctggttgaaaaaaatcaaatccccatagagacagttaacgctgagactgacttccacatctacaggtacgatgattttggtcgttcctaccatctttctgaggataatgacattgtcatgattggttaagatgaccctctccagatgaatagtgtccttgcccatgaagcgaaagagattgatatcatcgaattggcaagtctggtagcttgaaaaatgatgaagatttccaaaccaacgatttttctccttcttaaccgtcacgacctcttcaaaaaccaaattggtctgctctttttcctggttcatcatcgggtaaagaagaaagaggctatagataaccgcaacaaaaatagctagaatcacaaaaggattgagcataacgatgaaaaagaagagaatggttgccgctactaaaagaagattatttccctctttaccagtgtagtagcgaatcaaaagcaaaaagaggaatagtatcagcagaaaacgcgaaaaatgctctgataccatcaaaatcagagctcctgtcagaagacaggcttcgataaataaaaagattttaaattttctcataggttcatcctctcccttctattttatcacaattcaaaaaagtcacctcagtctgaggatggaaaaaaggcgctggttacgcctttttcatctgatcctttgcttcttttaattttccataaagaagatagtctactttttgtagatctgctatggtggcacagttaagggaacacataatcaagcgtagatctgctttccagccttggacaatgccaatcacttcttcaactgtgtaggtttcaaccaattccagaacggttcgtgacaatcccacagccttagcaccaaaaaccaagcacttaatcatatccagcggattccgaacccctccactaaccaagagttcgaccttatctttccattcttgggcattgagaagggcctgcatggtagactgaccccattgattgaggtaatcacgctggccactacgacggttttcgatataggcaaagctggtgccaccacgacccgataggtccactgtacgaacaccgaattcataggctctttcgattgtcttggcatccattccaaagcccacttccttgaggacaataggaacgggaatttgcttgctataatctgctagatgcgattgccagcttctaaacttcctttctccctcgggcatgagtaattcctgcatgacattgacatgcacttgcaatagaacaggattcatctcttctacagtctgaagtcctaactcgacaggcttgtccaatccaatattggttccaaggaggagattgggatgactagacttgacagaaaaagaatcatccgttggatttttgagggctgcgctataagaacccgttacaaataaaataccacaggattccgccacctgagccagcttttgattgatttctcttcccttattacttccaccagtcatggcattgatataaaaaggaaagtcccactttcgaccagcaaactctgtcgaaagatcgatttcatccagattgtaaagaggcaaggaagaatgaatcagctccacctcatcaaagctattataggaacttttctgctcaagggcatagaggatatgctcgtccttacgatttgtcgtcatgtcctatcctttcttgatataagagctcaatccccagatcggcccaacgattttttaaggttttggttgattgcgcatcaaaactcagggcgatgccacagtcaccaccaccagcaccactactcttggcaacggtctgcaaatcttgactggcttctttcaactgtctaagcaaaggcgtgtaaatatctgtactcaagccttctaaaagcttgctggctacttctacttgatcgataatcttttctgatttcccctgttccaaggcttctaccagagaagtcaccgtttcttttgaggaagttaaaaaattttgattgatattttgcttgatttgctggaccatgtgactcgatacagccacttccttggtccatcccactaagaaatcacattctaaagttggtttcacttgtgaaattgaaaagccccaatcacgctccagaactgtcgccaagttttcttcttctaaccaagcagccaccttctggcgatcaaatgactggtagagaaccaaatcctctgccacaatacaggcaaggtcgcccatggaaccattgtctcctcgcttaagcaagacagcgctagtcagcttgaacaagagctcctgatcaacagaaacatcatacagagccagtaaagccttgacaaccaagacaacgacgctgccactagaacctagaccaaactttttcccttctcgttccattttgccacagatttctagagaaaaaggtcttaaattctgaccacgaacagcgaggaagtctcccatcaaagcaatcgtttcttgaatcaagctatagtcaggattaggccttaagtccactgcgaaatcaaacatatctgaatagatacggtagctgtcagaaaaagcaatctcagccctcatatagatgggaatatcctttatcaaagctaactgccctggctctaaaatagcatattcacctgcccaatagagttttccgcaagttttaacagcaatcatcttgactcaaatcctttgtttttgacacaatcaagcgataacgatgaccgaaaatttctgataaatgctccaagtctttctcctgacagaagaccttaacattgggaccagcatccatggtaaagtagcaggcctctcctttctcacgaagctggcgaacaaaggccatagcctcataagaggcatccgtcagataagaaaaggctggactagcagtctttgtcgtagcatgcatagccagggcatttttctccgttaattctccaatcttggcaaaatcattttccttgagataaatcagcatatcctgatagtccttctcagactgacgaacccagtcgtcgaaagtcgtcgaggtttccacacaaagtttcatcccgtcacggctagagattggttttttcttgtcctctagcaccaacataatcatagctagtttcaagtctgtctctacagggtaaatttctccactatccttatcccaggctcctagtggtccataaaaactccgagaagaagaacctgaggcaaatttggcttcctgtgccaactgacttctatccaatccaagcttgaaataagcattacaagccttgaccagggcggacaaaccactagaacttgaggacagacccgctgccgtaggcatattgttttgagtatcgatacggacaaagccctcaccagctggacgataacggtcaataatcttactcatcttggcatgctcgacctcattttgtagctgaccattgatgtaaaattcgtcagctgttacattggctggtaaaggcgacaaggtcgtctctgtatacatattttccaaagttagagaaatactgctagtagcaggcaccatctctttttcttttttctttccccaatatttgataatagcaatatttgcgtaggaacgtactgttacaggctctctatccatgtctgaacagctcctttctcttctaatctttctgctagttcttgtgcgtgtgtcaaattggttaccaaggctatgatacaacctcctagcccaccaccgctcatcttggcacccagagcaccatggctaagagtcgtttcaaccaaaaagtctgcctcagggctactgactccaatttcttttaaatgtaaatgcgcttgactgaggatttgtcccagtccttcagcatctttttgtgaaatcgcaacttctgcttgctgggttaattctcccaaggcatgcaaaaacggtagggcatccttgcccttattttgaaccacttggatggcttcacgagtatgaccataaacacccgtatcggcaatcaccaaataggcggataaatccatctcaagttctgtaaatcctacgttcttgataaagcgaataggttggtcactaagacaggtcttagcatccaaaccactaggattcatatgggcaatcatttcagctcgattgaccaagatttctagtacatcatgaggcagatcagcctgatagtagtcaaatactgcacgaatggccgctatgctgatagccgctgacgaacccatcccccgtttctcagggatagccgagtcaatctcacaacgaatgcaggcttctgtgatattcaaatactccagtgaggcataaaccgccatggacaaggtatcctcctcataaaggcgccaaggactctctgcaggaactaccttacaggtcacctccacctccaaaagaggcagggaaatggcaggataaccgtaaacgaccgcatgttcccctattaaaattatcttactatgtgcctgaccgacaccaactttttttgtcattttttccttttactagacgaaaaaacgtcttatttttcatacaagtattaattctttcctatctattttattatattttcacaaaaaaagcgattgtttccattcacaatcgcttctttcattattgaacccattcgccattatagttgacagaatagccatctacggtcgtattcactgccaaggcacctgagcgctataagcgtagtaccatctgccattgacctggaaccaacctgtcgtcatagaacgacgaaagaaactccataccattaagtaaagaggaaagtcgtgagggagcatgcgccattgacaacctgttttagtgacgtacaaagtctcattaacaagtactcgtttcggccatttataggtgcggtgtttggagaaatagggttcaatcttcgcccattcttgatcgtttaaatcagtatcatatgctttgcgtatcataactctagcttaacatttttttgtgaatacaggttctaaataatcgaccacgaaaatttcttaagtggaaaacgccttatgaagtatgctacgggaaagttatgcacttaatttgacaattcaagatgtaaaaatatatactatagtagattgaaactagaatagtacacctctacttctaaaatattgttagaaatcgatttgactgtcctgatcgatttatcctgttattatctcattttactataatatttgataagttatcctaaaagtattattatgttgttgtgttatagattgattgaatctaactaaaggatcctattcaattactagaactatcacatactcaaggtcagctcacagatgagcaactattttggttacaatgtctactaaatttaagtcaaacaaataatttagtcaaaattaaaaaaatagaggaacataaatatgattacaaaacagaatgtaatagtgttctacaatttttactagataaaactgtaaattctgaaggaaggatcacttcttcaacagaatttggaaatttcgtaagtaatttatcattccaacacggaatagctggactactgtttcctctaaataaattgtaccccccagaactggattctaaaatactctctatcatcaagaaggcagtgacaattagaacgacacacacatatgaatatcaatactcactgctatttggtgatgcaggctatctatggttactcctacatttattttctatcagtaaaaatcaatactatctacaattagcaaacgtcaccgctaaaaaattaatagagaattatgatactctagaggaaatagactttgcattgggaaaatctggtgtcctattatcattaataaaatactatcaatttaccaatgacaatactcttaaaattttcatccacaatagtataggggaaatttatcattatttcctacaaagagatacagccaaagaaagcattttagactatagctttgctcatggatattgtggaattgcatatgctttatttgcctattctaaagtcttagaaccttctatgttttataatgatctccatacattccatactgaattaaaaaaattattagaaaaagttacttctaatactgaaaatttaggaaatttacaactttcttggtgcaaaggaatttccggaataatcttatatctttgtatgtacgattgtgacggaaacaaagatattattagtaaatatcaagaatttgtttttaaccatcatctaaaaatgatgacaggatattgccacggaataactagcttactacaaaccactgtctacaatcaaaacaaattactgatgaaaaaaatccaacaggtaattttagcatgttctgaacgagatgatcacggtttactgatgtttcaaggagatagtggtaaagcagatttgtttgacttcggaataggaagcatggggtatattggtgtctattaaataataaattcccattcgatgtgcagacataaggagaaaagtatgaaattattttggacaaacaacatatatagacagttgctgctaaacagctgtttttcatcattcggcgacagtattttctacctcgccattatcaattatgtggctcagtacaatttcgctccgctagcgattttactgatttccatttcagagatggttcccctactatcgcaactctttctcgggattctaggagattttcaagaaaatagagtcaaacacgcactctggattgccaaaatcaaaatcctgctctacgctattttgacagtatttctcgtcttgtcgcccttttcattagtttcagtcattatgattgtcatcatcaacctcatctctgacaccttgagctacctgtctgcctacatgatgaacgccctctacatcagtgtaattaaggacgacctgcatgatgccatggggttcaggcagtctctgatgagggttgtccgtattgtcgccaatctggctggcgcattccttatcaatgttataagtattcaaactatttcccttatcaacactctgacttttgtcattgcctttttgggcctgtatgttattcgacataccttgtatgaggttgaaaaaagaattgaaatgtcacatacagcactgagttttaagaaatattttcaacatcttaaacagtcgctggctgtgctcctgaggttaaaagataccgtcatactactgtttctgacgaccagtatgattgccatcttggatgtgtcccctcggctgattgccctccgcttcatccaacagacactagcacaactgagcattgggcaactcctcgccctgctctccatcatcatgtcttgtggagctatccttggcaatatgaccagcagtaatctatttaaaaatatccgtttcacgcacctcttggttttctgtgagatttccctattgactctaataactagtatcctttgtcaagcctatatcgtaattttcatgaccagtttcatcagttctacgattatcggcattctcagccctcgcctacaagcagctgtctttgcccatatccccagtgacaagatggggacggtgggctctgctctgagcacagtggacattctcgccccgtccctgctctccctattagccctatccatagcatcgggcgtttcggtgcagttagcattgatatttttgtatcttattttaattgctcttatcttttgtcaatggttagtcaagttcaacactcataactaacgaaaaagcatgtgtagatttcacatgcttttaatctccccaatcgtcaggtcaagtacaacaaagtcacttctttgattaagcgagtgttctaatataattataagcgccctgtcattaccgaacccattcgccattatagttgacagaatagccatctacggtcgtattcactgccaaagcacctgagctataagcatagtaccagttgccattgacctggaaccaacctgtcttcatgtctccattacctgcatttaggtagtaccaagttgaaccatcttgataccaaccagttgccatagctcctgatgaacggagatagtaccatttgttcccaaggttttgccaacctgttttcatatcgccatttgggtggtctaaataataccaagtggtaccttcctgataccagccagtggccattgctcctgaggaacggaggtagtaccacttattacctagatattgccaacctgtttgcataataccagttgttggatctaggtagtaccaagtcgaatcatcgtttatccaccccgcacgtctttcaccaccaaggtagttttctccattaatttccgtcttagctagataataccagttagactgatcataaagccaacctgtctctaaagaatgattttgattaaagtaatagttcgtataataacgcttctcttctttatcttctgaatcttcacgtttttccccgtactttcttccaacactgtctttagttttaatctctaatgttttccaaccaacaaactcttgtagcactccatttttatcgaagtagtaccactctgactttggaaaaccttctaatctgataccatttgggtaaggaccaattgtactacctttagatggaaacgggatatattgccagccgacaaccatctctccagatagagaatcaaaataatagtacttaccatcaatcactcgccagtaggtttctttgaggtccccctttttgtagtaggttcttccgttttcttggacaaactgccatccttcagaatcatctgcaaatactgtactggtccctagcaaaccaaagaaaaatactgtcagtccaacttgcatagtttttttcaaaattttcatctatataccctccaatattaaatccactcaccagatgaggcgaaattataaactttaccatcgatagtttggctacctgtaaccattgctccagg

SEQ ID NO: 147 - DNA, 11340 bp; double-stranded, linear
ccggtatgttctggaatactaccaatctaagctggctgtgccctacagttttacaaccctgtacgaataccttaaggaatatgaccgatttttcagctgggttttggagtctggtatttcaaacgctgataaaatatccgatattcctttatcagttttggaaaatatgtctaagaaagacatggaatcctttatcctttatctacgtgaacgtcccttgctgaatgctaatacaacaaaacaaggtgtttcacagacaactatcaatcgaaccttatcagcactttctagtctttacaagtatctaaccgaggaggttgaaaacgatcagggggaaccttatttctatcgtaatgtaatgaaaaaagtttccaccaagaaaaagaaagaaacccttgctgccagagctgaaaatatcaagcaaaaactctttctaggtgatgaaacagaaggttttctaacttatatcgatcaagagcacccacaacagctttcaaatcgagctctctcatcattcaacaaaaataaagaacgagatttagccattattgcccttctcttggcatctggtgttcgcttatctgaagctgttaatctagatctaagagatctcaatctaaaaatgatggttattgatgttactcgaaaaggttgcaaacgtgactcagtcaatgtcgctgcttttgctaaaccttatttagagaattatctggccattcggaatcaacgctataaaacggaaaaaacagatacagccctttttttaactctctacagaggtgttcctaatcgtatcgatgcttctagcgttgagaaaatggttgctaaatactcagaggattttaaagtgcgtgtaacaccccataaactgcgccatacactagcaactaggctctatgatgcgactaaatcacaagttttagtcagtcaccaactaggacatgctagcacacaagtcactgacctctatacccatattgttagtgatgaacaaaagaatgctctggatagtttatgattttacgtattttaaattatgtaaataaatatcaaaaaaagaagttggccaacttctttttgatttatccaactaccgcttcagcgatttcttcacggctaataccagcgaagtagcgtgtgatatcaatggtttttagcgccttaagaacatcttcgcgttcgtatttcaccccacgaaggacatcttctactgcagcaacgtcttcaataccaaagaagtcaccataaatcttgatgtcttggatttttgattcagtaacgttagcaaagacttcaaccttaccactagtgaatttgattccacgacggacgttaaattcaggtgatttaccatagttccagtcccaagttccaaacttagtatccttgatgcgattgatttcggccaattcttcttctgaaaagacgtattcagtcatctctgggtactcttttttcatgtattccaagagtaaatcacggaatttttcgactgtgattttttttggtaattcattgataatattggttacacgggcacggacggatttcacaccttttgattcaaatttatcttttgaaaccttaagggcatttgcgaggactgacaaatcaacgtcaaagagcaagcaaccgtggtgcatgatacggccgttgatataggcttgggcattgccacagaacttcttaccatcaatctcaaggtcattacgacctgtgaactcagctttaaccccaagttgagccagggtattgataaccggagttgagaagctcttgaagtcaaatgccttattttcatcttctttggagatgatcgtgtagttgaggttatttaaatcgtggtaaacagctccaccaccactaatacggcgaactacctcaataccattttcgcgaacataatcacggttgatttcttcgatagtgttctggtgacgaccaacaatgatagatggcttgttaatccaaagtaggaagatttgatcctcatccaaaaggtgtttaaaggcgtattcttccaaggcaatattaaaagcagtgtcatttgaatgattgataatgtatttcatgatatccctttactttatatgatagaaactggaaataaccttccagtctaatctatcttcgttttattttttcttaggtgaatggatggccattcctagaacatctgcaaacgcttcgtacatcacttcagagtaagttgggtgcccgtggatggtcttcagcatttcctcaacagtgatttccatttcgatgatgcttgatgcttcgtttattaattctgcggctgcaggaccaataatgtgtacaccaaggatttctccgtatttcttatcagcgataacttttacgaaaccttgagctgcgtcagatgcaatagcacgaccgttagcagcaaagttaaacttaccgatggcaacatcgtatttctcacgggcttgttcttctgtcaaacctactgctgctacttcagggagagtgtagatggctgcaggagtcaaattcaatttggcaactgcatgatttcctttaagggcattttcagcggaaacttcacccatgcggaaagctgcgtgagccaacatcttagtaccgttgatgtcacctggtgcataaatgcctggaactgaagtttccatgtattcgttgaccttgatacaaccacgatccaattcaaactcaacctctccaataccttcaaggtctggcatacgaccaattgaaagaagagctttgcttgcgatgatatcgtcttttccttcaaccttgatacgaagttgaccattttcctcaatgatttcttgcagtttagtaccagtcaagatggtcattcctttacgctcaagaatcaagcgaaggttcttagaaacttccacatccatagctggaactatacggtccatcatttcgataacagtcacttttgaaccaaatgtcatgaaggcctgaccgagttcgataccgacaactccaccaccgatgataacaaggctttctggcacttcgttcatttcaagaatgtcatcactagtcatgacaagtggagattccataccagggacgttgatcttgttgacttttgaaccaccagcaagaatgattttcttggtttcaagcaattcagaaccatttaccaagacgttcttgtctttagtgattgtaccaattcctttatgaacagtaactccgtagctacgaagaagtcctgcaacaccaccaacaagagtattaacaactttagatttagtttctaaaagtttttccatatcaacagtgaagttaggattttcaatcacgataccacgatttgcagcatgaccgatattttcaataatttcagcgttatgaaggtaggtcttggttggaatacatccacggtttaagcaggttccaccaagttcagatttctcaacaagggcaaccttaccgccgaattgggcagctttaatggctgcaacataaccagcaggacctccaccaatcacaacgatatcaaaagcatcatcgctcttaccatcatcgtttgaggtacttgctacaggtacagggctagcttctggcgatgctgctccagctgttgggatgttttccctttcttcaccaaggtaaccgataacttccgttacagggacagtttcaccatctcctttgagaatggcaatcaagtacccatcttcttcggcttccaattccatgctgactttatcagtcatgatttccaaaaggatttctccttcttttacaaattctccgacttttttattccattggacgatttgtccttctgtcatatccacgccggcttttggcataattacttctaaggccatgtcttccttcctttatctatatcttaaaaatgaatactcttgctcttaaattaacattgagattggcgtttcaatcaactctttcaagtccttcataaacttagcaccagccataccatctacgacacggtggtcaatggttaatcctaaactcatgattgggcgaatcacaatttcaccattgacgacaactggcttctcgattgtcgaactgacaccaaggatagctgagttgggttggttaataatcggaccaaaggactgaacaccaaacattcccaaattactgattgtgaatgttgaattttgtaactcacttggagccaatttaccatccaaggtacggccaataacatccttaaaggctacaaccagttctgaaagactcatcttctcagcattgtaaacaacaggtgtcatcaatccattatccatcccaactgccatggcaagattgacatagttgtgagtgataatagtcttgccatcttctgtcaatgaagcgttgatgtatgggtgtttcataagagtcttaacaactgcaagcgaaagaaggtctgttacagtagtcttcttcccagttgcttccatgattggctcaagaaccttcttacgaagagccaacatttcagtcatatcaacttcatagttgagggtgaaggttggcgcagtcaagtaagattcaaccatgcgttgggcaataaccttacgcattggtgtcattggaatacgctcgattttaccatatggtgttacgttatcagggacttcttccactttttcaatctgagcaggagatttgatgctatcgttttcgatattttcaggaagcagggccaaaacatccttcttcatgattttaccacgatgaccggttccttggatttcctgccaagcaatgttatgttcgagggcaattcgttttgcaagtggcgaaatgcgaaccacgtttgtgtctttataagtttccacgtcttctttgtggacacgaccgtttgcacctgagccagaaacgtcgtagaggtttatccctaaatcatccgctaactttctagctgcaggagtcgctcttagcttgtcatcagccatgacctctccaattctatttatgatacaaagggcgtcaaaagcgactgaaaaataggaaatcgacgatggcttcgatgaagccaaggagatttatcttttttccgatcttttagcccgtgctctaatctaagatattaatgacgaagagctctgcacctaaaagatacaaagtttctcgtcagctttattttatttacataacttatcttatgtaaccctattctttgttataagtttttcggattgcatctttgatactttcaactgttggaatcattgcattttctaggttttgtgcataaggcatcggcacatcttctcctgcacaacggcgaattggtgcatctagatagtcaaatgcttctgattctgaaataatagctgaaatttcaccgatatagccacttgttttgtgggcatcgttgaccagaacaaccttaccagtcttcttcactgagtttatgatgatatccttatcaagcggaacaagggtacgtgggtcaacaatttcaactgaaattccttcttctgctaattcttcagcagcttgaaccacacggcgaagcatttttccataagtaacaactgttacatccgttccttggcgtttgatttcaccaaccccaagtggaattgtgtagtctggatcaactggcacttcccctttttggttaaattctgacttgtactcaagtataataactgggttgttatcacggatagaagacttaagcaggcctttcatgtccgcaggtgttccaggtgccacaaccttaagtcctggaatgtgagtaaaccaagactctagagattgtgagtgctgggcggcagagccaactccgttaccagctgcacaacgaacagtcattggaacctgacctttaccaccaaacatgtaacgtgttttagcagcttggttgacgatattgtccatggcaataacagagaagtccatgaaggtcatatcgacgattggacgaagtcctgtcatggctgctcctgctgctgctccagagatggcagcttcagaaatcggacagtcacggacacgttctggaccaaattcttcaagcattccaacagaagtaccgaagtctcctccgaagacaccgacgtcttctcccatcaagaacacattttcatcgcgacgcatttcctcagacatagcaaggataatggtgtcacggaaggacattgtttttgtttccattttatctctttctccttagtctgcgtaaatatcttcaaaggctgattcaagcggtgggaatgggctttcctctgcaaatttaacagaagcttctactgcttcctttacttgcgcttggatttcttccaattcttcggcacttgcaatgttattttcaataaggtaattgcggaggttttcgattggatctttttgtttccacaattccacttcttcacgcgtacgatatttaccagggtcagatgatgagtgaccgagccagcgataagttacactttcaatcaagactggaccattgccactgcgaacatggtccacagctttctgaaatccttcatagacatcgatgacattgttaccgtcttcgatgaacattccaggaattccataagcggcgctacgttgatggatatgttctatattggtcattttcttgatatccgcagagataccgtaaccgttgttaatgcaatagaaaatgactggcaggttccagatagaagccatgttcactgcttcgtggaaaacaccttcattggtcgcaccatctccaaagaagcagacaacgattttaccggtattttgcatttgctgactgagggctgcaccgacagcgatccccataccaccacctacgataccattggcaccaaggttcccagcatcaaggtcagcgatatgcatagatccacctttccctttacaggttccagtgtatttaccaaggatttcagccatcattccgttgaggtcaatccctttagcaatagcttgcccgtgtccacggtggtttgaggtaatcagatcatctggattgagagctaacatagcccccacgttagctgcctcttcaccaacagaaaagtgcgtcattcctggcactttccctttctttactaattgtgcaatttttaagtccatgcgacggatttcttccatcttacggaacatttctagcaaaagatttttatctaaagttgacatcttcttgcctttctaactttcttcttaccttactattttaccgcttttggcaaatactgtcaaagtttttctaaaagaaatttcacaaaataaaaaagaaaaccccgtgaaaacaagggattttcttgtcaagaatattttttcacaaactttttagcatttggattttgctaaagattcaaatctcttcataatcacagttaaacgccaacggtagagcgccccgctcacaatcaaactaataatcaagccgatccagtaagaataagctccaaaatctgttagggaatcaaatagcgtancacagggattgctacgccccaataaccaagcaaaccaaggtaaaaaggaataactgtatccttatacccccgcaaaattccctgaagcggcgccgcaaaggtatctgctaactggaagaaaagactataagttaaaaaacgcactgtcaaatcgataaattttgggtcgttaccataaagactggccacatttcccctaaaaatgtaaaggaaggttaaggtgaaggccgcaaaaatgagggcagtccatcttcctagaccaatataggttttcgcatcatcaaatcgcttggctcccacttcataggaaacgacaatagccatagccgatgagatactcataggaaaggcgtacataagacttgaaaagttcatagctgactggtgactagctataatcaagggcgaaaacttagccataatcaagccaaccactgaaaagatagccacttccgcgaagacagttcccccaataggcagacctaaacgaactccttccttaattttatccatattaagtggaattcgtttctcaaggtgtaaggctttgagcttctcctgtttaaataaaaccagaacagaaatcccaagcaagacccagtaggccaaggatgttcctaaaccagcaccagcccctcccagttctggaacaccaaaggcaccgtaaatcaagagatagttaaatccgctattgagagggagtaacaaaagcatgaggtacatggacagtttggtcaagcccagcgaatccagcaaggaacgaatgacgctaaagagcaacaaggggataatcccgatagataaaaaccaaagatagcgaaccgctactgccgctactgctgcttctaacccaatatgattcaagattattggtgccaagaaaagtaccatccccagcaagaccacagataggcccaaggccaaataaataaattggtaaaaatcagacgcaacttcttcctttttgcctcgaccaagatggtgaccaatgataggcaccaaggctgacacaatccctgttagaaatgtaaagaaaggattccagatactggttgccatagatacaccagccaagtccatagtgttgtattgacctgtcattgcagtatcaacaaaagaggcagaataattggcaaattggtagatcaggattgggaagaaaatttttaaaaataatactaacttctctcgtaaacactttgtcttatacatacttctctttctattctgatttatctaaaccaaagagtttcagaccatagtttttcaaacttagcggaggtttattagattttgaagtagtatgccaacacgcacatgtacgacaataatagcttctaactaaacctccgttatcatattgaaccgcatggtcagctttttctttagtttcatattgaattttggaacgattagctgcgggacagtaaattccactattagatttcgcttgtctctccctacgttttcgaaaataattcatattctaactcctatcaagcttgatagacgatttgtcccttacagatggtatatttaacctgcccttttaaggtttcaccgatgaatggtgaattagctgctttggaagcaaaatgggagtccacaaagcggtcagccttggcatcaaaaatagtgatatctgctggaccattctcagccaagtaacctgcttcaaagttgtaaagcttggctgggttgtatgtcattttttcaagtaattccatcaagctcaactcaccagcttctactaaataggtcaagctgagagacagggatgtttctaagccagtcataccagatggcgctttggtaatatcctcaacatttttttcatctacatgatgaggcgcgtggtcagtcgcaataactgtgatgacacctgatttgagaccttcgataacggcacgacggtctgattccaaacgaagcggtggattcatcttagcattgctaccttgtgttaaaagaagtgcttctgtcttagagaaatgctgtggcgctacttctgctgtgacttctgcacctaacccctgagcaaactccactactttaacactttcttccttagacaaatgctggatgtgaacatgggctttagttgcataggcaatcatgacatcacgcgccatcatagcgtactcagccaccccagtagcaccgcagatatggaaatgttctctagcaatattttcattaaagccaagaacaccgttcaaacctggatcttcctcatgaaggctgataaaggtattgagttttttggcttcctccatggcttccttgacaatcttactgctctcaagcggaataccgtcatcagagaaaccaaccgcaccagcttctaagagtgccttaaagtcagtcaagtttttaccattaaagtttttagtaatggtcgcaactgtcttgacattaatcttctctttggcagctgactggagaactgcttgcaaagtctccacgtctgaaatggttggactggtattagccatcatgacgacagtagtaaaaccacctgcagcggctgctagggcaccagtatgaatgtcttctttatgtgtttgaccaggttcacggaaatgaacatgaatatcgaccaagccaggagcaaccacaagaccagtagcatcaatcgtttctgctccttcttccgtgatctcagacgcaattttgataattttcccatcttgaactaagacatcacaaacttgatccaaaccagacttgggatccattacacgaccatttttgattagtagcatctgctttctcctttattcatagaaatcaacttgggtatccaacaatttatccccatcataaacaaacttggctgaaaagaagggtttatcctctaaaagccactcaacaaaggtgtggtcaccttcccaagtcggcttgctcaaaacctcatcatagggaacccattctagcgtcccctcattgcagtcaatcaagtcgccctcaaactccgtcaccttaaaaacataggtgtaccagtctaaatctggtgtaaattcaggaaaagtgatgacaccttttagaactggcttggctttgagccctgtttcttcaaggatttcacgcgccgcgcattcctggggcgtctctcctctctctagcttaccacccacaccaatccatttcccttcatggacatcattgggtttcttattacgatggagcatgagcagttctttcccattatcaatgtagcaaatcgtcgctaactgaggcatattttctccttatctaagccaatcgattggctcttgtcctgtctcttttaagaatgcattggccttggaaaagggcttggaaccccaaaatcctctataaaccgacaaaggacttggatgggctgattcgataatcaagtgatgaggattggtaactaatgccttcttcttacgtgcataagctccccagagtacaaaaacgactggtctatctagatgattgaccacctgaatcacagcatcagtaaaaggctcccagatttgaccagcatgaccattggcctgtccagcaggaacagtcaaacaagcattaagaagcaagactccttgctcagcccaagctgtcaaatcatgagatttcttaactccgatatcatctgacaattctttcaagatattttgcaaggatggtggagctgggatagagtcaggtacagaaaaactcaagccctgcgcttgacctggtccgtgataggggtcttgccctagaattaccaccttaacttcttcaagcagtgttgtcaagagagcctgaaaaaccttttccttgggtggataaataatcccctgagaatagacctgctccataaactgattgattttcccgaaataaccctcaggtaattgcgccttaatcaaagcatgccaagacgagtgttccatagccgactcgg

SEQ ID NO: 148 - DNA, 12127 bp; double-stranded, linear
aaaaaatagacttgttagactataaatgtagtaagcctacacaagaaaaatacatagagataaaggtgattattatgaaattcaaaaaaatgcttactcttgcagccattggcttatcaggatttgggcttgttgcctgtggcaatcagtcagctgcttccaaacagtcagcttcaggaacgattgaggtgatttcacgagaaaatggctctgggacacggggtgccttcacagaaatcacagggattctcaaaaaagacggtgataaaaaaattgacaacactgccaaaacagctgtgattcaaaatagtacagaaggtgttctctcagcagttcaagggaatgctaatgctatcggctacatctccttgggatctttaacgaaatctgtcaaggctttagagattgatggtgtcaaggctagtcgagacacagttttagatggtgaataccctcttcaacgtcccttcaacattgtttggtcttctaatctttccaagctaggtcaagattttatcagctttatccactccaaacaaggtcaacaagtggtcacagataataaatttattgaagctaaaaccgaaaccacggaatatacaagccaacacttatcaggcaagttgtctgttgtaggttccacttcagtatcttctttaatggaaaaattagcagaagcttataaaaaagaaaatccagaagttacgattgatattacctctaatgggtcttcagcaggtattaccgctgttaaggagaaaaccgctgatattggtatggtttctagggaattaactcctgaagaaggtaagagtctcacccatgatgctattgctttagacggtattgctgttgtggtcaataatgacaataaggcaagccaagtcagtatggctgaacttgcagacgtttttagtggcaaattaaccacctgggacaagattaaataaaatgtttgctccataaatctctaaagagatgcagacgtttcatcgtacaataagataaagaaggcaagtagggaggtgtcgtatctcccttactttcttcactagaaaggacaagatgtgacaaaacaagccttcaaagaagcagtttttagggcaatttttttcatgagtgcaacagtagctgttgtagctattttgctaatctgtttctttatttttagtaatggcttacctttcatagctaactacggctttgcccgttttttattaggcagtgattggtcgccaacgaacattccggcaagctatggtattttaccaatgatcgttggttccttattaattaccttaggagcgattgtgattggggtgccaacaggcatcttgacatcggtgtttatggtttattattgtccaaagcccgtctatggcttcttaaaatcagctatcaacttgatggcagccattccatctattgtttatggttttttcggcctacaattattggtgccttggattagaagctttttaggaaatggcatgagtgtcctaaccgcttcgttactattaggaataatgattttgccaaccattatcagtttgtcagaatctgctatccgaacagttcccaaaacgtattattctggtagcttggctctaggagctagtcatgaacggagtatttttagtgtcatcttgccagctgcgagatctggtattttatcagcagttattttaggaatcggtcgcgcagtaggtgaaaccatggcagttattttggtggcaggcaaccagccgattattccaagtggactcttttcaggaaccagaaccttaacaaccaatattgttctggaaatggcttacgcatcaggtcagcatagggaagcccttattgcaacctcagcagttctctttttccttattctcttgattaatgcctactttgcctacttgaaaggaaaatcatcttatgagtaaatacctgctaaaacttctcgtttattgtttttcagctttaacctttggctctctctttttaatcattggttttatcctcatcaaaggcttacctcatctaagtctatccctcttttcttggacttatacttctgagaacatttcccttatgccagcgattatttccaccgttattctggtctttggtgctcttcttttagccttgcccatagggatttttgctggtttttatcttgtggaatatacaaaaaaagattccctttgtgttaaaatcatgcgattggcctcagataccttatctgggattccttccattgtttttggtctgtttggcatgctcttctttgtagtcttcttaggttttcaatactctctgttatcaggaatcttaacctcagttatcatggtgttgccagtcattattcgctcaacagaagaagcccttttatctgttagtgatagcatgcgtcaagcaagttatggacttggggcaggtaagttacggactgtttttagaattgttctaccagttgccatgccaggtattttagctggagtgatactagctattggccgtatcgttggtgaaacagctgccctcatgtatacattaggtacctctaccaatacgccaagtagtctcatgtcttcaggccgttctctagccctacatatgtatatgctgtcaagtgaggggctacatgtcaatgaagcctatgctaccggcgtgattttgattattactgttttaatgataaatactctatcaagcttattatctcgaaaacttgtgaaaggagcttcctagtatgggaacattttcagtcagacacctagacttattttacggggattttcaagccttaaaaaatatttcgattcaattaccagaaagacagattactgccttgataggcccatctggttgtggcaaatcaacttttctaaaaacccttaaccggatgaacgatttggttccttcttgccatattgaaggccaagtcctcttagatgagcaagatatttatagtagcaaattcaaccttaatcagctacgtaagcgtgtagggatggtttttcaacagcctaatccctttgccatgtctatctatgataacgtggcttatggcccaaggacacatggtattcgagacaaaaaacaattagatgccttagtggagaaatctttaaaaggggcagccatttgggaagaagtcaaagatgatcttaaaaagagtgccatgtccttatctggcggtcagcagcaacgcctttgcattgcgcgagctttagcagtagaacctgatattctgttaatggatgagccgacttcagccttagaccctatctccactttaaaaattgaagacctcattcagcaactaaaaaaggattatacgattatcattgttacccataacatgcaacaagcttcacgtatttcagataaaactgcttttttcttaacaggagaaatttgcgaatttggagataccgttgacgtgtttaccaatccaaaagatcagcgcacagaagactatatttcaggacggttcggataaggaaggaaaaacctatgagaaatcaatttgacttagaattgcatgaattagaacaatcctttttaggactagggcaacttgtccttgaaacagcttcaaaagccttactggccttagcctccaaagacaaggagatggcagagctaattatcaataaggatcatgctatcaaccaaggtcaaagcgctatcgaattgacctgtgcccgtttgttggccttgcagcagccacaagtgtctgaccttcgatttgtgattagcatcatgtcttcttgttcagaccttgaacgtatgggagaccatatggcaggcattgccaaagctgttttgcaactaaaagaaaatcaactagcccctgacgaagaacagttacaccaaatgggtaaattatccctcagcatgctagccgatttattggttgcctttcctttgcaccaagcctcaaaagctattagtattgctcaaaaagatgaacagattgaccaatattattatgccttatcaaaggaaatcattggacttatgaaagaccaagaaacctcaattcccaatggaactcaatacctttatatcatagggcatctggaacgctcgctgattacattgctaacatttgtgaacgcctagtctacctagaaacaggagaactagtggatttgaattaattcaactaatccttaaaagagaagagtacgattaagtactcttttttatggttgtaaaaaagttcatttgaccaatttaagcagtgtagatagtgaggagttgtttcaattctatcgtgaacgagggaatgctgaaaactttatcaaagaaaggaaagcaggattctttggggataagacagatagttcgaccatgattaagaatgaagtacgtatgatgatgggctgtctggcttataatctctacctctttttaaagcagctagctggtgatgaagtaaagtccttgactatcaagcgttttcgacgtctcttccttcatattgccggaaaatatgtctctactgctagacgacatattctcaaattctcaagtctatacgcctattcaaaacagtttcaagccttatttgatacaatctgccagataaatctgatactccctgttccatatagagctagagggcaggggaaaacatgcctaacagaataagtcaccttattttaaaaatcgagcatcaaaccaagggaggagtctgcccttttttaggaaaaaatcaagacaaatctcctcaattatgtctcgaacatcagaaattaagcaaaatcaccagaaggacagtatttcaactagcttttctggtaatttttgaactgtgtagttcgttagtgccagatatgaataatttgggatgataaatctttcttcctcaggtagcctatcataatactcttcaaaaatcttatcaaaaacactctctttcttttgggcgatagtttcatcttcgtatgtaggagtcctcatcaagaaatacttcaattctaggtattccttatccaactctatataacttggcatcaacttgtaatcttcaacccccaaacgttcagcaatatattttaactttgttagtattggtctggattctccattttcaattctaattaattgacggatacttaattcagactcatcaccacaaaattctgaacgactgatttttttagccaaacgtaatcttttaattttttcgccaaactctcgcaacctacaagaacttcctgagttgtttacctctattataagcatatactgaatcaaactatctatcagatttcttctcactttaactaaagactaagagtttatcccttcgtctcggtttttgtgtatttttccaccataccccagtaatgcaagtgcaaaatcccctagaatatgatagaataagagaaagaactctatcaaggaggaaatcatggaaaaacaaaccgtcgccgtcttggggcctggttcttggggaaccgccctttcacaagtcttaaatgacaatggacacgaggtacgtatttggggaaatcttcccgagcaaatcaatgaaattaatacacaccatactaataagcactactttaaagatgtcgttctagacgaaaatatcattgcctacaccgacttagcagaaacattgaaagatgtggatgcgattttgtttgttgtcccaacaaaagtgacacgacttgttgcccagcaagttgcacaaaccttggaccataaggttatcatcatgcacgcatcaaagggattagaacctgatagccataaacgattatcaaccattcttgaagaagaaattcctgaacatctccgtagtgatatcgtcgttgtttcagggcctagtcatgcagaagagaccattgtgcgtgacctaactttaataactgctgcttctaaagatttacaaacagctcaatacgttcagaagctatttagtaatcactacttccgactttataccaatacggatgttatcggggttgaaactgctggtgctcttaaaaatattattgctgtcggtgctggagctttacatggtcttggatttggtgataatgctaaggcagccatcatcgctcgaggtttagcagaaatcacccgcctaggggtagcactcggggccagtccattgacctatagcggcttatctggtgtgggagatttgatcgtaacgggaacttccatccactctcgtaactggagagctggagatgctctcggacgaggagaatccctagctgatatagaagctaatatgggcatggtaatcgaaggaatttcaacgactcgagcagcctatgaactagcccaagaacttggagtctatatgcccattacacaggctatttaccaagttatttatcacggaaccaatatcaaagatgccatttatgacatcatgaacaatgaatttaaagcagaaaatgagtggtcttaaccctctatagaaaggatttttatgacatcaaaagttagaaaggcagtcatccctgctgctggactaggaactcgatttttaccagcaaccaaggcccttgccaaagaaatgttgccaatcgtagacaaaccaactatccagtttatcgtggaagaagctctcaaatcaggtattgaagatattctagttgtcactggtaaatcaaaacgttctattgaggaccactttgattcaaacttcgaattggaatataacctcaaagaaaaagggaaaacagatcttttgaagctagttgataaaacaactgacatgcgtctgcattttatccgccaaactcatccacgcggtctcggagatgctgttttgcaagccaaggctttcgtcggaaatgaaccttttgtcgttatgcttggtgatgacttgatggatatcacagacgaaaaggctgttccacttaccaaacaactcatggatgactacgagcgtacccacgcgtctactatcgctgtcatgccagtccctcatgacgaagtatctgcttacggggttattgctccgcaaggcgaaggaaaagatggtctttacagtgttgaaacctttgttgaaaaaccagctccagaggacgctcctagcgaccttgctattatcggacgctacctcctcacgcctgaaatttttgagattctcgaaaagcaagctccaggtgcaggaaatgaaattcagctgacagatgcaatcgacaccctcaataaaacacaacgtgtatttgctcgtgagttcaaaggggctcgttacgatgtcggagacaagtttggcttcatgaaaacatccatcgactacgccctcaaacacccacaagtcaaagatgatttgaagaattacctcatccaacttggaaaagaattgactgagaaggaataacaaaatcatttatataaagattagccacacataaattaagtaaattctctacttgaatctacctatttaataaaaactaatgaaaacgctatacttgtatttgttttttcattaaaataagagtagaataaattagtatagtaaaacaaaaaagcaccgaatcggtgcgcactttttcaagttgtgtacggacaaagccttattttaactttgctatgttgtttctaatggttccaaaataataaataattttaaatttgacttaactgttggagtagtcatggttaaattaaatcaaccgagccgaacataagttgtttaattttgtggaagctattaataaaaatataataagggagaaagataggtgtaattttaattttaaagtaattgcggacactatcaaagaaaaagattatggagaacaaatttgtagaatttatcgaaaacaataaaaaagtaatcatttcatcagttgcagttggtgttgtattggtattagggtttggatggtattcatataaccaacaacaagcagaacaacaagcaaaaattgtacaattagaaaaagatagcaaatcagacaaagaacaagttgataaactatttgaatcatttgatgcatcttcagatgaatctatttctaaattaaaagaactatctgaaacttcacttaaaaccgatgcaggtaaagactatcttaataacaaagtcaaagaatcatctaaagcaattgtagattttcatttgcaaaaaggtttggcttatgatgttaaagattcagatgacaaatttaaagataaagcaactcttgaaacaaatgtaaaagaaattacaaaacaaattgattttatcaaaaaagttgatgaaacttttaaacaagagaatttggaagaaactcttaaatctctaaatgatcttgttgataaatatcaaaaacaaatcgaacttttgaagaaagaagaagaaaaagctgctgaaaaagctgctgaaaaagcaaaggaatcttctagtcaaagtaattcttctggtagtgcttctaatgagtcttataatggatcttccaattcaaatgtagattatagttcatctgaacaaactaatggatattcaaataattatggcggtcaagattattctggttcaggagatagttcaacaaatggtggatcatcagaacaatattcatctagcaattcaaacagcggagcaaataatgtctacagatataaaggcactggtgctgacggctatcaaagatactactacaaagatcataataatggagatgtgtatgatgacgatggaaattaccttgggaactttggtggcggcattgcagaacctagtcaacgctaataactattttagagctgtgttgtttcgaatggttccaaaacacattaaaagctactcattttttaagtagcttttttcttattcaagtttacatattatactcaatgaaaatcaaattcaaaccacgtcagcatcgccttaccgtaggtatggttactgacttcgtcagtttcatctacaacctcaaaaccatgttttgagctgacttcgtcagttctatctacaacctcaaagcagtgctttgagcaacctgcggctagcttcctagtttgctctttgattttcattgagtattagtcgtcacaatcccattcccttgtagaaaagcaaaatggcgagtcctacgaacaagactaccgctcctaatctctggctggtgttatacatccgtttttctcctctaactggaaagataactgctagaaatgcgccaccaactgcaccaccgatatggcctgctaggctgattcctggaatcagaacacttccaataatgttaaccacaaaaagtgtcagataggattgccctagctgttggatataaggattgcgagttgcatagcgaagaacaataatcgcggcaaatagcccataaagagaggtagaggcgcctgctgctaaggatttaggactaaatacaaaaacaaagagattgcccatcattcctgataaaagatagagaaagaaaaactgcttagaaccgaaaatctcctctacctgccttccaagataataaagtgaaagcatattaacaatgaaatgttcccacccaatatgaacaaaaatggcagacaagagacgccaaacctgctcgggaaagaggcgaatagctggcccatacatggctccaaatcgaaataatgtatctgccctgtcaaagtttccgcctgcagtgaccaacattagtaaaaataccaaggccgtcactaagaggaagaaactcgtcacagggtaacgtctatcaaagatttccttcatcaattaatacctcctgaacaggaatatcatggttttcaggtataaagtcctgaatttgacaaggatatatcgtactcaaagtacgaccagaaaaatgttccagatagcggtcataatagcctccaccgtatcctatccgatatcctttcgtcgtaaaagccagaccaggaacatgaatcaaatcaatctgagatgcatccaccacttccaaatctccctgtagctccagtaaggcaaagaaagtttttaccaactgttgcggatcatagaccacaaagtccatgcgccccttgggataagttttgggtattaaaaccttcttgccgtccttcagcgcctgctcaatcagttcctgcgtttgaaactcatgagaaaaagagaggtaggttgcgatgaccttggcttcttgataaaaggggtgttgtaaaagccgctcggttaaagcttggtctatagcctgtttttgctcttgagatatagccttcatttcatgcaagacttgcttgcgtaattccgatttcatagacaagccctctattctgctgccttctttttcaggaaactagacaccgcagccaccccaatagctaagacttcttccttaggactcatttgagggtgatgaagagcgtagggactatcgatacctagccaaaacatcacgccatcaacctttgaaaggagataaccaaagtcctcgcctgtcatagcaggttcgatatcaatcaactcgattccgtctttttcgtcaaagaagtccatcagttcacgcgccaaggctggattgttctcaacaggtaggtatccaccttgtttgagttccacttcgacttccatatcaaaggcagctgcaaccccttctgcaactgtttttaccctcttttgcaccaagagactcatgtcctgtgtcaaggcacgaatagttccatgtaaaaaagctgtgtctgtgatgacattgttggtggttccagcttgaaaaacgccgaaggtcaccactgctccctcgattgggttgacattgcggctaacaactgactgcacttgggtcacaaagtaactagccgccaccaaggcgtcattggcttcatgaggaaaagctgcgtggccacctttgcctttgaaacggatcttcacctcgcaagttcctgcaaagagtgtatgagtattagtcgcaatctggccgactttcaaatctggacgaacatggagaccatagaattgatctggcaaccaatctccaaaagcaccgtcctcatacatgagcataccaccagcttcattttcttcagcaggctgaaatagaaagagcagattattcttgggttgctcctcaagggcgcgctcaagacagcctaaggcaatggtcatatgaaaatcatggacacaggcatgcatgcgaccttggtgttgagaagcaaaaggtagacctgtttgttcgacgataggcaggccatcaatatctgtccgccaaccaatggttcgctccggctgacttccctgcaggtagaccaaaatccctgtccgccaagtacgaatttgaacaaaatccttgcccgtagtcaatttctcaatcacatccagcaaataagcctgagtcttgaactcctccaagccaatctctggaatctggtgtaaatctcgtctagtctgaatcaaatctaacatctatctgtcctccgatatagcagaaagaggctggaaaaagggttccgcctcttttttacttttacaattacaaggtacgaagcgcatcctctagcgctgttttttgttgagtttgggcatcaatttctttgataatacgagctggaacacctgctactaccacgttttctgggacatcttgggtaacaatagctcctgctgcgacaactgaaccactaccgatttggactccttcgataaccactgcattagcaccgataagaacattgtctccgacacggactggttcagcactagctggctcaatcacacctgccaaaactgcacctgcaccaacgtggctattttttccaacgatggcacggccaccaaggatggcacccatgtcaatcatggttccagcaccgatttcagcaccgatattgataacagatcccatcatgataacagcattgtcaccaatttccacctggtcacggataatcgcacctggctcgatacgagcgttgatagcacgcttatctagcaaaggaactgcagaattacgagcatcttgctcgacaacataatcttgattttctaccaaaccttcaagaagcggagccacatccttccagtctccgaataggacatttcctagtttgacaacagagctaggcacagcagttgcgagttgcccctcaaaggttactttgacactggttttcttttcagcattggcgataaattggataatttcttgagcgttcatttttgtagcagtcataggtg

SEQ ID NO: 149 - DNA, 12566 bp; double-stranded, linear
ccatccttctgttgatgtgacaggaatgatgataaatcaaccagtagctagtcgcgaagaggtgacagaggctttgagtcacttggcggtagagcacaatagtctcattgctcgtcgaatcgttgagccaaatgaagctggagaaacacgctttacctatgccacttatggtgagggaaagcttccagaaggtctgaccatttcctccaaggagagtgcagaaacgagtgatttattagggtcttacttgattgtatcaggaagtttggatggagtgagcttacagaccaccttgaaagagcttggttatcaaggctttgtttcgaatggagaagatccattttcgatagtcttactattgacggccacccctatggtgctactgagtttagctatttttctgctgacctttatgagtctgaccctgatttatcggatcaaatcccttcgtcaggcagggattcgcttaatagctggtgagagcttgtttggagttgctctcagaccagtgttagaagatgtgagacagcttatctgctcagtgctggtatccagtcttttgggattggggattctctggtatcaaggtgccttgtttatggcaacggtgcaactggtcatcattgctcttctactttatggattgaccttggcagggatttctaccttactaagtgtcgtctatctacttggtttacaggaaaatagtctggtggatctattgaaagggaaactccctctcaaacgtatgatgacattgatgatggtggggcaactcttagctgtattggtggtcggatcgagtgcgacagctctcctaccccactaccgtgaaatgcaggaaatggagagagctagcaataaatggagccagtcctcagaccgttaccgtctatcctttggttggtctagtgcatttgccgatgaagaaggaacgcgtaaggataatcgtgagtggcagacatttactgaagaacggttagccaatacagactctttttatattatgagcaatgttgacaatttctcagatggagcagaagtggacctagatggcaatcgtctcagtgactacacaccgtcagggaatgttatctatgtctcaccgcgctatctgatagaagaaaagattaccgtttcttcagagtttatggacaagatgcaaaacttgtctgagggagagtttgggctgatcttgcctgagagcttgcgagagcagtctgtctactaccaaggattgtttacagattacctgcaaaacttttcatctgaaagtgtagaagtgacgagtcagaaacactacctcccacaggtaaggctagcttttacagaaacaggacaggaacgtttcctctataatgatgggtacaagacaacacgccagtacctaaaagatccgattattgtagttctaacgccgcaagcgactggaacaagacctgttgcagggatgttgtggggaactacggctaatagtgccttgaaactagatcgatatggagacagcatcacagctctaaaagagaaaggtctgtatcacaaggtttcttacttggtaaaaagccagctattttttgccaaggtactaaatgacaaacgggtggagttttactctctccttattgggacgattttgaccctgtctacggctatcttgttatttgattccatgaatcttctctattttgagcagttcagacgggaacttatgattaaacgtcttgctggtatgacaatctatgagcttcatggcaagtatttactggcgcaaggaggagttctcttgcttggcctagtcctatctagtattttgacaagagatggtttgattagcgctctagttgtagctttgtttacgcttaacgccctcttgattttagtaaggcaggacaaaaaagaagaagctggtagcatggcagtattgaaaggaaaataagatgattgatattcaaggattggaaaagaaatttaatgaccgcgcgattttctctggtttgaatctcaagctggagaagggcaaggtttatgccttaatcggaaagagtggaagcggaaagacgacgctgctgaatatcttgggaaagctagaaaagatagatggtggaagggttctctatcaggggaaagatttaaaaaccattcccactcgtgagtattttcgagaccagatgggctatctctttcaaaatttcggcctcttagaaaaccaatcaatcaaagaaaatttggatttgggttttgttggtcagaaaatctcaaaagtagaacgtttggaaaggcaagtgggggctttagaaaaagttaatctagggtatttggatttagaacaaaaaatctatactttatctgggggagaggcccaacgagttgcccttgctaagactattttgaaaaatccacccttgattttggcagatgaaccaacagcagctcttgatcctgaaaattcagaggaggttatgaatctcttggtggatttgaaagatgaaaatcgaattatcatcattgcgacccataatcccctagtctggaataaggctgatgaaatcattgatatgaggaaacttgctcatgtgtgaaaaaatccgtattcgcagggtatctgattatcctagtgccagaggtggtttagaagatatcctcatcatggaaaatatgaccaatcatctccttttggttcaaatccgagtgcatggctatttgcttgattttgctagtattgaagggcaaaggcaaaagcattatcgtttgaaaaatttacctcagacggttgaactgacagtggatgatgtggaggaggatgtggatttgaccctacctgaaaatcgaagttatcaagaagctgatttttttgaacgcatgtttcgagagaactgctaaggccacttttaaagatttccaagactatctttcttcatgaggaaagatagttttttggtatgattttcattcccaaaatacaaggggaatgtgttacaatagtagtaacagataatagaaaagagaatagatgagaattgcagattatagcgtgaccaaggcagtgctggagcgtcacggttttacctttaaaaagtcctttgggcaaaattttttgacggataccaatatccttcaaaaaattgtggatacggctgaaattgatgatcaggtcaatgtcatcgaaatcgggccaggtattggtgccttgacagaatttttggctgagcgtgcagcccaagtcatggcttttgagattgaccaccgtttggtgccaattttggcagataccctgcgtgattttgataatgtgaccgtagttaacgaagatattctcaaggttgatttggcgcaacatatccagaattttaaaaatcctgacctgccaatcaaggtagtggctaatttgccttactacatcacgacgcctattctcatgcacttgattgagagtggcattcctttttgtgagtttgtggtcatgatgcagaaagaagtagcggaccgcatttcagcccagcctaacaccaaggcttacggtagcttgtctatcgccgtgcagtattacatgacagccaaggttgcctttatcgtgcctcgtacggtctttgtgccagcgccaaatgtggattcagccatcttgaaaatggtgcgtcgtccagagccagccgtagcagtagaagatgagaactttttctttaaggtttccaaggctagttttacccatcgccgcaagaccttgtggaataacttgacaggttactttggtaagactgaagaggtcaaggacaagctgaccaaggctttggaccaggcaggcttgtcaccaagtgtgcgtggggaagctctcagcttggcagaatttgccggtctagcagacgcacttaaagggcaaggactctaagatgcagggacaaatcattaaagccttggcaggtttctactatgtggagagtgatggccaggtttatcaaacacgcgcgcgtgggaatttccgtaaaaaaggccataccccttatgttggggactgggtagatttctctgccgaggaaaattcagaaggctatatcctcaaaattcacgaacggaaaaacagtctggttcgtccgcctattgtcaatatcgatcaagctgtagtaatcatgtccgtcaaggaacctgattttaacagcaatttgctggatcgtttcttggttcttttggagcacaagggcatccatcccattgtctatatttccaaaatggatttgttggaagataggggagaactggatttttaccagcagacctatggtgacatcggctatgactttgtgaccagtaaagaggaactcctgtctttgttaacaggcaaggttacggtctttatggggcagacaggtgttgggaagtcaactcttctcaataaaatcgcaccagacctcaatcttgaaacgggagaaatttcagacagtctaggtcgcggtcgccataccactcgagctgttagtttttacaatctcaacgggggtaaaatcgcagatacaccaggattttcatccttggactatgaagtatcaagggctgaagacctcaatcaggctttcccagagattgctactgttagccgagattgtaagttccgtacttgtacccatacccatgagccgtcttgtgccgtcaaaccagctgttgaagagggtgttattgcaaccttccgttttgacaattacctgcaattccttagtgaaattgaaaatcgtagagaaacctataaaaaagtcagcaaaaaaattccaaaataaggagaaacctatgtctcaatacaagattgctccgtcaattctggcagcagattatgccaactttgaacgtgaaatcaaacgtctagaagcaactggggcagaatatgcccatatcgatatcatggacagtcattttgtaccgcaaatcagttttggtgcaggtgtggtcgagagccttcgtcctcatagtaagatggttttcgattgccacttgatggtgtcaaaccctgagcatcatctggaagattttgcgcgtgcaggtgcagacatcatcagtatccatgtagaagcaacgcctcatattcatggcgccctccaaaaaattcgttcactcggagttaagccttcagtcgttatcaatcctggcacatcagttgaagccatcaagcacgtccttcatctagttgaccaagttttagtcatgacggttaatccaggttttggtgggcaagcctttctgccagaaaccatggataaggtccgtgagttggttgctcttcgtgaggaaaaaggtttgaactttgaaatcgaagtggatggtgggattgatgaccaaactattgctcaagccaaagaagccggtgcgactgtttttgtagcaggttcctatgtctttaagggagaagtcaatgagcgagtacaaactctcagaaaacaactggactagggttgcagtttttgcaggcggaaaccgcggtcattatcggacagattttgatgcttttgttggggtggatcgaggctcgctctgggtcttggaagaagacttacctcttgctctagcagtcggagattttgattctgtgacggaagaagagcgacaggtgattcaaaaaggtgcccagtattttgtccaagcacgaccagaaaaggatgatacagatctggaattggctctcttaaccatctttgaacaaaatcctcaggctcaggtcactattttcggtgccttgggtggccgtattgaccatatgttggccaatgtctttctgcctagcaatcctaagttggcaccctatatgcatcaaatagaaattgaggatgggcaaaacttgattacttattgtccagaaggaatcagtcagctagaacctcgttcagactacgactatctagcctttatgccagttcgggatagccagctgactattcttggagccaagtatgagttgacagaggaaaattttttctttaaaaaagtgtacgcttctaacgaatatatagatagggaagtgtcggtaacttgcccagatggttatgtggtcgtactgcatagcaaggacaggaggtaggatggaaagtttacttattctattattaattgccaatctagctggtctctttctgatttggcaaaggcaggataggcaggagaaacacttaagtaagagcttggaggatcaggcagatcatttgtcagaccagttggattaccgctttgaccaagccagacaagccagccagttagaccaaaaagatttggaagtggttgtcagcgaccgtttgcaagaagtgcggattgaattgcaccaaggtctgacccaagtccgtcaagaaatgacagataatctcctccaaactagagacaagacagaccaacgtctccaagccttgcaggaatcaaatgagcaacgtttggaacaaatgcgccagacggtcgaggaaaaactagaaaagaccttgcagacacgcttacaggcttcctttgagacagtttctaaacaactggagtctgtcaatcgtggccttggagaaatgcagacagttgcccgtgatgtcggagctcttaacaaggttctctctggaaccaagacgcgagggattctgggagaattgcaactggggcaaattattgaagacatcatgacacctgcccagtacgaacgagaatacgcaacggttgaaaactctagtgaacgagtggagtatgccatcaagttacccggacaaggcgaccaagaatacgtctatctgccaattgactctaagtttccactggcagattattaccgcttggaagaagcctatgagacaggtgacaaggatgagattgaacgctgtcgtaagtcactcctagcaagcgtcaagcgctttgctagggatattaggaacaagtacatagcaccacctcggacgaccaattttggagttttgtttgttccgacagaaggtctctactcagaaatcgtccgcaatccggtcttctttgatgatttgagacgggaagaacagattattgttgcaggaccaagtaccctatcagcccttcttaactccctatcagttggtttcaagacccttaatatccaaaagagtgccgaccatatcagcaagactcttgccagtgtcaagaccgagtttggcaagtttggtggtattctggtcaaggcacaaaaacatctccaacatgcctctggcaatattgatgaattattaaaccgtcgtaccatagctatcgagcggacgctccgtcacattgagttgtcagaaggtgagcctgcgcttgatctactccattttcaagaaaatgaggaagaatatgaagattagtcacatgaaaaaagatgagttatttgaaggcttttacctaatcaaatcagctgacctgaggcaaactcgagctgggaaaaactacctagcctttaccttccaagatgatagtggcgagattgatgggaagctctgggatgcccaacctcataacattgaggcctttaccgcaggtaaggttgtccacatgaaaggacgccgagaagtttataacaatacccctcaagtcaatcaaattactctccgcctgcctcaagctggtgaacccaatgacccagctgatttcaaggtcaagtcaccagttgatgtcaaggaaattcgtgactacatgtcgcaaatgattttcaaaattgaaaatcctgtctggcaacggattgtccgaaatctctacaccaagtatgataaggaattctactcctatccagctgccaagaccaaccaccatgcctttgaaacgggcttggcctatcatacggcgaccatggtgcgtttggcagacgctattagcgaagtttatcctcagctcaataagagcctgctctatgcggggattatgttgcatgacttagctaaggtcatcgagttgacggggccagaccagacagagtacacagtgcgaggtaatcttcttggacatatcgctctcattgatagcgaaattaccaagacagttatggaactcggcatcgatgataccaaggaagaagtcgttttgcttcgtcatgtcatcctcagtcaccacggcttgcttgagtatggaagcccagtccgtccacgcattatggaagcagagattatccatatgattgacaatctggatgcaagcatgatgatgatgtcaacagctcttgctttggtggataaaggagagatgaccaataaaatcttcgctatggataatcgttccttctataaaccagatttagattaataatttaagaaaaatgagcattttttaggataagaatgttcgtttttttatgtgaatatggtataataagtaaaagacaaaaatgaatactcttcgaaaatctcttcaaactagggtagtatcgccttgtcgtatgtatatatgcaggtatattacagggtttgtcagttctattgacaatctcaaaacagtgttttgaaccaccagcgaccagctttctagtttgctttttgattttttgaataaaaatggaataggaaatagaaatgaaattaagaagaagtgatcggatggttgtcatttccaactatttgattaataatccttataaactaactagtctcaatacttttgctgaaaagtatgagtctgctaaatcatccatctcagaagatatcgtcattatcaaacgcgcctttgaggaaattgaaatcggtcatatccagacagtgactggggctggcggaggtgtcatcttcacaccgtctatttcgagtcaggatgctaaggaaatggttgaagacttgcgtaccaagttgtcagaaagtgaccgtatcttgccaggtggttatatctatctgtctgatttgcttagcacaccagccatcttgaaaaatattggtcgtattattgccaaaagctttatggaccaaaaaattgacgcggttatgaccgtagcaactaagggtgtgccacttgcaaatgcagttgccaatgtcctcaatgtctcttttgtcattgtgcgccgtgacctgaaaattaccgaaggttcaactgttagcgtcaactatgtttcaggttcaagtggtgaccgtatcgagaaaatgttcctttcaaaacgtagtcttaaggcaggcagccgtgtcttgattgtggatgacttcttgaaaggtggcggaacggtcaatggtatgattagtctcttgcgcgagttcgactcagaactggcaggtgtagcggtctttgcggacaatgcccaagaagaacgtgaaaagcagtttgactacaagtcactcttgaaggtaaccaatattgatgtcaagaaccaagccatcgatgttgaggttggcaatatctttgacgaagataaataagagatagaactaaaggttggaacgattgtcccagcctttctttgcaaacagaatagaaggaagcttatgaaaacaccatttatcaatagagaagagttagaagcgattgttgccgagttcccgactccctttcacttgtatgatgagaaggggattcgtgagaaggcaagagccgtcaaccaagctttttcgtggaacaagggctttaaggaatattttgcagttaaggctactccaactccagctattttgaaaattctccaagaagaaggttgtggtgtggactgctctagttatgtagagcttttgatgagccataaactggactttctgggttctgagattatgttctcttccaacaacacgccagacaaggaatacgcctatgcacgtgaattgggtgcgaccattaacttggatgcctttgaagatattgaacatctggagagagtagcaggcattccagaaatcatctcttgtcgttataatcctggaggcgtttttgaactggggacagacattatggacaatcctggggaggctaagtttggcatgaccaaggaccagctctttgaagcctttgctatcttgaaggaaaaaggagccaagacttttgggattcactccttcctagcgtccaataccgtgacccatctctattatccagagttggctcgtcagctctttgaactggctgttgaaatcaaggaaaagttgggcatttcgctagactttatcaatctttctggcggtattggtgttaattatcatccagaccaggagccgaacgatatcgccttgattggtgagggagttcgtaaggtgtatgaagaggttcttacgtcagcaggtcttggtcaggtcaagattttcaccgaattgggtcgttttatgctggcacctcacggtgctctagtcacaagagtcactcataagaaggaaacctaccgtacctatctaggtgtggatgcctcagcagtcaacctcatgcgtccagctatgtacggagcttaccatcatattagcaacgtgacccatccagatggaccagctgaagtggtagatgtggtcggttcactctgtgaaaacaatgataaatttgcagttaatcgcgaactgcctcatacagaaatcggtgatttgctggtcattcatgatacaggtgcccacggattttcaatgggctaccagtataatgccaaattacgttctgcggaaatcctctataccgaagaaggtaaagcccgtcaaatccgccgtgcagagcgccctgaggactattttgcaaccttatatggcttcgattttgaagaataatctgataatagattgaaaatgaaattgaaaaacagattgctttctaaaaaataggcaaaaatcttgtttttccttcaagtcgtgatataataaaactataaaacgttttcaaggaaggtaacgatatgtctgaagaaacaattgattatggacaagtgacaggaatggtgcattcgacagaaagctttgggtcagtagatgggcctggtattcgctttattgtctttttgcagggctgtcacatgcgttgccagtattgccacaacccagacacttgggctatggagtccaataagtcacgtgaacggacggtagatgatgtcttgacagaggccttgcgctaccgtggtttctggggaaataagggtgggattacagtcagtggaggagaagctctcttgcagattgatttcctgattgctctcttcaccaaggctaaggaacaaggaatccactgtaccttggacacctgtgctcttcctttccgtaataaaccacgttaccttgagaagtttgacaaactcatggctgtcactgacttggttcttttggatatcaaggaaatcaacgaagaacagcacaagattgtcactagccaaaccaataaaaatatcttggcttgtgcccagtatctatcagatattggaaaacctgtctggattcgccacgtgctagttccaggattgacagacagagatgatgacttgattgaacttggtaagttcgtcaagaccctcaaaaatgttgataagtttgaaattctaccttatcacaccatgggtgagttcaagtggcgtgaacttggaattccatattccctcgaaggagtcaaaccaccaacagcagatcgcgtcaagaacgctaaacaactcatggataccgaaagttatcaagattatatgaaacgtgtacatggatagaaaagaagcctgatggaaacatcgggcttttgacttgcaaaaagacttagcaaatcagctaagcctttttcttcttatctcgaacgttgttttccagcgttgcgatttttgtgttttttcttgcttgtgatagcagttggttgttcaggggtaacgtcttttcgtccacttggtttagagaaagcacttgcttttggtgggttcttggctagttcttcacggacttttttgcgaagttttggacgaacgatatagttgacgataaactgttggagaatcatcatgaaaccaccgacaacccagtaaagtgtgacactagctggtgagaagagggagaagacgacgatcatgagtgggctcatgtaaatcattttcttgatttgttctctttgcatttcatcttctactccgtgaagtgaaaggagcgattgaagatagtaaaggacaccagcacaggcaaccaaaatcatacttggagaacctagaggaatgcctaggtagcttgcttgagcaaccccttcagtatgttgggcagcaaagtagatagcagagaagaaaggcatttgaaggaggatagggaaacatcctacaccgccaaacatgctgataccgtgctctttttgagcagcaaagagagcttgttgggcttcgagtttttcttcttgagtagtcgcttctttgagacgcgtttggtgtggctcaaggacgtgcttgagggcgttcatcttttcagagtgaagcgttgccttccatgattggtagataccaagtggtaagataatcaagcgtacgataatggttacgataatgatagcgacaccaaagcctagacctttatcagtagcgaagtacttgatggcttcagccataggcgctccgatcgtattccaaataaatcctgttggctgacctgtggttttatcgacattgacacagccagtcaagacaagcaacatagccactcccatagccgagagtgcaaaatcggggt

SEQ ID NO: 150 - DNA, 5238 bp; double-stranded, linear
tgacactctgtaggattgtcgttaattgattgctcgtactctctacaataaccaccaaagtaaaaacgacatagaaagatagcatcagctgtagccatagcgcctttgacaccttctggatgattatgagttacctctgcagaaagactcgtaagtcctctagatgatggccatataccagttttcgcataaaaaccacagtccatgatccaagcacatggagaaatacgcatagctgatccattcccaaagctattataaggctcacggttatcgctgtttagccatgcattaaaccgagcaccgtaatcagcattcggatacattctgccatatttcttcatcgcgtcaatgaagtcatctttttgtccaccattcataattgcttctgcaacagcacaggtcataaccgtgtcatctgtaaaaaagcagtccttccgaaataaaggaaagtcctttgttttgatattgttccattcgtaaacagaaccgacaatatctccaataattgctccaagcatcagattcctccttgttcattttgatgctttttatattggttatctaccatatttattttagaaaataacatcctgttggattttaaaaatttcatttttttcaaaatagggttttaccatttctttccacctagctctatgaaaattgattgattttaaaggagataggccataatttcccaatgcataaccatcatttacttcaacaacaagtgttctgccatcgcgagtaacaccgatatctagtccataagctattggcgcatctttccaacatgatatcgcttcatcaattacacttgcatcaaattgtgcatgataatcacctgtatagggtcgaacatctaatacgcgaccatctaacacaaaacaacgccattcagctatgaattctacaacctcactaatccatataggatagtcgaaaggtagaccaatacctattaaatcatgggttccattaacaactcttccagtaaagacttttgaaccagctttaggcttaataaattttccccaattatcaggtatattcacaatctctcctaaaataccagcataaatctttcgaccataaaactctttaagctcaataggatagtcatgaaccggaacgtttaagcccatcatttttagtaatgctctagtctccattatataatctacaactatatcttcacttgttaactcttttatttcagaaaaagattgatataaaataacttcttctccttgtaagtaggcacctacttgagcattgtatttattaattgaaacctcacttggtaatttactttgtctaatataaacaaccatttcatcactcctatatcactagtgttacaccaatttgtaaaaaataatagcaattttgctcttatttttttgagtaaatagcccccataatatcatcgaaataatcaacggtatttaggagtaattcaataacctgggactttgttagtcgcattccccttctatctctagcatcttctactaaattttcaagtttctctagatttttatcatccaagctaatcattattctatttttatcggttgccattttcatcacctcaagttaattctatcacaggtgtaacactagtgtcaactggcttttataatacattagtttaaaagtggagaggatttttaacacagtaactttaaatctttggtattaaaaaattttcacaatatttatagaaataaaatctgtctcaaatcagttatcaaatctagtataaattatgagcggctactctaatactttccctctaaacaagaaaaagacttacactcaagggttttcttcccccccttcgttataacgttttgactcttttactagcaaaggtatatactcacaaggaactttggttgactattgaatctctccaacttcttctttaacatatccttctacatcttcaatctctacaaacattgggtctaagtgacacaagaaatgccaaacttcgatccctttttttctgtaaagaatcgcttcaccgtcttcacttccgaaaaagcttctgtcgatttcatatccgcggctttctaagaagtcttttgctttacgatagttcgtttctcttgtttcgacataggctttaacttcatggttgttaacgacatatgcatcaatttttgaatatccttcgatcactctatcatttttgagggataaatttgaaatctctttccaaataatgtttacattttcctcaggatcgaacataaatttagataaaggaacaatatttccgttaaaaataatttccatataatccggtatgtttttaggattaaaatactccacttcaaaaccatcttctgtttccagagtgtatcccgggatttgagctacaaaggctttcccatcttctatggaatcaaatgctactaaatctttagaataatcattttggtacaattccaatataaccatcgataatctctccattttcattatcaggctaatgtaaataagcacgtcacctgaccaattcaggctctctgtatcatctcatcatatttcctacttactttacgagtcttatacccagaacacaccttatcgaccttcggtctcacctcgtcgcattggctgaacatctacttttactttgctgatgcttcaactcgtacaagcagtgataccgcctcagcgtgatgcgtcagtgggactcaaaaggttcggggaaccttttgaggattaactacgtttctctaataaacttacacattcaacttgttcatcattgtccaaacctatgttgagattttcttctataattggtagcttaaaagtaatggattttagccattgtccgttagattgtttttcttcataaacttgaatttcagaaatcaaagctgaaattaactgcctacgctctacatcattcatgactttatagagcttatcaaaatagatcagaaccttatatatgttatctcctgtaagcttttcagcttcaatagtctgtttctttgctttcgcatcaattagtgatgattctaattcatctagtttgtcatacatacgatatagtctatcatctaaatcctgtttccttctcttataatgcttatcttcaacatctaaattatctatttcctcaattagcttaaactttgtagaatgactctttctcaattccttttggtaattatctatttctttttctatttcagaggtatccaccttcatgttgattttttcttgcatcatagaagcaaatttcggattacttactatcttgacaatcacctctgcaacagcatcatctaacaattcttctctaatttgcttactgaatgtacacttattacctcttatcatctgcctatggttacaaccatagtaataaaaatctttatactttgtgccatctttctttttcttgatacacttgttcccaaacattcccactccacatatcgggcattttacaattccagaaagcaagtgtgtgcgtgtatcttttcctttattcacatgctcatatttctttgcttgagattttagcttaacctgagcagcttgccaaacttcatcggaaactatagcttcatgtatcccttcagatattagatattcatcttgttcaacctgcttatattcatttcttgtaccatgaactttttctaaagttcttcttccaaatgctattttcccattatatacaggattctttaatatctttcttataagacctgcatcaaacaaaggattcttaccattctgtcttgggatttttctaattccatgattctctaagtatttagatatcccattggctcctatcgtagtatttacatactggtcgaaaatcgttcttattgcaactgcctcttcctcatttataaacagcttgccgtcttcaagtttatatccatacggagcaaagccaccattccattttccttcccctgctttttgaatgcgaccttccattgtttgaatactgatgttttctctttctatttcagccacagctgataaaacagaaatcattagtttcccagcatctttagatgaatcaatgccatcttcaacgcagataagattaactccataatcctgcattatatgaagtgtagaaagaacatcagcggcatttcttgcaaatcttgataacttaaacacaagaacaaaagatactccatcttttccagattttatatcttccatcattcgattgaactgtattctaccttcaatagacttgtcagacttcccggcatcttcatactctccaacaatttcataatcgttgtaaatagcaaaagctttcattcgtgatttttgtgcctctaacgaatacccctctatctgtattgacgtagatactcgtgtatagaggtatacttttattttttcttttgacatagtattaacctcaatataatttttctatatcatatataatttttttaatttaagtttggactatcatttcaagtatattataacacttttattagtccgtctcaatttgtgtttttgccatgtcaaaactatttttcatctcttgattttttgctggcgttggatcgggtagattatctaaatctaaagcaccagcatattttgcaatcagatttgctattaaatcagccaatccattccagtcattgtccaatatatacctcctctaaagttttatatctaataattatttgtttaattaagttttttgacattgacaagtgctttggattagcaacataggaatctcacttccgcctctattccggatgagccggcttcaaccttagaagtatcattaccctcattttcttcatagcggatagggtatccctccctatattcaaactcttacttatcgctcactttctttttgcttagcagaactttttttgccgaattattcagccgaaagatcttgacggataggttattacgctccaaaaataattaacgtcttgtcttggtctattcaattgttaaggttcaaaatttatcgagagttattaatctttttaaaatttgaccatcagaaaatatttatcttgatgtaacaaaattctataaattaccctcttatacttaacagtgaaaagaagtctttcttggtaaccaattttgaaatagaatttgcttatataaaaaggtccaattcccactgcataaatagcagtgaaaattagaccctcttggtaactgtcatctaaaagtcttcta

SEQ ID NO: 151 - DNA, 13425 bp; double-stranded, linear
gacgatttacgaagaatcgaacaagaacctgctcctatcaattcccaacctctatctctaaaatcttgcagttcatgcttatacttttttaagaaatctagaatcatagatacggtagatgacatcgtctggttgacattggtcaaaatagaacaaaccaaaacgactcgttctatacctccaacctttcaaatgcatctcatgtaaatgttcttcttccttgtccaaatcaacaatggtgaaaatccgaaattctactctgctattcattgtcttaccccaaaattagaaaacatgcctggcgttatttattagataattctttccacttttgactcaatctccaaaaaatataagaaatctgaatcgcaaaaactatcaataaaacccaatctattatgaaaatcaaaaacactttccaactgaaagaactacctccagtgacaaactttgagaaaaacggtagtagagctaaaaagagaaataaaataggaagcatccgcattgttaaaatccgtttggcataaaaaaatctttatttaaacgaaaatattatggcaaaatttacgccagtttttgaacggctgatgtagatattttatactttcaaaatgtttaaatgtgattatttatttttgaaaaatagatcaccagcccgactgaaagtgcttatagaatgataataagtcgcctgccgaaaacagcgaaaaatagcggtgttatgcggagataatctgacgcgatgcgaaagtatattgcatacttattttcaacaatttagcagagtatttttataagtgtgatataatagaagtataatttgttctgatagtttattttatggagaagtagatttttagaatgcggagggttcaatatggttgagtttataaagtctaagaaagaaatgagtgaggaggatattaaagcaaatttcatcactcctgctattgtatccaaaggatggaaaaatggtgagcatatcgcttacgaagaatacttcactgatggtcgaattgaagttagaggagataaggctcgtcgtaaagaaggaaaaaaatcagactattcactgtattaccaatttggaactcgaattgcaattgttgaggcaaaggataataaacacagcgttcgagcaggattacaacaagctattgaatatggagagattttagatgttccatttgtttattcttcgaatggtgatggctttattgaacacgaccgtatcacgagagaagaacgtgagctggagttagacgaattccctactcgtgaagaattattttctcgtatgacgaaggaaaaaggattgacgtacgaaattacagaagctatctcaactccatactatacagacgccttctcaatgaaaacgccacgctattatcagcaaatagctatcaaccgtactattgaaacagttgccagaggacaaaaacgagtaatgtttgtgatggcaacaggaacggggaaaacgttcatggcttttcaaattattcatcgccttcgaaaagctggtttggctaaacgagttttattcttagcagatagaaacatcttagtagaccaaacgatggctgaagactttaggccattcgaaaaggtaatgacgaaaattacaccaaaacttttgactgctcctgaaaaattaaattcttttgaaatttatctagggctttatcagcaactaactggtgaagatggaactgaaacacattatcaaaaatttgacaaagacttctttgatttaatcgtaattgatgaagcgcaccgtggttcagctaaggaaaacagtaactggcgtaaggtaattgattatttcagttctgcgacacagattgggatgaccgctactcttaaagaaaccaagaatgcttccaatacggaatactttggtgagccaatctatacttatagtttaaaacagggaatcgaggatggttttttggctccatatcgtgttatgagggttaatttagatgtggatgtggatggttatcgtccagaaactggaaaagttgatgctaacggacaattaatagaagataggtactacggcaggaaagattttgataaaaccattgtcattgatgatagaacgcaaagagttgccaagtttgtttctgattatatgaagcaaaacaatgcacgatttgataaaacaattgttttttgtgttgatattgaccatgccgagcgaatgcgtgctgcacttgtaaaagagaatctagacttagtccaagaagactatcgttatgtcatgcaagtaactggtgacaacgctgaaggaaaagctcaactggataactttatggatgtcaattctaattttcccgctattgtaacaacgtctaaattattaacgacaggagttaatgctaaaacatgtcgtttgattgttttagactctaatatccaatccatgactgaatttaaacaaattattggtcgtggcacacgtctttatcctcaaaaggggaaagaattttttacgattattgattttcgaaatgttaccaatttgtttgctgaccctgattttgatggtgatccagtgaaggtgctagaaacaggtgcgaaaacagtcagtggttctacgcccggtttcgtagatgaggaaggtgacccagtagaaaaatatatcgttacagacaagcaggttaccattcttaattctactgttcaagtattggatgaaaacgggaaactgattaccgaaagcctgaccgactacactcgaaagaatatcttaggtagctacgccactttgaacgattttatcacagtttggcatacggcagataagaagaagcttatcttagacgaactttataaaaaaggagtttatctagatgctattcgagagtcggagggaatatcagaacaagaaatcgatgattttgatttactcctaaaacttgcctatggtcaaaaagaattaaccaaaacggaacgtatcaataaactcaaacaaagcggatatttatataaatatagtgaggaagcgcgtgctgttttggaaattttactgaacaaatacatggataaaggtattggagaactcgaaagcattgaaacattaaaacttccagaatttcagatatatggtggaaccttcaaaatcatcaatacttattttggagataaaaaacgatatttacaagcaattaaagaattggagcaagagctatttacagtagcttaatgaaaggaaagtatgtcaattacatcatttgtaaaaagaattcaagatatcactcgaaacgatgctggtgttaatggtgatgctcaacgtattgagcaaatgtcttggttattattcttaaaaatttatgatagccgtgaaatggtttgggaattagaagaagacgagtatgagtcaattatcccagaggaattaaaatggcgaaattgggctcatgctcaaaatggggaacgggtattgacaggcgatgaattacttgattttgtcaataacaagttattcaaagagttgaaagagcttgaaataacttcaaatatgcctattcgaaaaacgattgttaaatcagcttttgaagatgcgaacaactatatgaaaaatggcgtcttgttacgccaagtcatcaatgttattgatgaagttgatttcaatagccctgaagatcgtcattcgtttaatgatatttacgaaaaaattcttaaagatattcaaaatgctgggaactcaggagaattttatacgccacgtgcagcgactgattttattgccgaagttcttgacccaaaacttggagaatcaatggcagaccttgcttgcggaacaggaggcttcttgacttcgactctgaaccgtttaagtagtcaacgtaaaactagtgaagataccaaaaaatataatacagctgtttttggtattgaaaagaaagcatttcctcatcttttagcagttacaaatctgtttcttcacgaaattgatgaccctaaaattgttcatggaaatactttggagaaaaatgttcgtgaatatacggatgatgaaaaatttgacattattatgatgaatccaccttttggagggtcagaattagaaacaataaaaaataactttccagcagaattacggagttctgaaacagctgatttatttatggctgtcattatgtatcgtttgaaagaaaatggtcgtgttggagttattttacctgatggttttctatttggtgaaggtgtaaaaactcgcttgaaacaaaaactggtagatgagttcaacttgcatacgattattaggttgcctcatagtgtctttgcaccgtatacaggaatccatacgaacattcttttctttgataaaacaaagaaaacagaagaaacttggttttatcgtttagatatgccagatggttataaaaatttctcgaaaactaagccgatgaagtcagaacacttcaatcctgttcgtgactggtgggaaaatcgtgaagagattctggaaggtaagttctacaaatctaaatcatttacacctagtgaattggctgagttgaattataatttagaccagtgtgactttccaaaagaggaagaggaaatcttaaatccctttgagttgattcagaattatcaagcggaaagagcaactttaaatcataagattgataatgtattagctgatattttgcagttgttggaggacaaataatgacaccagaacaacttaaagcaagtattctccaaagagcgatggaagggaaattagtgccgcaaaatcccaatgacgaacctgcaagtgaattattaaagagaattaaagctgaaaaagaaaaacttatcagtgaaggaaaaatcaaacgagataaaaaggaaactgagatatttcgtggtgatgatgggaaacattatgggaagtttgctgatggaagcactcaagaaattgatgttccttatgatattcctgatacttgggagtgggtgaggttttctacattggttgaaattgtcagaggtggctctccacgaccaatcaaagattatcttacttctgaagtagatggaataaattggataaaaataggtgatactgaaaagggtgaaaagtatataaataatgttaaagaaaaaatcaaaaaatcagggcttaacaaaactagatttgtaaaaaaaggtacatttttgttaactaattctatgagttttggtagaccttatattttgaatgttgatggtgcaatacacgatggatggttggctatttcgaactatgaaaactcattaaataaagattacctattctatattctttcatcaaatgtagtttattctcaatttctatctctaattagtggagctgttgtgaaaaacttgaatagtgataaagttgcttctattcttatccctctccccccactatccgaacaacaacgaatagtagaagcaatcgaatcagctttagaaaaagtagatgaatatgctgaaagttataatagactagaacagctagataaagaatttccagataaactaaaaaaatctattcttcaatatgctatgcaaggaaaattagttgaacaagacccaaatgatgaatcagtcgaagttttacttgaaaaaatacgagcagaaaaacaaaaactctttgaagaaggcaagattaaaaagaaagatttggacatttctattgtttcccaaggagatgataactcttattatgggaatatacctatgaattgggttgttataaaaataaaagatattttttcaataaatacaggtctttcttacaagaagggcgatttaagcattaataataaaggtgttagaattatacgtggtggtaatattaagcctttagaattttctctgttggataatgattactacattgatacacaattcatctcctctgagcaagtttatttaaaacataatcagctaataacacctgtatcaacctctttagaacatattggaaagtttgcaagaatcgataaagactatgatggtgttgtggctggtggatttattttccaattaacaccattcgaaagttcagagattatttcaaaatttctattatttaacttgtcctctccgttattttataaacaattgaaagcaataactaaactatcaggtcaagctttatataatattcctaaaactacactgagcgagctattaattccgttagctccttttgaggaacaggaacttattactcaaaaagttgagaaactttttgaaaaagtaaatcaactttgaaaatgattcttttcatctcttcatgattagaaatagggattaataattcggagatactggtactatttaatgttttccctttgatagcatcttttgaatcacctaaagtagagataagtggcaaaaatatcattaagtaatctctgataatattttctttattagcataggggaatatcgatataatggcttcattatgagtggcaggaatatccaatatggcaacttttccaatagataatttaaaactcattaataaagttcctttaggtgaaatgtctattttctttgattttaatgctaatttagaaatagattctctcgcattagttacataaccagatataggcatatctgatatagatacccaaggtatttcagttccccaaaaagtagcttcactgcgtggaggagtttttcctattctgaagttaactaggctagcaaatttaatatatctccatgcttctgggatttcatatataggataagaggttgtttcgtctttgttcccataataagagccataatcacaaaaatagcaggtagtcagtttgaccacctgttattttttaccaattaacaattttatctacaatattttgttgttcagtagctgttttccttagataaattcgagtagtttctatactttcgtgtcccatcaaatctgcaagcaaggcaatatcattatacttcgctaaaaaattcttagcaaataaatgcctaaaagaatgagggtaaattacgttaggattcattttgtatttatcagcataattttttaactgttgagcaactcctcttgctgtaattggttcgttaaatttattcaaaaataaataaccacttcggcgattttctgattctaaccaactaagacaactatttcttaattttttaggaatgtacagtctacgaattttaccaccttttgagtaaatgtcaaaataaccgatttctacatgctctacttttagtttaataagttcacttacacgagccccagttgcacctaaaaaccaaacgacaaaatgccattttaaaataccatcttttttcaaactacgtttaagaaaaaggtaatcagcatggctaatgacatcttctaaaaacggtttttgctgtactttgacaaattttaatttcaaatcatcatgaccaataaaagccagatatttatttactccttgtagtcgcaaattgacagttttaggtttaaaattgtctaataaatatcctttgtattcaaataaatcttccattttgagttcgtaattctccaagaaaaatcgaacaccataaaggtacgaacgcacagtattttcagctaaaccagctttcttcaaatgtaattcaaaatctttcaacgtaaaactcctatcttatgtttgatagaaattccaccgcacgtaaaactattatactaaattagtgcgtcaatatgggcgaaaaattgttcgattttatcaacgattctggattgttcaggaaggggtgggagggggattaaatattcttttatagttttcgttaataattctttttgttttgtactacccgacgctttttcttcaataactgactgaacaataggagaggaaagaaaattatagatgaaatggcaattaataacccccgataagactcttataactgtaacatggctatctgcaacagcccagccataaggatttttattttcatggtaaatagctaatcgtcctaacgtacctagacctgttgaattccacattaaatcaccatctcttagtaatctttctttctggtaactatgaactgtttcgggatcaataaatcttgctaagtcaatagaaaagccagaccattgattacatttctgagcaatcacagggtatataggaatatttgaatattttggagacttccctctttgaatgtaggaggttatatcgtttaacctcacccattcccaactttctggtatttcacaaggtacttcctcataataagagttatcatctccttgggaaacaatagaaatgtccaaatctttctttttaatcttgccttcttcaaagagtttttgtttttctgctcgtattttttcaagtaaaacttcgactgattcatcatttgggtcttgttcaactaattttccttgcatagcatattgaagaatagatttttttagtttatctggaaattctttatctagctgttctagtctattataactttcagcatattcatctactttttctaaagctgattcgattgcttctactattcgttgttgttcggatagtggggggagagcaattaataatagattaaaattataatcattgattgcaggataacttgttccagtagatttattattaacacgattgataaaattatctgataataaataatatttcaaatatgtttcgttaagtaaagtatccaaaacaataaatgctgtactagctatcaaatactctttaagttctctaactacagcaatattttttagatatggtctaactgttgaaaataagacactattctgcgaaactaattttctagcacgggaaggcgcttgttcaggtgaaagatattgtagatttttgtagttgattatgttcttttttctatcaatactagacgtatctatatacctaaaggatttctctggcttattttgcccaaaattccaataaattgattttatcctcacccactcccaagtatcaggaatatcataaggaacatcaatttcttgagtgcttccatcagcaaacttcccataatgtttcttatgtgcttcaagtatataaaaaggcgtaaaaatacgcctatagataatggggttgaaataggtttattgttgatgagattgtagataattcaattttttacttccaatcgaatattcaaatcctccaccttttctgcctgtaattgttcatcataaaattcaatatcttcaggattttccccttggcaacctcggcagaaatattcttccgctcgatcaggattcaaaaatcgacaagcacaaacaaaacagtcgccatcatcatttattgagataatatagtagattgaaataagatgtaaacaaatcgattaggaaagttaaattagtttctagaaatttttagcagatgtagtgtactattctagtctcaatttactatggcttcaaatatatctttcgaaaaaatatttacagatgtgtaattttgaagcttgcaaaagttagtaaacttgtagatttcgatttgaagtaacttgttttcttgcccgatattgtttttgaaattgaatttttccatagtgactccttaattttcttctacacgtctgatgataaatctaattcgcaaaagagtcaagaggatttttcgaaaaataaatagcgaccgaaatcgctattttaagggttataggtatttgatggcttagactgctgtgtgactgtttacccacaggcaatctttcttctatattagtattagtaaaggtctaaataattatcaatttcccattgtgaaacgaaggttgcataacttgcccattcgattcgtttggcttcaaggaagctagtatagatgtgatctccgagagcagctttaaccacttcatcttctgtcaaagctttcaaagcgttgtgaagagttgatggaaggtctgtaataccagcttccttgcgctcttctgctgtcatgatgtagatattttcttcgataggagctggtgcttcgattttattttcaataccatacaaaccaacttccaaaagaacagccatagcaacgtaagggttcgccattggatccactgaacgcaactcaagacgagttcccataccacgtgaagcaggtacgcgcacaagtggcgaacggttacgaccagcccaagcaatgtaaacaggcgcttcataacctggaaccaaacgtttgtatgagttaactgttgggttcatgatggcagtatagttgtaagcatgcttgatcaaaccgcctaggaaatggtaagctgtttctgacaactgcattccttttggatcatttggatcaaagaaggcgttatttccttctgcatcaaacaaggacatattacagtgcatacctgatccagcaataccaaattttggcttcgccataaatgttgcgtaaagtccgtgtttgcgagcaatggttttaacaacaagcttaaagatttgaatcttatcacaagcacggagaacttcatcgtacttaaagtcaatctcatgctgtccaaccgcaacctcgtggtgactcgcttctacttcaaatcccattttggtcaagacattcacaatctcacgacgtgtgttgtccgcaaggtcagtaggtgccaagtcaaagtagccacccttgtcattcacttcaagtgttgggtccccattttcatccaacttaaataggaagaattctggctctggaccaaggttgaaggatttgaatccaacttcttccatgtgacgaagagctcgtttcaaattaccacgagggtcacccgcaaatggttcaccttctgttgtatagacatcacagatcagacctgcaacacttccattttcatctccccaagggaagactgtccatgtatccaagtccgggtacaagtacatatccgactcattgatacgtacaaaaccttcaatagaagatccatcaaacataaccttgttcgacaagaccttatctaactgttcatctgtagcaggaatttcgacgtttttcatggttcccaaaatatctgagaacataagacgaataaaggtaacatttttttccttgacttcacgacgaatatctgcagctgtgattggcataagttttctccttaatctatgactacttgcggttgcctaaccgcgaccaaaaggtgactgtactgaagcaaaacgcccctgttggaggagttcattgtgaagtgcacgacgtacttcagtctgactaaccgctttcttggatttcgcttcacgttcagcatattttttcttaatggcagcgatattataaccttcagagatataatctttgatttcaagcagacgatccatgtcattcaaggaatacatgcgacgatttccttcgtttcgatcgggcttgatcaactcttgatcttcataataacgaatctgacgcgccgatagatcggtcaacttcataacactgccgataggaaaaacagccatatttcggcgaaattctttttccttcatttacaatttccttctttctgtctattatagtctaaaaaaagacaaacgtcaattgataatgttataaaatgtaacattatttttcttttttctctaaaaagagacgaatacgatcaatatcgtaatttacgataattgcgacaaaaactcccataaacgtttctaatacacgcacaaacacgtacaaaattgtctcaccacttggaattgatagggtaatgattaacatagctgctacaccaccaataacccctgctttgttattcatggctacatttgtcataatggttaacatggtgcagattggaacaactaccaaggtcacccaaaaggcttcgtggaaaaaggtatttaataagaagaagaccaaggcatagagtccaccgatactatttcctagaatacgcgaagtcccaaaatgaacactctcatcaaaactctccctcaggctaaaaacggctgtcaaagcaccaatttgaagacctttccagccaaaaaagccaaaaatcaagagaactagaaaaacagcaatacctgttttaaaggttcgcataccaagtttgaactgggatttatcgaatttatattttttaaaataactcataatctcaactttctatttccattttatcataaatcggtgatttttatgagtaatagttgagaggaagcgtttttattttaagcaaaagaaaagaggaactttcatccctctcttctttgatttatttataaaatcttatttttctgtcaaggctgcaagtcctggaagaaccttaccttcaagaagttccattgatgctccaccacccgtactaatccatgagaacttgtctgcacggccaaggttaatcgctgcggcagctgagtcaccaccaccgatgattgatttaactcctggttgtttcacgatagcgtccatcacaccgattgtaccagcttggaaatctgggttttcaaatacacccataggtccgttccatacgactgttttggcaccagtcaaagcttcgtcaaatttggcgatagattttggaccgatgtcaagaccaaggaagccttcagaaactgcttcaccttcagtgtcacgcacttcagtgtaaccagcaaatgcgttagcttcttttgagtcaactggcaagatcaatttaccatttgctttttcaagaagagctttcgcaacatccaatttgtcttcttctacaagtgagttaccgatttcgataccttgtgctttgtagaatgtgtaagtcatcccaccaccgataaggacgttatcagctttttcaagcaagttttcgataacaccgatcttgtctgaaacttttgaaccaccaaggatagccacgaatggacgttctggagtttcaactgcttcttggatgtaggcaatttcgttttcaagaaggaaaccagcaactgctttttcaacgtttgctgagataccaacgttagatgcgtgtgcacggtgagctgtaccgaatgcatcgtttacgaagataccatctccaagtgatgcccagtatttaccaagttcaggatcgtttttagattctttcttgccgtcaacatcttcgtaacgagtgttttcaaccaagagaacttgtccatcttcaagagcgttgattgccgcttctaattcagcaccacgagtgacacctgggaaaacaacatcttgaccaagttttgctgccaagtcagctgctacaggagcaagtgatttaccagctttatcagcttcttctttcacacgtccaaggtgagagaaaagaattgcacgtccaccttgttcgatgatgtacttaatagttggaagagctgctgtgatacggttatcgttagtgattacgccatctttcaatggtacgttgaagtcaacacgaacgaggacttttttacctttcaagtcaacgtctttaacagtaagttttgccatgttacaaaaactccgg

SEQ ID NO: 152 - DNA, 905 bp; double-stranded, linear
gatttatcctaccggngaatttccggaggggttctagcagcaatcttaggaatctatgaacgaatgattggctttctggcccatccctttaaagactttaaagaaaatgttttgtactttattccagttgccatcggtatgcttctgggaatcggcttattttcctacccgattgaatacctgcttgaaaattatcaggtttttgtattatggagctttgcgggagctattatcggtacagttcctagcctcctcaaagaatcaactcgagaatctgaccgagacaagattgatttagcttggttatggacaacctttatcatttctggattaggactctatgccttaaattttgtcgttggaaccttaagcgccagctttcttaacttcgtcctagcaggcgcactattggcccttggcgtcttggttcctggcctcagcccatcaaatttacttttgattttgggactctatgctcctatgttgactggttttaaaacttttgatttcttgggaaccttctttccgattggaattggtgcaggtgcaactctcatcgttttttcaaaattgatagattatgccttaaacaactaccactcacgcgtctatcatttcatcatcggtatcgtcctatcaagtacccttttgatcttaattccaaatgcaggaaacgctgaaagtatccaatacacaggactttcacttgtcggttatgtcatcatcgccttcttctttgcgctgggaatctggcttggtatttggatgagtcaattggaggataaatataaataatggcaaaaaaagttaaaatcaaaaaaacattggtggaacaaatcctatctaaagcagctatccctcatcaggggattcaaatcaatgccctagaaggagagcttcctcaa

SEQ ID NO: 153 - DNA, 4278 bp; double-stranded, linear
cttgaattaaataaaaaacgtcatgcgactaagcattttactgataagcttgttgatcccaaagatgtgcgtacggctatcgaaattgcaaccttagcgccaagcgcccacaacagccagccttggaaatttgtggtggtacgtgagaaaaatgctgaactggcaaagttagcttatggttccaattttgaacaggtatcatcagcgcctgtaaccattgccttgtttacagatacggacttagccaaacgtgctcgtaagattgcccgtgttggtggtgctaataacttttctgaagagcaacttcaatattttatgaaaaatctgccagctgagtttgcccgttacagtgagcaacaagtcagcgactacctagctctcaatgcaggtttggttgccatgaacttggttcttgcattgacagaccaaggaattggttctaacattattcttggttttgacaaatcaaaagttaatgaagttttggaaatcgaagaccgtttccgcccagaactcttgatcacagtgggttatacagacgaaaaattggaaccaagctaccgcttgccagtagatgaaatcatcgagaaaagatagaaagaagaaaaaatgacagcaattgattttacagcagaagtagaaaaacgcaaagaagacctcttggctgacttgtttagccttttggaaatcaattcagaacgtgatgacagcaaggctgatgcccagcatccatttgggcctggtccagtaaaagccttggagaaattccttgaaatcgcagaccgcgatggctacccaactaagaatgttgataactatgcaggacattttgagtttggtgatggagaagaagttctcggaatctttgcccatatggatgtggtgcctgctggtagcggttgggacacagacccttacacaccaactatcaaagatggtcgcctttatgcgcgcggggcttcggacgataagggtcctacaacagcttgttactatggtttgaaaatcatcaaagaattgggtcttccaacttctaagaaagttcgcttcatcgttggaacagacgaagaatcaggctgggcagacatggactactactttgagcacgtaggacttgccaaaccagatttcggtttctcaccagatgctgaatttccaatcatcaatggtgaaaaaggaaatatcacggaatacctccactttgcaggagaaaatacaggtgttgcccgtcttcacagctttacaggtggtttacgtgaaaatatggtaccagaatcagcaacagcagtcgtttcaggtgacttggctgacttgcaagctaaactagatgcctttgttgcagaacacaaacttagaggagaactccaagaagaagctggcaaatacaaggtgacgatcattggtaaatcagcccacggtgctatgcctgcttcaggtgtcaatggcgcaacttaccttgccctcttcctcagccagtttggctttgctggtccagccaaagactaccttgacatcgcaggtaaaattctcttgaacgatcatgagggtgaaaatcttaagattgctcatgtggatgaaaagatgggtgctctttctatgaatgccggcgtcttccacttcgatgaaacaagtgctgataataccattgccctcaacatccgctatccaaaaggaacaagtccagaacaaatcaagtcaatccttgaaaacttgccagttgtttctgttagcctgtctgaacacggtcacacgcctcactatgtgccaatggaagatccacttgtgcaaaccttgttgaatatctatgaaaaacaaactggctttaaaggtcatgaacaagtcatcggtggtggaacctttggtcgcttgctagaacgcggagttgcctacggtgctatgttcccagactcgattgataccatgcaccaagccaatgaatttatcgccttggatgatcttttccgagcagcagcaatttatgccgaagctatttacgaattgatcaaataaaacgatagaagtctgagatcttatgcttggacttctttttggagggaaagtagatgtctcaaatcgaaagaatcaaacaggctatcatggcggattcgcagaatgccagctatacagagcgtggcattgagcctctctttgcagcgccaaaaactgctcgcatcaatatcatcggtcaggctccgggacttaaaactcaagaagcaggcctttactggaaagataaaagtggtgaccgcttgcgggactggctaggtgtggatgaagataccttttacaattcaggttattttgctgttttgcctatggatttctactttccaggacatggcaagtcgggtgatcttccgcctcgtacaggttttgcagaaaaatggcatccgcaggtcttacaggaattgcctgatattcagttaaccctcttgattgggcaatatgcccaagcctactatttacaggagaaaatcagtgggaaggtaacggagagggtgaaacactataaagactatctgccagcctattttccgctagttcacccatcaccacgaaatcaaatctggatggccaaaaatccttggtttgaggcagaagtagtgccagatttgaaaaaaagaattaaaaccattttatagtcaatgaaaatcaaagagcaaactaggaagctagtcgtaggctgctcaaagtacagctttgaagttgcagataaaactgacgaagtcggtaacatacgcacggtaaggcgacgctgacgtggtttgaagagattttcgaagagtattagaagaaaaagaatgaaagaaatagcctttgacgcattttaccagctttaccaaaacgaccagctttctttagtggatgtgagagaagtggatgagtttgcagctcttcatttagaaggtgcccacaacctaccgcttagtcaattggctgatagttatgattaattggacaaagatcgcttgcattatattatttgcaaatctggaatgagatcggcgcgtgcttgccaattcctattagaacaaggttataatgttatcaatgtccagggtggcatgttagcctttgaagaactttaaaattttgcatttctcctacttggtgtggactgggtaggagagttttatttttagataattcttatttttaagaaaattgaaaacatttaatatttgcctcgtgatgcttttttcagactcctaatcgtggtatactaggtcagtattttataaatatgaaggagatttttatggctaaaaaaggtaccctaacaggtttgctcctgtttggaatattttttggtgcggggaacttgatttttccgccttctctaggtgctctatctggagaacattttcttcctgccatcgcaggttttgtcttttcaggcgttggtatcgccgtcttgacccttattattggaacgctaaatcctaaaggatatatctacgagatttcaacgaagatagcgccttggtttgcgactctttacctctcagttctttacttgtcaatcggtccattctttgctaccccacgtactgctacaacagcttacgaagtagggattagcccccttttgtcggatgcaaataaaggacttggcttgattgtatttacggttctgtattttgcggcagcctatttgatttcgcttaatccatcaaaaatcttagaccgcattggacgtattttaacgccagtctttgcaattttgattgttatcttggtcgttctgggagctatcaaatatggtggaacaagtcctcaagctgcttcactgcttatcaagcttctgcctttggtacaggtttcctagaaggttacaataccttggacgcccttgcctcagtggcctttagcgtaatcgcagttcaaaccttgaaacaacttggattttcaagtaagaaagaatacatttcaactatttgggttgttggtatcgttgttgcccttgccttcagcgctctttacatcggtttaggttttcttggaaatcatttcccagtaccagctgaagcgatgaagggtggaacaccaggtgtttacatcttgtcacaagccactcaagaaatctttggctcaacagctcaactcttccttgcagctatggttaccgtaacctgcttcacaacgactgttggtttgattgtgtcaacagctgagttctttaatgagcgcttcccacaaatcagctacaaggtttatgcgacagcctttaccttgattggatttgctattgccaatttgggtcttgatgcgattatc

SEQ ID NO: 154 - DNA, 1953 bp; double-stranded, linear
acccgatcaaatgacaaaagctaactttggtgtcgtaggtatggccgtaatgggtcgtaaccttgcccttaatattgaatctcgtggttacacagttgctatctacaaccgtagtaaagaaaaaacggaagatgtgattgcttgccatcctgaaaagaactttgtaccaagctatgacgttgaaagttttgtaaactcaatcgaaaaacctcgtcgtatcatgctgatggttcaagctggacctggtacagatgctactatccaagcccttcttccacaccttgacaagggtgatatcttgattgacggaggaaatactttctacaaagataccatccgtcgtaatgaagaattggcaaactctggtatcaactttatcggtactggggtttctggtggtgaaaaaggtgcccttgaaggtccttctatcatgcctggtggacaaaaagaagcctacgaattggttgcggatgttcttgaagaaatctcagctaaagcaccagaagatggcaaaccatgtgtgacttacatcggtcctgatggagctggtcactatgtgaaaatggttcacaatggtattgagtacggtgatatgcaattgatcgcagaaagctatgacttgatgcaacacttgctaggcctttctgcagaagatatggctgaaatctttactgagtggaacaagggtgaattagacagctacttgattgaaatcacagctgatatcttgagccgtaaagacgatgaaggccaagatggaccaatcgtagactacatccttgatgctgcaggtaacaagggaactggtaaatggactagccaatcatctcttgaccttggtgtaccattgtcactgattactgagtcagtgtttgcacgctacatttcaacttacaaagaagaacgtgtacatgctagcaaggtgcttccaaaaccagctgccttcaactttgaaggagacaaggctgaattgattgaaaagatccgtcaagccctttacttctcaaaaatcatttcatacgcacaaggatttgctcaattgcgtgtagcctctaaagaaaacaactggaacttgccatttgcagatatcgcatctatctggcgtgatggctgtatcatccgttctcgtttcttgcaaaagattacagatgcttacaaccgcgatgcagatcttgccaaccttcttttggacgagtacttcttggatgttactgctaagtaccaacaagcagtacgtgatatcgtagctcttgcggttcaagcaggtgtgccagtgccaactttctcagcagctattacttactttgatagctaccgttcagctgaccttccagctaacttgatccaagcacaacgtgactactttggtgctcacacttaccaacgtaaagacaaagaaggaaccttccactactcttggtatgacgaaaaataagtaggtcagccatggggaaacggattttattacttgagaaagaacgaaatctagctcattttttaagtttggaactccagaaagagcagtatcgggttgatctggtagaggaggggcaaaaagccctctccatggctcttcagacagactatgatttgatgttattgaacgttaatctgggagatatgatggctcaggattttgcagaaaaattgagccgaactaaacctgcctcagtcatcatgattttagatcattgggaagacttgcaagaagagctggaagttgttcagcgttttgcagtttcatacatctataagccagtccttatcgaaaatctggtagcgcgtatttcggcgatcttccgaggtcgggacttcattgatcaacactgcagtctgatgaaagttccaaggacctaccgcaatcttaggatagatgttgaacatcacacggtttatcgtggtgaagagatgattgctctgacacgccgtgagtatgaccttttggcgacacgg

SEQ ID NO: 155 - DNA, 6474 bp; double-stranded, linear
ccggcagtacacgagcttggggaacagccactggaacgatgaggtgtgagctcaaaatatcctccagttatgtttttcctaatagtataccggaagagtgaaaggattttataatggagcggttacaaagaacctactttctattaaacagtatactatgaaaatgtgaaaatttaacatttttttgtacaaattttataaattattgcctttttaatatcaatagttaatctcttatccagatcccccttgtgtaaactttatctttataagcttcaaggcccctatcccatctatttgcaacaattagatcactttgttttgtaaatagttcaaaattcttttcaataattacgttatctatactaacgtttaaatttggttcatatactaaaatttttataccgacaatcaatagttcattaattatacttaaaatagctgactctttgtaattatctgaattatatttcatccccaatttatatattcctactatctttggctttcgttccaatatttgtttaactatgaactgttttctatttgtgtttgaaatatcaatcgcttctatcactggggcatttatttctataaattctttttttaattgtttagtatctttgggaagacaatatcctccaaatccaaaagaaggattattataaaaatttccaattcttggatctaaacaaacaccttttattacaacttcagcatttaagcttctcctctcagcaaaagaatctagttcattaaaaaagcaacacggagagctaagaatgtgttagaaaaaagcttaattgcttctgcttcagtaggagaaactaacataacatttttaatattggcagtactatgagtactaatcgaaaggaacaactctgcaatttttcttccttcaactgtctcatctccaacaactatgcgacttggatataaattatcatatatagaacaaccttctctcaaaaattcagggacaaaaatgatattttttgtatcaaacagcctttttaatttgtttgaaaagccgatcggaactgttgactttaaaataatctttccattaggttttaccctcagaatcttcgataccgtttgttcgatttcatatgtattaaaactaccaattttctcatcataatctgtcggaagcgcaataatataataatcaatattatttttaatttcagaaaatgtatcaaaaaaagtaatatttaagttattctcgcaaaaaaacttcataagctcttcatttttagatggaagaatgcccttttttaaattatttatttttacagaatctatatcatatgcaacaactttatatttagatgcaaatagtaacgcgtaggccagcccaacatgccccaaaccaattactgctatattcataaaactacttccttatttcttaatccaaaatctaatagaataagctgccccattccttaaatacaactctttaatattgtttaaaagtttttcaactgatttccagattatcaaaatctgagatttatagcacaatattgatgatattctatcaatataatttttttcatcaagttcctcttgatacatttttaattctttagtttttcccatataactaaccatactactatcacttacatatgggaagtcctcataatatattactttataacgcataaattcaagcgcccttccaatactattcacaaaaacatgagcaacatggtcaccaagtgaaagcggacaatatacgacacatttgtcgtctaaatgcattaacagctcttttatgatatcattctttaatgtgtcctcattttttaattcactatagatatgacggtatagaaaattgccatttctatctttcctatagagacattcatagtacgataagtgtctaaaatcacattgtagacgttcacaagctaacctgtcttctttcttcctttcttcaatcggatatttcccaaggttacacaacttatgaaattgcttagcagagggctgtagctgttggctcaaagggtaaccagaaaatatagtaataacaagtacaatttctccttctgaagttaattttgaaatataatcaccacaggaaaaaattgcgtcatctaaatgtggagataaaaagatatacttagtattgttactcataaccattccctctacaatttatctaaaaactcactaagtgtctgattaaattccacatcatcaaaaaaattcaccttattcttaataatgaatatttcgttaaataaacatatatataaatatttcaatatcctttcaatatcatcctctaaattctcctcaatattttgtatcagcccatttacaatcttattaaaaaagataagctctttatctctaaaattaaatattttcatacaactgttgtatcgaaaaatatataaaataatttttactaatgtttgaatatttaaacaactaaataaatgagttgtacccgggacactatttatgttatcaagaacactatcttgaaacctcaactcacagttctttttgtgaaattcttttttatcgtttagatctgatatttttttagacatttcaacaatctcagacattttatatggatatctaggatgaatgccaaaactatgcaaaatgaactgcaccccaaaagttagacagaataaatctaacttttggggtgcagttcataagattgggatatttttttttagctagaactagtagaaatatatagtcaaataacagataccttaagggtttctcatctacataaaaaaatgatacttttttctcttcagtaattacctcataagcttcacaatagaatctcatgtttccctcccctatattcttaaataaaatcctttggaaattgatatatcttagtaaaatattgtttaagttccggatgcggagcatgggtaacaataatgacagtcaaatcctctctatctaatatcttacgttcaatcgctaacgaagttctcctatcgatagcagaagttccctcgtcaattaatactattttcttatttctaattagccctctagctaaagtaattttttgtttctgccctcctgacagtaatctcccatcatcaccaacataataatctaaaatgttattaggaaaatcttttacactcaaaccaacttgctctaaagactgtagtatttcttcatcagtataattttcttccaataaaatattatctctaatcgtaccttcaaacaaataagctttttgatctacatatagaacattcgaaaccatatttaaataggaggttttttttatatcatccccgcagaatcgcaattctccactataatctctcaaaaagccattcaataattttaataatgtagatttcccgcttccactttcacctaaaattaaatacttttcattacgttgaaaacaaaaatttaagttttttaatatttctttatctccatacttatagcaaatattttttgcttcatataacggaaaatctctattcacctcatttggttcgatatcattcattttatttgactcaattggattaattgaatacaattttaaaaaaataggcttcgtaccaataatagaggataattgacctcctaattcacctagcgctgtaaaaataacacctgttagtgctcctattgcttcaatagtaccaattttcactattccttttattgcaagatagcctgttaaaaaaacgagagatatctgaaaaaaaatattgagaaagaagctaatagcgcctgctaacgtttctacagttgtctttctttgtataaccatctttaataaaattcctgcttctttaattttcttaggcaatacatataaaagattcaaggacgctaacacatcaaatccattcaatatagtctcactagattttaaaaaagcttcattttggttagttaaatttagactaacttctcgcattttcgatgcaaagatttttggtacaagtagcataatcattaatgaaaacaaggtggctacagtcaatgaccaatgatagtgattaagagtcacaactgcaaatatagtaccagaaattccttttattactaaaaaaagttgtttaaacgcctgatcatttaaagtctgaacatcattatttagccacgaaagatatgttcctgatgatttactatgaaattcttgataggtagagttagagatgtctgtggcaactctatttcgaatctctagattaaactcttggatcacttcaacctgataatttttcactacccagtcaaggaatattatcccacaccagacaatcatttggtagattgacaatttcaaaaaccgctctaaattcatcgcaattaattcattcaacaccagagcattaatagttgctgcataaattagcaataattgaccagcaacaataaatatcgttaataaactaaatttttttatatttgattttataatagtatacacaatagtttctcactttctaaattttaattgaacatagttttcatatatacaatagaaaaaaccaaaatgatataataacatatatttcaaaaaagaaattcgttaaaaattttttcttctcttgccttcttgattacttttaaagccttgcatttgtctcctattaatagtaaccgctttatgtttaaagaataatatttctttgtaaccaatattctctcgttgaaactcaataaattaaaatatttcctacagtaattataatattcttcatctgcattaattgttttttgtgtcactccagtgataccgttttctttactgtgagcgtagtaattcaccaagaattctcgcactatatcaatttggtatccttgaacaagtagttttaataaaacaacaccgtcctgatgtgaatctattttctcaaaaccattaattaattctagcacctcttttttacacaaccaaaatgacgtacctgctatattgtgaaccatttgaacaaacaagggatttccaacaaaatcggtcttctcctcttctcgtgtaccatttggataaattattattccataactacaaactaaagctaaattcttcattctactctttttaaaacaagccatcaactttaaaattcgatctggcatatattcatcatcatcgtctaaaaatgatatatacttacctctagaatttttgatacctatgtttctggcattagttgcacctaaatcttcattacttaaaattaacttaattctatgattggtatagccaaattgatggataattttatttcttaaatttacattactataattatcatcaataattataacttcgatatttttataactttgatgtaaacaacttttcacagctctaatcagagattcatacctattatgtgttggtattataatacttactaattcttgatctatattcctatccatgactactcttctctaataattcatcatatactctcatggtttctacaaacattttttgcacagaaaaatgttttcttatttttgatttactattctcacctatatatttcaaatactcagaatcattgagtaaaaaattagcacaagcacacactccctcaacatcttccttctcaaataaaaatccatcaaccctatgttcaataatttcacttaacccgccaacattactagctaaaaccggagttccttgtgacattgactctaaaacacacataggtattccttctgtatcagaaggaatatacaataaatccgatatttggtaaactatagtagctggatagatttcaccaagtaacctgaaattatctctacatttcaaatggcaaattttttctttcaaagcagcccacatactaccatttccagccataataaaaatcacatcttctctgactaaaaataatttttctgcaaattcaaggaatctatccggccttttttctggatccaaccttccaacataacaaatgattttttgttatttggaatacaaaattcttttttaaagtcttgaacacctactacatctaaatcgctatttgatacattaattccgttatttattgcaactatcttcttattttttattatactctccaatcttttttttcatagtttcagatacacaaataaaagcatctcccatagaatatgtccaaaaatcaaaataagtcaagaatttcttttttaagttatattcaacccatccatggcatgttatcactgtcttaacctttccaaatccattcttgtcaagtttttttaacatatataaaaaataattagttgagtagccatgacagtgtataagttggatttttaataattttaaaatatttttaacgtgtaaggcagtttcaaaattatttgaacattgagtacaatcaacataggcaatatctaaatttttataatcatcaataacctttgaatctctagatacaattatcaaaatagggaatagagaca

SEQ ID NO: 156 - DNA, 4792 bp; double-stranded, linear
tatttaacgatttttttcatgtcatttcctccaaaatagaataccttataatcttaacagaaaaagagcatttacgccattatatgatatctatctctgtgataagttttttttatgggtaatttaaaagaccaaacgcaagatggcaatcaagaccactccaaagagaactgttccgactagattgcggtagcgaaaggctacccaagctgttggaaagacggctaagaagtccagtcatttgatttgaggaagactgccaaccttacctgtcactacgcttgaaagaatcagggcaaagataatggaaacaggcaaaaacttcaaaaaacgctcaacaatcgcaggcaggcccttatacttgaccaagatgaagggaatcatacggggaatccaagtcaccaagccagagaaaataactgctaataaaagatacttactgaccatctaaaaccacccccatgctacaaccaagtagcgtcgcaaacagaacagctagtgactgagacatcactgtcaagagcaaaaagaaggacaccgcaacaactgctaggataatgagcagattgcggacaggaatccgtctttgcataatctgaaattgcgaagcaaaataccaataaacatcccaaccagggcaaaatccaagccaaagatttctggatttggtagcaggccacccagagccgttccgactactgtccccacaaaccaagccacatagctgttaagattgtttccgtgcatccacataggatttaccttgtctgtatgggccaattcacccatcaaaacgccataggtctcatctgtcaagatactagacataccgatattgtaccaaagactggtatgacggaaataagtcgatgcgtgtaaactcaacaaaaagagacgcaagttgattagaaaaaccgtcatagcaatagctgccacaggagcttgaaccacaatcagtgccaacatggcaaactgggcactcccagcataaacaaagagactcatcaagcccatctcaacaggtgtcacatagggcgcaccgataattccacaggccaggccgatactgacatagccaagagccgttggcatggctgcctgcgccccctcctaaaatcctttttctttcatctttctcctcatattgtcttaataatactcaatgaaaatcaaagagcaaactaggaaactagccgcaggttgctcaaaacactgttttgaggttgcagatagaactgatgaagtcagctcaaaacactgttttgaggttgtggatagaactgacgaagtcagctcaaaacaccgttttgaggttgtggatagaactgacgaagtcagtaaccatacctacggcaaagtgaagctgacgtggtttgaagagagtttcgaagagtacaagtaggctgaaaagaatccaaccacagcatggactattatatagcagattgaaataagatgagaacaaatcgattgggaaagtaaaattaatttctataaatgttttagcaattgtttcgtactattttagattcagtctattataacacattcagaaaagagaaaaaagtctgttgattttgaccatcataaaaagactggcaatccagtctcaaacatatattatagaaattctccactaaatactttcacgaatattcagaagcataacaaaggcaactagaagaaatagcaataaaacaaagctaactgccagagttccaaagctagtagcaatggttaccaaagctattgtaaataagctaggtaaaacaaccgtaatggcaccgatagaggattgaactgctcccattgactcctcaggtatttgtttaaaaacgagttcttgcaatctaggagagagaacacctgcgaaaaaggcatccaaggtactaaagatgagaatccagtcaaaacgaactgtggcaaatcctactagaagaagcaactggatgacaagtgaggcatagagagctgtttttatggaaatggtatgttgcagatagccacttacaaggcttccgacaatcagggctgataattctagtgtggctaacaaggcaagagattgaccagtttgtaaattcaaaaagggctggttccttaaaaatagagtggaaataggaaccgtaacatttatcactgcttgactagtagagataataaacaaaaccaagagcaccttattcatattccatatcaatttcgatgattggagcaaatgctggcaaaaggattttacagagagtccttcttgatagctaatcgttttttctactttcaagaggtcagtttttatgaagaggatacctaaaaatgcgattaaaaaggtaagagcgttcagtaaggaaataaactggatggatagaatgcctagtaagactcctcctaggatattactgattgttttcactaaactaacagttgactgtttaaagccaatagcttctgccagatggtcttgcccaataattctaatgaaaatcggagtgagcatggcgcctgaaaaataactcaatgtgtcagacaagaggttaatcagacaaataaatgctactagcaacaaggagaaagactgccctgaaagtgataaagacactatagagtaaagcaaaaattttgcaaaactaatgactgtgtatttcaagacacgatgatgttgaaaatccgccaaaactcccagaaagatttgtagaacttggggcagggtttctgaaatcgtgatgagtaaaatcgccaaaggggcaaaagatgcatctgccacataattcaggaaggccagataaaaaatcgtatccccaagcgttgaaatccactggttgatagttaattgcctaaaatctctattttgaagaaatactttcatcacaactccttcttaagttcaaatgggaatctttccccaaggatagaccgcgatactactaacaaccaaaattacagtaacatcaaaagctgaccaatgccattgtagactatatgcagtccaataggccaataaattgactttgtcattctaaataagactgcaaatataagacctccacccatatagaagacaaagtctgtcaagacccaaccgtgattactaatgtgcgagaccccaaataaaacagcggaaccaagtacatctagcccccatttctttcctttttccagagcagtcatcactaatccacgataaatcatgtcttcaaaaatgggacctgcaatcacaggataaaaaaaatacatcaaaaatgctgtagcccctgtaaaagtcggagcagcatgttgataagaaatttcatttcgagtaggtgggaaaagaaaaaaggtaacgaaattccaaacaacaaaagcaagcagagctaggaaggaatagaaaagataggatcctttaaactttctactattgattttctgccatttccccgaccaaatcatagcaataagagcaaataaaaccacaagaaaattcaacatcatatccgacagataataggcaaagtcagatagcccagtaacaaggtcgctgcgtaaaactagaacactgaacttctggtcagcaataactagtagaaaaactataataaagtagcggtgtgagattatctttttcatatatcacctttctaatatccaaataccaataaagtaacaatgagtaagaaactattccatgaagcatgcagagctatagcccaatagatggatcgggtgtagcgaaacatcatacaaaatatcaagcccattccaaaatactttatgaaatctgtcgttatccaaccatactgcaaaacatgcatagcgccaaatatggcagcggaaacaagaacatcaagatagtatctcttaactttagataaacttgtcatcaaaagaccacgacaaacaacctcttctgatacaggtgcgataatactagtataaagtattcgcgtaacaaaatagctaattcctgttaaattggtggctacttctacgactgtacttccattctgggtacgaggaaagatataggttgttagatttgcccacacgaacaataagaaaaaagaaagaaggaaaacacccaggtaagaccaacgaaactggaaacgaccacactctttccaatgttcacttttgacaaaagcaattgtagctatagttcccagaataagtaccaataaaacttggaacacatagtacatattatcagacaaagcaaccataaaatctaagtctgatgtgacattaaaaatgaggtaataagtcaaaatcaacaagccagttgctaggtgaaatttcacttctttcattttcttcatcctattatctcctataagagcctatcttctacggcggccaaacaatccatctgctaaatctatagtccaatcaaaagctccacgattaggactcatcccttgattgccccaaccagggtaaattcctgggacgccccaaccagatataccacttcttccaccacctcccatagaatttacgaggttgcctcctctaacatcttgcaactcagcttctgtcaattccattgtttctgcaaattgtaaatttaacatcttttacactccttcaattatcttcatttgtaaaccacttctgcgacctaggatttgcttcaagtgctttacaagtacagtataacacgaacattggcttattttagaaaatcgcatatttgatattttttcttatagaaatttcagatttgcgattttggtgaatttgattacttctctggtataataaagttactactaatgaggagtggagaaatatgaagaaacaaattttaacattattgaaa

SEQ ID NO: 157 - DNA, 2156 bp; double-stranded, linear
ccgttctcggcgacggccatctgatgaagctatttatgagggaaactggcaagctggagagtcagagtatctagtctttcaccgattgctgtggcagcagatgtgcagggaaaaggagttgctcaaaccttcttagagggcttgattgaaggttttgattatcttgattttcgctcagatacgcatgctgaaaacaaggttatgcaacatatttttgaaaaacttggttttaaacaagtcggtaagatgccagtagatggcgaacgcttggcctatcaagaattaaagaaataatgcaaaagaagtatgtaaaaatcctctactcctcaccaattggtattctatcacttgtagctgatgaccattatttgtatggaatttgggttcaggagcagaagcattttgagaggggactaggagatgaaacgatagaagaagttgttagtcatcctattttagacccagttattgcttgcttagatgattactttaaaggcaagcctcaggatttatccaacttgctcttggcgccaatcggaacgaattttgaaaagagagtttgggactatttacagggcattccttatggtcagacagtgacctatggacaaattgctcaagacctgcaagtggcttctgctcaagcaattggtggagcagtgggacgcaatccttggtctatcctagtaccttgtcatcgtgtgttgggagcaggcaagcgtctgacaggttatgctgcaggagtggaaaagaaagcttggctcttggagcatgaaggagtagattttaaagatagaagcaatagaaggagaagcacatgttagaatttatcgaataccccaaatgttcaacttgtaaaaaagcaaaacaagaattaaatcaattaggtgtggactataaagccgtccatatcgtggaagaaacacctagccaagaagtcattttgaattggctagaaacctcaggatttgaattgaagcaatttttcaacaccagtggtatcaaataccgtgaattagggctaaaagataaggtaggaagtttgtcaaaccaagaagcggctgagttgctagcaagtgacggtatgttgttaaaacggcccattttagtagaaaatggaactgttaagcaaatcggttatcgaaaatcttatgaggaactgggactgaaatagtttttatctatctctttgatagataaaatatataacttccctgtttcaaagtatgataaactagtaggtagacaaagtctgtatctgaccgtagcaaataatttcattgacggcagaagcatggtagcatgaatcattatcagaagaggatgtttttatgaatgttacaacgattttagcatcagattggtaccaaaacttgatgcaattgattccggatggcaagctgtttagcctacgttcggtctttgatggaatccctagaattgtccaacaacttccaacaacaattatgttgacaattggtggtgccctttttggcttggttttggcgcttctttttgccattgtgaagatcaatcgtgtcaagattttatatcccttgcaggccttctttgttagtttcttaaaagggacaccgattttggtgcaactcatgttgacctactacggaatccctttggctttgaaagccctcaatcagcaatggggaactggtctcaatatcaatgcgattccagctgcagcttttgcgattgtcgcctttgcctttaatgaggcagcttatgctagtgaaaccattcgtgcagccattctctcagttaatcctggtgagattgaggcggcacgcagtctgggtatgacccgagcgcaagtttatcgacgagtgattattcctaatgcagcggtggtagctactccaaccttgattaattccctcatcggtttgaccaagggaacatctctagcttttagtgcgggtgttgtggaagtctttgcccaagctcagattctaggtggagctgattatcgctattttgaacgcttcatctccgttgcccttgtttattgggtagtcaatatcggaattgaaagcctcggtcgtttcatcgagagaaaaatggctatttctgcacctgatacagtgcaacagatgtgaaaggagaccttcgttaatgattaagatttcgaatttaagcaa

SEQ ID NO: 158 - DNA, 3140 bp; double-stranded, linear
gtatctctacacatgtcttcaatcgattttgttgtcctccaatttaattccttatatgctttgtctgcatttgcataacaagttgcaacgtctcctgaacgtcttggaactattttataaggaatagggatcttattaacactttcaaatgtatttacaagttgtaatacactagtgccttctcccgagcctaggttatagatataaacatctgttttttcagatactttttctaaagcttttatatgtcctattgctaaatctactacatggatataatcacgcacaccagtaccatcaagcgtatcataatcatttccgaacacacttagctctgatagcttacctaccgctacttgtgcaatataaggcatcaagttgttaggaattcctgagggatcttccccaatcaaaccagactcatgagcaccaattggattgaaataacgaagcaacgcaatactccattctgaatctgccacatgaacatcttttaaaatttgctcaagcatcactttcgtatacccataaggatttgtcgcacttgtttgcatcgtctcaattagaggtgactgattgttaattccatatacagtcgcacttgaagaaaagacaatctttttaacattaaattctgacatcacttcaacaagtgccaatgtactcataatattatttttgtagtacatcacaggcttttgcacggattctccgacagctttataacctgcaaaatgaattgcagcatcaatcgattcttgttcaaatacctttctcaatgcttgtttatcacaaacatctaattcgtaaaacacgggacgtattcctgtaattgcttcaatacggtctagcaccaagatgctagagttcgaaaggttgtcgacaatgataacttcctttcctaaatttagtaattctactacggtatggctaccaatataaccagctccgcctgttaccaatattgccatctgggtttcctcctaattaattccaaccgacttaacaaatctcataaacgcttcatgcccagacggtgtattcttataaactcctgcatcttccagaactctcgcaaacacttgtcctgcttcgtgttgaactacgctattaacctcttctttattaatgcgaggatatttttctttcaattggtcggcccattctaaatgataatccgcaattgcattatcctctcctaaaagatattttccaacttcttctaactctggtttcaaacgaggtggtaatatcgcaagtcccatcacttcgattaacccgatattttcctttttaatatgttgtacatcttgatgaggatggaaaacaccatctgggtattgttcagtagtatgattatctcttagaacaatatctaattcgtatctcccgtccactttacgagcaataggagtcaccgtatggtgtgggacatcttcagtcatagcaatgatgtctacttctaaatctgaatattctctccacttatttagaattttagtagctaaatctaacaagcgatttttattttcactttgtaacctaattactgacattggccattttacaataccagcattaacatcctcaaagtctttaaaacaaaattcactctcaaattttgctttttccattgggaaaatatgtttccctccctggtagtggttatgactaagaatggagcctcctgagataggaagatcagaatttgaaccagcaaaatatcctggcaaaatatcaacaatctccaataattgttcaaatgttttagaggtaatagccattggtacatgttgactattcaaaaatatcgcatgctcattaaagtatgagtagggagaatactggaatccccatacttcgtcaccaagtttcaaccgaataattctatgattcgaacgtgctggataatttattcgcccctgatatccttcattttccatacatagtaaacatttgggataattagttgcttttactaatttttcagcagcaattgtttttggatctttttcgggttttgacaaatttatcgtaatctctagctctccgtatttagttgatgctcgaaactcaatattcttagcaatagcagaagttttaatataatcactatctttacttaacttataaaactcttcaactgcttcttgaggtgatatatcatatgaactccaaaaaatatcatttaatcgactaggtaaaggaactatgaaattcattaactctgctcctaaacattccttttcctcgattaaatctttaattttaccgttttttaaggcgatttccactaagtaatcttttatttgtttcaggtcattttcatcggaaatgcgatcaattccctcctcacctattaacgctagtactctatttttcacatatattttgtcaatttcattatacattccgtattcaattactctatcaacaaaattatcaataattgttttcatatatttttctttctaatttatgttcccatattttctatacattatccatttataaattgcttgcgtagtatgagcaattttatcaaggtgatgaataatatctaaagcactaattacttcagaaacgttcccatcatcttcaaatatgtaattcattattttcttttccatatttatactaagctcttctatctcattctgtttttgtataacaaccatatctaaacatccagattgttcctctctataacaagatatagccctattcatatgcagtccgataacttcatgaagtatttttatttttgaaataattttcttcaaaatttcattattttgaagaatctgtagattttttaaaatttcaacaattctatccccaatacgttcaatgtcagttgatatttttattacactaataattcttcttaagtcatatgaaacaggatgttgtaaacaaattaactcatatccttttttatcaatatttagaactgactcatttatgattaaatcttctttaatcaattctactcgttcttcatttgataaatattcaaataacttctcatatttatcaagcacagatacccaaatggtctctaaattatttgataattctataatttcattttctaaatataaccttaacatttaggtacctcttcttaacaaagttcg

SEQ ID NO: 159 - DNA, 9048 bp; double-stranded, linear
ccggatgatttcctggtcagatagggggaaagtgacttcctcagcaatcgcgcgtagagtaggattcccttcacggataatatcgttcatatcaattaagtgagcagcttttgtaatacgttctattgcagacattttctctccttatattatgtttagtgcagttagctactgccaaagcccaagtggtatacttggaataagccactgtggattagttcattttctttcattacctctacatgatatcacaaaatgacaagaattgaaagcattatggcatttaggatttatagaaaatagataggaagttcaattcaattgtgaaagaaatacttatctgtgatataataaaaagaaaaggcttgcataagaaagtagggagaacgaagatacaaagaagacaaaatcgaaatcagggtggtttagcttttcgttttatgaagggcttggtaaactttttaggagttatcgcaagtggagcaataagggatttgtggcgatactcttgctagcagttggtttatcaatgggcttggtcttgttgtttgaaagcttccaaggaatcccttgactagtcaaaaacgagatactatttctcaagaggggactaagcaaaagtctcaggagtaggaagaggaaaaaactgccagaattatggcccacggggatttgctctaccacgatggacttttcttttcagctaaaaaagaagacggtacctatgactttcatgaaaattttgagtatgtgactccttggctcaagcaaggggactaagcagcagatttagctattggtgattttgaaggaaccattaataaggatcattatttagcgggttatcttctctttaatgctcctgttgaagttatggatgctattaaggaggcaggttatcatgtgctggatttagctcataatcatattttggattcgcaaattgagggagttatttcaacggccgatattattgagaaagctggaatcactccaatcggagtttatacgcacgaaccacgtgatcaggctccgctggtcattaaggaagtgaatggtatcaaggttgcattgttagcctattcctatggtttcaatggaattgagcagtatatttctcaggaagactataatcgttatctttcagatttaaacgaagataagatgaaggttgaaattgaacgggcagagaaggaagcagatatcaccattatcatgcttcagatgggtgttgagtatcgattggaaccaactgaagaacaaaaagctctttatcacaagatgatcgatttgggagcggatattatctttggagggcatcctcacgttgttgaaccatctgaaacggttgaaaaagatggagataagaaactcattatctattaaatggggaacttcatttccaatcaacgaattgaatctatgggagatgaagagaatgctaagtggactgaacgtggtgttctcatggatgtcaccatcaagaagaaggatggaaaaacaactatcggaacagctaaagctcatcctacttgggtcaatcgaacaccaaagggaaccttttcaccagaaggatatcccttgtatcattaccaaacttatattttggaagattttatagaggatggcagtcatcgtgaccagttagatgaagcgactaaggaacgaattgatacagcctataaagaaatgaatgaacatgtgggattgaagtggtattagcttgaatccagaggaaagtaaatgatgattaaggtaattgcgacagatatggatgggaccttgctggatgctagaggtcagcttgatctcccacgattggaaaagattttagatcagttggatcaaaggggcattcgttttgtcattgcgacgggcaatgaaattcaccgcatgagacaactactgagtcccttggtggatcgagtggttctggttgttgctaatggcgctcgtatttttgaaaacaatgaattgattcaggctcagacatgggatgacgccattgtcaacaaggctttgactcatttcaagggtcgagcgtgtcaggaccagtttgttgtaacggggatgaagggtgattttgtcaaggaaggtacgatttttacagatcttgaaagttttatgactccagaaatgattgaaaaattctaccaacggatgcaatttgtggatgaattaacatctgacctctttggtggtgtgctcaagatgagcatggttgttggtgaggaacgtttgagttcggttttggaagaaatcaatgctctctttgatggccgtgtccgagctgtatccagtggctatggttgcattgatatcctccaagctgggattcataaagcatggggcttggaggaattactcaagcgctgggacttgaaatcccaagaaatcatggcttttggtgatagtgaaaatgatgttgaaatgcttgaaatggctggaattgcctatgcgatggaaaatgctgatgagaaagccaaagctgtggcgactgctctagcaccagccaacagccaaggaggagtttatcaagtcttggaaaactggttagaaaaaggagaatgaagtggcagtacagttattagaaaattggctcctaaaggaacaagaaaaaattcaaactaagtatcgtcacctaaatcacatttctgttgtagaaccaaacattctttttattggggattccattgtcgagtattatcctctacaggagctatttgggacttcaaagacgattgtcaatcgaggaattcgtggctatcagacaggactgttactagagaaccttgatgctcatctatatggtggagcagtagataaaatttttcttctgattgggacaaatgatatcggaaaggatgttcctgtgaatgaggctctcaataatctcgaagctatcattcaatccgttgctcgcgattatccattgacagagattaaattgctttccattttgcctgtcaatgagagagaggagtaccagcaggcagtctatatccgctcgaatgaaaaaattcagaactggaatcaagcctatcaagagcttgcatctgcctatatgcaggtggaatttgtgccagtatttgattgtttgacagaccaagcaggccaactcaaaaaagaatatacaactgatggactgcacctcagtattgctggttatcaggctttgtcaaaatccttgaaagactatctttactaaatagctaaataatgttaaatttgagcataatatcttgtaaaaaattctaaaatcctttaaaataaaaagtgacggaggaatttatgaatgtaaatcagattgtacggattattcctactttaaaagctaataatagaaaattaaatgaaacattttatattgaaacccttggaatgaaggccttgttagaagaatcggcctttctgtcactaggtgaccaaacgggtcttgaaaagctggttttagaagaagctcccagtatgcgtactcgtaaggtagagggaagaaaaaaactagctagattgattgtcaaggtggaaaatcccttagaaattgaaggaatcttatctaaaacagattcgattcatcgattatataaaggtcaaaatggctacgcttttgaaattttctcaccagaagatgatttgattttgattcatgcggaagatgacatagcaagtctagtagaagtaggagaaaagcctgaatttcaaacagatttggcatcaatttctttaagtaaatttgagatttctatggaattacatctcccaactgatatcgaaagtttcttggaatcatctgaaattggggcatcccttgattttattccagctcaggggcaggatttgactgtggacaatacggttacctgggacttatctatgctcaagttcttggtcaatgaattagacatagcaagtcttcgccagaagtttgagtctactgaatattttattcctaagtctgaaaaattcttccttggtaaagatagaaataatgttgaattgtggtttgaagaagtatgaagtggaccaagattattaaaaaaatagaagaacaaatcgaggcagggatttatcccggagcctcttttgcgtattttaaggacaatcaatggacagagttctatttaggccagagtgacccagagcatggcttgcagactgaggcaggactagtttatgacctagctagtgtcagcaaggttgttggggttggcacagtttgtaccttcttgtgggaaataggtcaattagatattgatagactggtaatagattttttacctgagagtgattatccagacatcactattcgccagctcttgactcatgcaacagaccttgatccttttattcctaatcgtgatcttttaacagcccctgaattaaaggaagcgatgtttcatctcaacagacgaagtcagccagcctttctttattcggatgtccattttttgctgttgggctttattttggaaagaatttttaatcaagatttggatgtgattttaaaggatcaagtctggaaaccttggggaatgacggaaactaagtttgggccagttgagcttgctgttccaacagttagaggtgtagaggcaggcatagtgcatgatcccaaggctcgtctcctgggtagacatgctgggagtgctggtttattttcgactataaaggatttacaaatctttttagaacactatttagcagatgattttgcaagagacttaaatcaaaatttttctcctttggatgacaaggaacgttctttagcatggaatttggaaggagattggctagaccatacgggctatacaggtacctttatcatgtggaatcgtcagaagcaagaagccactattttcctatcgaatcgtacctatgaaaaggacgagagagctcaatggatattagaccgcaatcaagtgatgaacttgattcgcaaagaagagtaaggagagacatgtcaaatagtttaaaagggactttactaacagttgtggctggtattgcttgggggttgtcaggaacgagtggccaatacctaatggcacacggaatttcggctctggtcttgactaacttgcgtcttttaatcgctggtggaattctcatgctcttggcttatgctactgcaaaggataaaatactggtctttttaaaggatagaaagagtttgctgtctcttcttatttttgctctgattggtctttttctcaaccaattcgcctatctgtctgctattcaggagaccaatgcgggaacagcgacggtgcttcagtatgtttgtcctgtcggaattttaatttatagctgtatcaaggatagggtggcaccgacactgggagagatagtttccatcatattcgccatcggaggaaccttcctgatcgcaacacatgggcagttggaccagttatccatgacacctgctggtctgttctggggtctcttttctgccttgacttatgctctgtatatcattttacccatagccttgattaaaaagtgggggagcagcttggtcattggtgtgggaatggtcatagcaggtttggtcgcccttccttttacaggggttctacaggccgatatcccgactagtcttgattttctccttgcgtttgcaggcattatccttatcgggactgtctttgcctatacagctttccttaaaggagccagtctgataggaccggtcaagtcaagcttgttggcttcaattgagccaatatcggcgattttctttgccttcttaataatgaatgaacaattttatcccattgattttcttggtatggcaatgatattgtttgctgtaactttgatttctttgaaagatttattcttagaaaaataaaaaagactctttgtccgtgacagagagtttttgcgtggtaatctaattattttcaagataaaattcaaagcgttcgcctacatattgactttttacgtattcaaaagcagtaccatcttctaggtaggaaacctgggtcaatccaagaatagcatgtcctttttcaacttccaaatagtgggcaatcttttctttagcaaggcgagcatagatggtctgttgagatttgccgatacgatagccatgtttttgcaaggtttggaagaaatgactggtgatttcttcttttttaaagtccttaatgaatttttcaggaatagaagcaacttcataaactaggggaacttggtcggcatagcggacccgctccattcggataatattgtccgttggaaaaattcctagcttggcaacttcttgctcattgggaatggtttttttgtaggaaatgagctggctagagggaactttaccttgggatttgacaatttcagtaaaactggttgtccctcgcatcttttcttgtactcgagtactggaaacaaaggtgccgcttcctacacggcgctctaagacgccttcttcgactaatagagatacggcttggcggagggtcatgcgactgaccgcaaactgctcagctaaatctctttcactgggaagcctctcaccaatagcccaacggtactcgtcaatatccttttttatctgatcatggatttttatataagcaggtagcatatttttcacttcatttctatcttttctctattgtaccccaataaactagaaaaagtcaaacttcgccttgtttagttggtaattcgcccttatttgtgatagaatattgagaaaagatatttcttttgagaaaggaaaaagatgagcaacatttcaactgatttgcaagatgtagaaaaaatcatcgtattggactatggtagccagtacaaccagctgatttcacgccgtatccgtgagattggtgttttttcagaactaaaaagccataaaatttcagctgctgaagttcgtgaagtcaatcctgtaggaattattctatcaggtggtccaaattctgtatatgaagatggttcatttgatattgacccagaaatcttcgaactcggaattccaattttgggaatctgttatggtatgcagttattgacccataaacttggaggaaaagttgttcctgcaggtgatgctggaaatcgtgaatacggtcaatcaaccctaactcacacaccatcagcgctttttgaatcaacacctgatgaacagactgttttgatgagccatggtgatgcggttactgagattcctgctgactttgttcgtacaggtacatcagctgactgcccatacgcagccatcgaaaacccagataaacacatttacggtatccaattccacccagaagttcgtcattctgtatacggaaatgatatccttcgtaactttgcccttaacatttgtaaggctaaaggtgactggtcaatggataatttcattgacatgcagatcaaaaaaattcgtgaaaccgtcggtgataaacgtgtccttcttggtctatcaggtggtgttgactcatctgtcgttggggttcttctccaaaaagcgattggcgatcaattgatctgtatcttcgtagaccacggtcttcttcgtaaaggcgaagctgatcaagttatggacatgctcggtggtaagtttggtttgaatatcgtcaaagcagacgctgctaaacgtttccttgacaaacttgctggcgtttctgaccctgaacaaaaacgtaaaatcatcggtaacgagtttgtctatgtattcgatgacgaagcaagcaagctcaaagatgtgaaattccttgctcaaggtactttatatacagatgttatcgagtctggtacggatacagctcaaactatcaagtcacaccacaacgtggtggtcttccagaagatatgcagtttgaattgattgaaccactcaatactctttacaaggatgaagttcgtgctcttggtacagagcttggtatgccagaccatatcgtatggcgccaaccattcccaggaccaggacttgctatccgtgtcatgggtgaaatcactgaagagaaacttgaaaccgttcgtgaatcagacgctattcttcgtgaagaaatcgctaaagctggacttgaccgcgatatttggcaatacttcactgttaacacaggcgttcgttcagtcggtgttatgggtgacggtcgtacgtatgactacacgattgcaatccgtgctatcacttctatcgatggtatgactgctgattttgccaaaattccatgggaagtacttcaaaaaatctcagtacgtatcgtaaatgaagtggatcatgttaaccgtatcgtctacgatattacaagtaaaccacctgcaacagttgagtgggaataatcgcaaaaaaattaaaagctttgtaaaatcaacggttacagaggattaaaaactgtaactgggattaaaacgggaacatttgctaaaaagaataaattgaataatagttccaagtggtttacatttggacaaaaaattagaccgtagttttcaagctgcggtcttttgatatatataatgagaattaatggctctttgtcaactgtagtgggttgaagtcagctaagctcgagaaaggacaaattttgtcctttcttttttgatattcagagcgataaaaatccgttttttgaagttttcaaagttccgaaaaccaaaggcattgcgcttgataagtttgatgagattattggtcgcttccaatttggcgttagaatagtgtagttgaagggcgttgacgattttctctttgtcctttagaaaggttttaaagacagtctgaaaaagaggatgaacctgctttagattgtcctcaatgagtccgaaaaatttctccggttccttattctgaaagtgaaacagcaagagttgatagagctgatagtgatgtttcaagtcttgtgaatagctcaaaagcttgtttaaaatctctttattggttaaatgcatacgaaaagtagggcgataaaaatgtttatcgctgagtttacgactatcctgttgtatgagcttccagtagcgcttgatagccttgtattcatgagactttcgatccaattgattcatgatttgaacacgcacacgactcgg

SEQ ID NO: 160 - DNA, 10399 bp; double-stranded, linear
gtacctttattgatgaatggactgtttaaatcagtagcacgccaaccagatatgctttctgagtttcgtagtttgatgtttttaggtgttgcctttattgaaggaactttctttgtaactcttgtcttctcatttattatcaaataaatacatggaacgagaagaaaagggaggattttagatggaagaaagtattaatccaatcatctctattggtcctgttatcttcaatctgactatgttagccatgactttgttgattgtgggagttatttttgtctttatttattgggcaagccgcaatatgaccttgaaacccaaaggaaagcaaaatgtacttgagtatgtctatgactttgttattggatttacagaacctaacattggttcgcgctacatgaaagattactcactctttttcctttgtttattccttttcatggtgattgccaataaccttggcttaatgacaaagcttcaaacgatcgatgggactaactggtggagttcgccaaccgctaatttacagtatgacttaaccttatcttttcttgtcattttgttgacacatatagaaagcgttcgtcgtcgtggatttaaaaaaagtataaaatcttttatgagtcctgtttttgtcataccgatgaatatcttggaagaatttacaaacttcttatctttggctttgcggatttttgggaatatctttgcaggagaggtcatgacgagtttgttacttcttctttcccaccaagctatttattggtatccagtagcctttggagctaatttggcttggactgcattttctgtctttatttcctgcatccaagcttatgtttttactcttttgacatctgtgtatttagggaataagattaatattgaagaggaatagaaaggagtaactgatgcacgtaacagtaggtgaattaattggtaattttattttaatcactggctcttttattcttttgctagtcttgattaaaaaatttgcatggtctaatattacaggcattttcgaagaaagagctgaaaaaattgcttcagatattgacagagctgaagaagcccgtcaaaaagcagaagtattggctcaaaaacgcgaagatgaattggctggtagccgtaaagaagctaagacaatcattgaaaatgcaaaggaaacagctgagcaaagtaaggctaatatcttagcagatgctaaactagaagcaggacacttaaaagaaaaagccaatcaagaaattgctcaaaataaagtagaagctttacagagtgttaagggtgaggtcgcagatttgaccatcagcttagctggtaaaatcatctcacaaaaccttgacagtcatgcccataaagcactcattgatcagtatatcgatcagctaggagaagcttaatggacaagaaaacagtaaaggtaattgaaaaatacagcatgccttttgtccaattggtacttgaaaaaggagaagaagaccgtatcttttcagacttgactcaaatcaagcaagttgttgaaaaaacaggtctgccttcttttttaaaacaagtggcagtagacgagtcggataaggaaaaaacaattgcttttttccaagattctgtgtcgcctttattacaaaactttatccaggttctggcctacaatcacagagcaaatcttttttatgatgtgcttgtagattgcttgaaccgacttgaaaaagaaacaaatcgatttgaagtgacgattacgtctgctcatcctctaactgatgaacagaagactcgtttgctccctttgattgagaaaaaaatgtctctgaaagtaaggagtgtaaaagaacaaatcgatgaaagtctcattggtggttttgtcatttttgccaatcacaagacaattgatgtgagtattaaacaacaacttaaagttgttaaagaaaatttgaaatagaaagtggtgttcttttggcaattaacgcacaagaaatcagcgctttaattaagcaacaaattgaaaatttcaaacccaattttgatgtgactgaaacaggtgttgtaacctatatcggggacggtatcgcgcgtgctcacggccttgaaaatgtcatgagtggagagttgttgaattttgaaaacggctcttatggtatggctcaaaacttggagtcaacagacgttggtattatcatcctaggtgactttacagatatccgtgaaggcgatacaatccgccgtacagggaaaatcatggaagtccctgtaggtgaaagtctgattggtcgtgttgtggatccgcttggtcgtccagttgacggtcttggagaaatccacactgataaaactcgtccagtagaagcaccagctcctggtgttatgcaacgtaagtctgtttcagaaccattgcaaactggtttgaaagctattgacgcccttgtaccgattggtcgtggtcaacgtgagttgattatcggtgaccgtcagacagggaaaacaaccattgcgattgatacaatcttgaaccaaaaagatcaagatatgatctgtatctacgtcgcgattggacaaaaagaatcaacagttcgtacgcaagtagaaacacttcgtcagtacggtgccttggactacacaatcgttgtgacagcctctgcttcacaaccatctccattgctcttcctagctccttatgctggggttgctatggcggaagaatttatgtatcaaggtaagcatgttttgattgtatacgatgatctatcaaaacaagcggtagcttatcgtgaactgtcgctcttgcttcgtcgtcctccaggtcgtgaagccttcccaggggatgttttctatctccacagccgtttgcttgagcgctcagctaaagtttctgatgaacttggtggtggatcaattacagccctaccatttatcgagacacaagcaggagatatctcagcctatatcgcaaccaacgtgatttctatcactgatggacaaatcttccttggcgatggcctcttcaatgcaggtattcgtccagccatcgatgcgggttcatctgtatctcgtgtaggtggttctgcacaaatcaaagccatgaagaaggttgctggtacacttcgtatcgaccttgcttcataccgtgagttggaagcctttactaagtttggttctgacttggacgcagcaacacaggctaagttgaaccgtggacgtcgtaccgttgaggtcttgaaacaacctgttcacaaaccattacctgttgagaaacaagtaaccattctttatgctttgacacatggtttcttggatactgttccagtagatgatattgttcgtttcgaggaagagttccatgccttctttgatgctcaacatccagagattttggaaaccattcgtgatacaaaagacttgccagaagaagcagtcttggatgctgcgattacagagtttctcaatcaatctagcttccaataagaatagaggtgtcagatggcagtatctctaaatgatattaaaacaaaaatcgcctcaacaaaaaatacgagtcaaatcactaatgccatgcaaatggtatcggctgctaagctaggtcgttctgaagaagctgctcgcaacttccaagtttacgctcagaaagtgcgtaaacttttgacagatatccttcatggtaatggagctggtgcttcaactaatccgatgttgattagccgttctgtgaagaagacaggctatatcgttatcacttcagaccgcggtttggttggaggttataattcctctattttgaaagctgttatggagttgaaagaagaataccacccagacggtaaaggttttgaaatgatctgtatcggtgggatgggagctgatttctttaaggctcgcggtattcaaccactttatgaattacgtggcttgtcagaccaacctagctttgatcaagttcgtaagattatttcaaaaactgttgaaatgtaccaaaatgaactctttgatgagctttatgtttgctacaaccaccatgtcaatacgctaaccagtcaaatgcgtgtggaacaaatgcttccgattgttgacttggatccaaatgaagcggatgaagagtacagcttgacttttgaattggaaaccagccgagaagaaattctggagcagttgttgcctcagtttgcagaaagtatgatttacggtgccattatcgatgccaagacagctgagaatgctgcgggcatgacagccatgcaaacagcgacagataatgctaagaaagtcatcaatgatttgacaattcagtataaccgtgccagacaggcggcgattacacaagaaattacagaaatcgtagcaggtgctagtgccttagaataggctctagtccagctcgtatgaaaatgaacttaggacctagttgagctaggaaccgacagtatcttatatagaataggagaaggagatgagttcaggtaaaattgctcaggttatcggtcccgttgtagacgttttgtttgcagcaggggaaaaacttcctgagattaacaatgcacttgtcgtctacaaaaatgacgaaagaaaaacaaaaatcgtccttgaagtagccttggagttaggagatggtatggttcgtactatcgccatggaatcaacagatgggttgactcgtggaatggaagtattggacacaggtcgtccaatctctgtaccagtaggtaaagaaactttgggacgtgtcttcaacgttttgggagataccattgacttggaagctccttttacagaagacgcagagcgtcagccaattcataaaaaagctccaacttttgatgagttgtctacctcttctgaaatccttgaaacagggatcaaggttattgaccttcttgccccttaccttaaaggtggtaaagttggacttttcggtggtgccggagttggtaaaactgtcttaatccaagaattgattcacaacattgcccaagagcacggtggtatttcagtatttgctggtgttggggaacgtactcgtgaggggaatgacctttactgggaaatgaaagaatcaggcgttatcgagaaaacagccatggtctttggtcagatgaatgagccaccaggagcacgtatgcgtgttgcccttactggtttgacaatcgctgaatacttccgtgatgtggaaggccaagacgtgcttctctttatcgataatatcttccgtttcactcaggctggttcagaagtatctgcccttttgggtcgtatgccatcagccgttggttaccaaccaacacttgctacggaaatgggtcaattgcaagaacgtatcacatcaaccaagaagggttctgtaacctctatccaggctatctatgtgccagcggatgactatactgacccagcgccagcaacagccttcgctcacttggattcaacaacaaacttggaacgtaagttggtacaattgggtatctacccagccgttgacccacttgcttcaagctcacgtgccttggcacctgaaatcgttggagaagagcactatgcagttgctgctgaagtaaaacgtgtccttcaacgttaccatgaattgcaagatatcattgctatccttggtatggatgagctttctgatgaagaaaagaccttggttgctcgcgcccgtcgtatccagttcttcttgtcacaaaacttcaacgttgcggaacaatttactggtcagccaggttcttatgttccagttgctgaaactgtacgtggctttaaggaaatccttgatggtaaatacgaccacttgccagaagatgccttccgtggtgtaggttctatcgaagatgtgattgcaaaagctgaaaaaatgggattttaagaggtgatctatggctcagttaactgtccagatcgtgacaccagatggtctcgtctatgatcaccatgccagctatgtatcggttcgaactctggatggtgagatggggatcttgccacgacatgaaaatatgattgcggttttagcagttgatgaagtaaaggtaaaacgtatcgatgataaagatcacgtgaactggattgcagtaaacggtggcgttattgaaattgccaatgatatgatcacaatcgtcgctgactctgcagaacgtgctcgtgatatcgatatcagtcgtgcagaacgtgccaaacttcgtgcagaacgtgcaattgaagaagcacaagacaaacatttgattgaccaagaacgtcgtgctaagattgctttgcaacgtgctattaaccgtattaatgtcggaaatagactataagaaaaaatgaacttgaaaataccaagttcattttttatggtgttttaaggagcaaaacggatgcagactgcttcgggaacatggaagtcgttggagagttctgctagacgaccattgtcacaattacgtttaaagacagttgcattgtcagagtcttgatggacaacaatgagaaatttttggtcgggtgtcaaatcaaaatcacgtggagtctgaccatgcgttggaacgatttctaataactctaagctaccgtccgcaaggatggtatatactgcgatagaatcatggccacggttagaagcgtagaggtatttaccgtctttagagagatgaatagcagcggttccattaaagccttcgtaagcttccggtaaagttgaaatgacctgcatacgttcaaattcgccaacgccatcgtagattaaaacttcgatagtactattgagttcacaaatgagataagcgattttatagtggttatggaaaatgatatggcgtgagcctgctcctggcttgctgtgataggtatagagcttagataattttccttcttgatcgaggtcataggtgatgacttggtcagttcccaagtcgcaggtcactagatagtggtcaggtgttaaatctgtatagtgaacatggggggaagcttgattttcatgtggaccttggccactgtgttgatccatatcactaagtagaagactaccatcttcctggcgtttataaacaaggacttgtcccttgtgatagttagctgcgtaaaccaaatcacgcttttcatcgacagcaacataacagtggggagctccttcttcaacaacatgatttaacacagtcccgtcagtttgataggctgcaattccccccttatcgtcttggctaccaacagtgtataaatgttggtgctggtcaaaggcaaggtaggttggacttggctcagctgcaaaaagttctagatttgaaagctgaccagtttctgtatcaaagtctgccttgtaaatcccttgagaagtacgacgtgtataagttccaaaataaacagtttctttcattactatacctctgtgtaaagataagactattatatcacaaaaacaagtaaattaaagatatccaattagatgtaagcactttaaaaaagagttattttgtttcaaaaatggtataatgagagaacaatagaaaggaagtatttatggagcaaaaagagaaacattttagcctatcttggtttttcaagtggtttttagataacaaggcaattacggtatttttagtaaccttattattgggactgaatctttttattttaagtaagattagttttctattttcacctgttttagactttttagcagttgtgatgttgccagtcattttgtctggtttgttatattatttgttgaatcctattgttgattggatggagaagcataaggttaatcgtgttatagctatcactattgtctttgttatcatcgctctctttatcatttggggcttggcagtcgccattccaaatctgcaacgtcaggttttgacctttgcaagaaacgttcctgtttacttagaagatatagataggattgttaatggattggtagcccagcacctgccagatgatttcagacctcaattagagcaagttttgaccaatttttctagccaggctacagttttggcaagtaaggtttcatctcaggcagtcaactgggtgagtgcctttattagcggggcttctcaagtgattgttgccttgattatcgttcctttcatgctcttttatctcttgcgtgatgggaaaggcttgcgtaactatttgacccaattcattccaagaaaattgaaggaacctgttggacaagttttatcagatgtgaatcaacagttgtccaactatgttcgagggcaagtgacagtggctattattgtagcagtaatgtttatcatcttcttcaagattattggtctacgctatgcggttacgctgggggttactgctggtattttaaatctggtcccttatcttggtagctttctagccatgcttcctgctctagtattgggtttgattgctggtccagtcatgcttttgaaagtagtgattgtctttatcgtagaacaaactattgaaggccgttttgtctctccattgattttgggaagtcaattaaacatccaccctattaatgttctctttgttttgttaacttcaggatctatgtttggtatctggggagttttacttggtattccggtttatgcctctgctaaggttgtcatttcagccattttcgaatggtataaggtagtcagtggtctatatgaattagagggtgaggaagtcaagagtgaacaatagtcaacagatgttacaggctttggaggagcaagatttaactaaggctgagcattatttcgccaaagctttagaaaatgattcaagtgatcttctgtatgaattggcaacttatcttgaagggattggtttctatcctcaggccaaggaaatttacctgaaaattgtagaggattttccagaggttcatcttaatctagctgcaattgctagcgaggatggtcaaatagaagaagcctttacctatcttgaggaaatccaagctgacagtgactggtatgtctcgtctttggctctgaaggcagacctttaccagctggaaggtttgacagatgtggcacgtgagaaattattggaggccttgacctactcagaggattctctcttgatattgggtttggcagagttggatagtgagttggaaaattaccaagcggctattcaagcctatgcccagttagataatcgctcgatttatgagcaaacgggcatttccacctatcaacgaattggctttgcctatgctcagttagggaaatttgaaacggctactgagtttttagaaaaagccctggagttagaatacgatgacttaacagcttttgagttggccagtctttattttgatcaagaagaatatcaaaaagccaccctctactttaagcagcttgataccatttctcctgactttgaaggctatgagtatgggtacagtcaggctttacataaggaacatcaagttcaagaagccctgcgtatcgctaagcaaggattagagaaaaatccctttgaaactcgcctcttgctagctgcttcacaattttcttatgaattgcatgatgctagtggtgcagaaaattatctccttactgcaaaagaagacgctgaggatacagaagaaatcttgcttcgtttagccactatttatctggagcaggagcgttatgaggatattctagaattgcagagtgaggagccagaaaatcttttgaccaagtggatgattgctcgttcttatcaagaaatggacgatttggatactgcttatgagtattatcaagagttgacaggagatttgaaggacaatccagaatttctggaacactatatctatctcttgcgtgaattgggacattttgaagaagcaaaagtccatgctcacacttacttaaaactggttccagatgatgtgcaaatgcaagaactgtttgagagattgtaagaatgtttaacccaaatcattcatacctctctcaactagatgtaacttacaaaacccctgacctcatgagccactttcttcctcctcatgaggtcagttttactttctgctgttccagtatcgtttttcctcgctagatttcctcaaaagggcagactcctcccttggtgcgtcacacgattttttcatctcgactgttctttaatgcatcattaacgacgcttttcttctaggtggttcataaggaacaggaagattcaggttgacttttctaatcctagaataaagtgctgaaaacaattcggaataggcatagagactagacaatttgaggagctgcttgcgtcctgttcgaacacattttcccaccacgtgaagaaaaagatggcggaagcgtttgattgttaaagtttggaagtcacctccagctagatgtttgagaaaaagatagagattgtaggcgatacagctcatcatcatacgaattcgtttttgattaaggttgaactatccgttttatcgccaaaaaatcgg

SEQ ID NO: 161 - DNA, 9409 bp; double-stranded, linear
gataagattaagttagaaaagaaagaactaggacatatctaccagattcaggtttttaatagctatgggcaggaagaaatctatcgtgtgattttgatggagaccaatattagttcggtttcaaccaatatcaagtatgctgctgtcttgattaataccagtcagttggaacaggctagtcaaaagcatgagcaattgattgtggtcgtgatggctagtttctggattttgtctttacttgccagtctctatctagctagggtcagtgttaggcccctgcttgagagtatgcagaagcaacagtcttttgtggaaaatgccagtcatgagttacgaactccactcgcagttttgcaaaatcgcttagagaccctttttcgtaagccagaagctaccattatggatgtgagcgaaagcattgcatcgagtttggaagaagtccgaaatatgcgttttttaacgacaagcttgctgaacttagctcggagagatgatgggattaagccggagcttgcagaagttccaactagcttttttaatacaactttcacaaactacgagatgattgcttcggaaaataatcgtgtcttccgttttgaaaatcgtatccatcgaacaattgtcacagatcagcttcttctgaaacaactgatgaccattcttttcgataatgccgtcaagtatactgaggaggatggtgaaattgattttcttatctcggcgaccgatcgcaatctttatttacttgtttctgataatggaatcggtatttcgacagaagataaaaagaaaatttttgaccgtttttatcgagtagacaaggctagaacccggcaaaaaggtggttttggtttaggattatccctagccaagcaaattgtagatgctctaaaaggaactgttactgtcaaagataataaacccaagggaacaatctttgaagtgaagattgccattcagacaccatctaaaaagaaaaaataaaaatatcgctccaattggggcgatattttggatttatcttctacgttttcgtttgataatagaccgttgaacttttaaaacaagtaagctgaatccgattgctgcggcaaaggcaagagcagttgataattttaatgctaaaaagataaaactaaagatagcaatacagatacaaaaaacagcgatattaataaaaaataggatttccttgagattggcatcagattgcgcttcaggtgtataagcttggtaatgaggaagctgctggtttaattcttcttgatagtctacctcataggattgtaattttcttacgggcatgattctctccttaacagtacatacctattttatcattttttcggcagagaattattacagaaaggttacaaaaagaataaagtcccttttcattttcaaagcatggctgattttggagaaatgtggtataatttttcttatggaaaagattgtcattacagcaactgctgaaagtattgaacaagttgaacaactactcgaagctggcgtagaccgtatctatgtcggtgagaaagattttggtcttcgtctgccaacgacctttagttatgaccaattacgtgaaatcgctaagttggttcatgatgctggtaaggaattgatcgttgcggtcaatgctctcatgcaccaagatatgatggaccgtatcaagcctttcttaaacttcttggaagaaatcaagacagactatattacgattggggatgcaggcgtcttttacgtagttaaccgcgatggttattcatttaagaccatctacgatgcttcaaccatggtaactagcagtcgtcagattaacttctggggacaaaaggctggcgcatctgaggctgttttggcgcgtgaaattccatcagctgaacttttcaaaatgccagagattttggaaattcctgctgaagttttggtttacggtgctagcgtcatccatcattctaaacgtccactcttgcaaaactactataactttacacatatcgatgatgaaaagacgcataaacgtgacctcttcttggctgagccaagtgatccagagagccactattccatttttgaagataatcatgggacccatatctttgccaacaatgaccttgatttgatgatcaaattaacagaattggtggagcatggctttactcgctggaaactagaagggctctacactcctggtcagaactttgttgagattgcaaaactctttatccaagcgcgtagcttgattcaagagggcaactttagtcatgctcaagccttcttgctggatgaagaagttcgtaaacttcaccctaaaaaccgtttccttgatacaggattttatgactacgatcctgacatggttagataaaatacatgattcgttgagagaaggaagatgcaaacatttcttctctcaatttttcgtatttcttcactattttacaaaaatcagcaggctagaatgctctattcgatgggatttttaagaaaagtagtgttcttgagtttgaaaattatcctatgtttgcaggtgccaaatggccctttttttggtataattttttataatgaaaacgattggtaatcgctatgttgtggtggatttagaggcaactagcacaggtagtaaggctaaaattatccaagtgggaattgtcgtgattgaggacggagaaatcgtcgatcactatacgacggatgtcaatccacatgaacccttggatgctcatatcaaagaactgacaggattgacagaccaacgtctggcgcaagcacctgatttttcgcaagttgccagaaaaatatttgacttggtggaggatgggatttttgtagcccataatgttcagtttgatgctaatctcttggcggaaaatttattttttgaaggctatgagctaagaaaccctcgtgttgatacggtcgaattggcccaggtctttttccctgaactggaaaaatatagcttgccgattttgtgtcgagaattaggaattcctcttaaacacgcacacacagccctttcagatgcccaagctacagcagaattacttctttttttacggaaaaagatgacccagcttcctaaaggtctcttggaacgcttgctggaaatggctgacgctctcctatatgagtcctacctggttattgaggaaacttatcgcaaccaatctatcctgagttctccagacttggtccaagttcaaggtctatattttaagaaaacggaagcttctctggagccacgaaaactatctcaagacttttctaaaaatatttctctgttgaaccttgaagtgagggaggaacaagaaagttttgctaaagaggttggcttgctattgaaagatgaacctgtctctctgattcaagcgccgacagggattgggaaaacctatggctatctcttacccgctttatctcaatccaaagagcgacaaattgttcttagtgttccgacaaagattcttcaaaatcaaatcatggaagaagaaggtaaacgcctcaaggaagtgttccatacagatattcatagcttaaagggaccacaaaattatctgaagttggatgccttttatcattccttgcaggaaaatgatgaaaatcgcttatttagacgctttaaaatgcaagtcttggtctggcttactgagacagagacaggagatttggatgaaatcgggcaactctaccgttaccaacattttctagcagaccttcgtcatgatgggaatttatcatcccagagcttatttgtgacggaagatttttggaaacgtagtcaagaaagggcagagacttgcaagcttttagtgactaatcatgcctatctcgtaaccagacttgaagataatcctgaatttgtcagtgaccgtttactgattattgatgaagtccaaaagattttgttagctctagaaaatctgcttcaagagacctacgatatacaatctattatcgatttaattgataaggctttagtaggagaagaaaacagggttcaacaacggatactagaaagtattcgctttgagtgtctctacttgatagaacaatttcagtctggcaaatctaggaaaaatatcttagattctctggacaatctccatcagtatttttcagaattggaagtagaagactttgatgagctggttcgctattttacagctgaaggtgattactggcttgaagtaactgaaacgagtcaaaagaaaattcagatttcttctacaaaatcaggccgtactcttctgtcctctttacttcctgagagttgccaagtcttgggagtatcggctactcttgagattagtcagagggtttctttggcagaccttttaggctatcctgaagctaaatttgtcaagattgaatctcggggaaaacaggaacaagaagtggtcatggtcaaagatttccctctggtaacagaaacctccttagaagtctatgccagagaggtagctgctttactagtggaaattcaagctttccagcaaccgattttggttctctttaccgctaaagacatgcttctagcagtatcggatttacttacagttagccacttggcccagtataaaaatggggatgttcatcagctaaagaaacgctttgaaaaaggtgaacaacaaatcttgcttggtgcagcaagtttctgggagggagttgatttttcaagccatccttctgtgattcaagttgtaccgaggcttcctttccaaaatcctcaagaacccttgacgaaaaagattaatcaagaactgaatcaagaagggaaaaatgccttttatgattatcaattgccaatggccattattcgtttaaaacaggctttgggaagaagtatgagacgtgaataccaacgttccttaactcttattttggataggagaatcgtcggaaaacgatacggcaaacaaatagtagcatctctagcagaagaagcgactgttaaaaccatctctcgatccgaagttgacgaggctattgatagattttttaatgagctttgataaatagtattgtatgaaagtataaggttagtatatatgaaacgttctctcgactcaagagtcgattacagtttgctcttgccagtattttttctactggtcatcggtgtggtggctatctatatagccgttagtcatgattatcccaataatattctgcccattttagggcagcaggtcgcctggattgccttggggcttgtgattggttttgtggtcatgctctttaatacagaatttctttggaaggtgaccccctttctatatattttaggcttgggacttatgatcttgccgattgtattttataatccaagcttagttgcatcaacgggtgccaaaaactgggtatcaataaatggaattaccctattccaaccgtcagaatttatgaagatatcctatatcctcatgttggctcgtgtcattgtccaatttacaaagaaacataaggaatggagacgcacggttccgctggactttttgttaattttctggatgattctctttaccattccagtcctagttcttttagcacttcaaagtgacttggggacggctttggtttttgtagccattttctcaggaatcgttttattatcaggggtttcttggaaaattattatcccagtatttgtgactgctgtaacaggagttgctggtttcttagctatctttattagcaaggacggacgagcttttcttcaccagattggaatgccgacctaccaaattaatcggattttggcttggctcaatccctttgagtttgcccaaacaacgacttaccagcaggctcaagggcagattgccattgggagtggtggcttatttggtcagggatttaatgcttcgaatctgcttatcccagttcgagagtcagatatgatttttacggttattgcagaagattttggctttattggctctgtcctggttattgccctctatctcatgttgatttaccgtatgttgaagattactcttaaatcaaataaccagttctacacttatatttccacaggtttgattatgatgttgctcttccacatctttgagaatatcggtgctgtgactggactacttcctttgacggggattcccttgcctttcatttcgcaagggggatcagctattatcagtaatctgattggtgttggtttgcttttatcgatgagttaccagactaatctagctgaagaaaagagcggaaaagtcccattcaaacggaaaaaggttgtattaaaacaaattaaataaggagaaaatcatggtaaaagtagcagttatattagctcagggctttgaagaaattgaagccttgacagttgtagatgtcttgcgtcgagccaatatcacatgtgatatggttggttttgaagagcaagtaacgggttcgcatgcaatccaagtaagagcagatcatgtctttgatggagatttatcagactatgatatgattgttcttcctggaggtatgcctggttctgcacatttacgtgataatcagaccttgattcaagaattgcaaagcttcgagcaagaagggaagaaactagcagccatttgtgcggcaccaattgccctcaatcaagcagagatattgaaaaataagcgatacacttgttatgacggcgttcaagagcaaatccttgatggtcactacgtcaaggaaacagtagtggtagatggtcagttgacaaccagtcggggtccttcaacagcccttgcctttgcctacgagttggtggagcaactaggaggggacgcagagagtttacgaacaggaatgctctatcgagatgtctttggtaaaaatcagtaaaacgggagttattctctcgttttttatgtggaaaactcagggaaatcatcgcttttttcataaaaaaatgctataatgaagggtatgaaatatcacgattacatctgggatttaggtggaactttactggataattatgaaacttcaacagctgcatttgttgaaacattggcactgtatggtatcacacaagaccatgacagtgtctatcaagctttaaaggtttctactccttttgcgattgagacattcgctcccaatttagagaattttttagaaaagtacaaggaaaatgaagccagagagcttgaacacccgattttatttgaaggagtttctgacctattggaagacatttcaaatcaaggtggccgtcattttttggtctctcatcgaaatgatcaggttttggaaattttagaaaaaacctctatagcagcttattttacagaagtggtgacttctagctcaggctttaagagaaagccaaatcccgaatccatgctttatttaagagaaaagtatcagattagctctggtcttgtcattggtgatcggccgattgatatcgaagcaggtcaagctgcaggacttgatacccacttgtttaccagtatcgtgaatttaagacaagtattagacatataagaaaaaggaataagatgacagaagaaatcaaaaatctgcaggcacaggattatgatgccagtcaaattcaagttttagagggcttagaggctgttcgtatgcgtccagggatgtacattggatcaacctcaaaagaaggtcttcaccatctagtctgggaaattgttgataactcaattgacgaggccttggcaggatttgccagccatattcaagtttttattgagccagatgattcgattactgttgtggatgatgggcgtggtatcccagtcgatattcaggaaaaaacaggccgtcctgctgttgagaccgtctttacagtccttcacgctggaggaaagttcggcggtggtggatacaaggtttcaggtggtcttcacggggtggggtcgtcagtagttaatgccctttccactcaattagacgttcatgttcacaaaaatggtaagattcattaccaagaataccgtcgtggtcatgttgtcgcagatcttgaaatagttggagatacggataaaacaggaacaactgttcacttcacaccggacccaaaaatcttcactgaaacaacaatctttgattttgataaattaaataaacggattcaagagttggcctttctaaatcgcggtcttcaaatttcaattacagataagcgccaaggtttggaacaaaccaagcattatcattatgaaggtgggattgctagttacgttgaatatatcaacgagaacaaggatgtaatctttgatacaccaatctatacagacggtgagatggatgatatcacagttgaggtagccatgcagtacacaactggttaccatgaaaatgtcatgagtttcgccaataatattcatacccatgaaggtggaacacatgaacaaggtttccgtacagccttgacacgtgttatcaacgattatgctcgtaaaaataagttactgaaagacaatgaagataatttaacaggggaagatgttcgcgaaggcttaactgcagttatctcagttaaacacccaaatccacagtttgaaggacaaaccaagaccaaattgggaaatagcgaagtggtcaagattaccaatcgcctcttcagtgaagctttctccgatttcctcatggaaaatccacagattgccaaacgtatcgtagaaaaaggaattttggctgccaaggctcgtgtggctgccaagcgtgcgcgtgaagtcacacgtaaaaaatctggtttggaaatttccaaccttccagggaaactagcagactgttcttctaataaccctgctgaaacagaactcttcatcgtcgaaggagactcagctggtggatcagccaaatctggtcgtaaccgtgagtttcaggctatccttccaattcgcggtaagattttgaacgttgaaaaagcaagtatggataagattctagccaacgaagaaattcgtagtcttttcacagccatgggaacaggatttggcgcagaatttgatgtttcgaaagcccgttaccaaaaactcgttttgatgaccgatgccgatgtcgatggagcccacattcgtacccttcttttaaccttgatttatcgttatatgaaaccaatcctagaagctggttatgtttatattgcccaaccaccaatctatggtgtcaaggttggaagcgagattaaagaatatatccagccgggtgcagatcaagaaatcaaactccaagaagctttagcccgttatagtgaaggtcgtaccaaaccgactattcagcgttataaggggctaggtgaaatggacgatcatcagctgtgggaaacaaccatggatcccgaacatcgcttgatggctagagtttctgtagatgatgtgcagaagcagataaaatctttgatatgttgatggggatcgagttgtcctcgtcg

SEQ ID NO: 162 - DNA, 6415 bp; double-stranded, linear
cctgggaaagtcttgaaaattatgatagaatggtggaaggaaaaattcaggagagtagtagtgactcaaaatgttgaaagtcttctcgtatccattgtaatcagtgcatacaatgaagaaaaatatctgcctggtctaattgaagacttaaaaaatcaaacctatcctaaagaggatattgaaattctatttataaatgctatgtccacagatgggaccacagctatcattcagcaatttataaaggaagatacagagtttaactcaattagattgtataacaatcctaagaaaaatcaagctagtggttttaacctgggagttaaacattctgtaggggaccttattttaaaaattgatgctcattcaaaagttactgagacttttgtaatgaacaatgtggctattattcaacaaggtgaatttgtctgtggggggcctagaccgacgattgtcgaaggaaaaggaaaatgggcagagaccttgcatcttgttgaggaaaatatgtttggcagtagcattgccaattatcgaaatagttctgaggatagatatgtttcttctatttttcatggaatgtataaacgagaggttttccagaaggttggtttagtaaatgagcaacttggccgaactgaagataatgatattcattatagaattcgagaatatggttataaaatccgctatagcccaagtattctatcttatcagtatattcgaccaacattcaagaaaatgctgcatcaaaagtattcaaatggtttgtggattggcttgacaagtcatgttcagtttaagtgtttatcattatttcactatgttccttgtttatttgttttgagtcttgtgtttagtctagcattgttaccgatcacattcgtattcataactttactattaggtgcctattttctacttttgtcattactcactttgctgactttattaaaacataaaaatggatttctaattgtgatgccctttattttattttccattcactttgcttatggccttgggacgattgtaggtttaattagaggatttaaatggaagaaggagtacaagagaacaataatttatttggataaaataagccaaataaatcaaaatatgctataataacaatatagtaaaactcttttaaggaggagtagatttctatgaataaaaaactaacagattatgtgattgatctggtggaaattttaaataaacaacaaaagcaggttttctggggaatatttgatattttcagtatggtggtttccatcattgtatcttatattttattttatgggctgattaatccagcacctgttgactacattatctatacgagtttggccttcctgttctatcaattgatgattggtttttgggggttgaacgcgagcattagtcgttacagcaagattacggatttcatgaaaatcttttttggtgtgactgctagcagtgtcttgtcatatagtatctgttatgccttcttgccactcttctccatccgtttcatcattctctttatcttgttgagtaccttcttgattttattgccacggattacttggcagttaatctactccagacgcaaaaaaggtagtggtgatggagaacaccgtcggaccttcttgattggtgccggtgatggtggggctctttttatggatagttaccaacatccaaccagtgaattagaactggtcggtattttggataaggattctaagaaaaagggtcaaaaacttggtggtattcctgttttgggctcttatgacaatctgcctgaattagccaaacgccatcaaatcgagcgtgtcatcgttgcgattccgtcgctggatccgtcagaatatgagcgtatcttgcagatgtgtaataagctgggtgtcaaatgttacaagatgcctaaggttgaaactgttgttcagggccttcaccaagcaggtactggcttccaaaaaattgatattacggaccttttgggtcgtcaggaaatccgtcttgacgaatcgcgtctgggtgcagaactgacaggtaagaccatcttagtcacaggagctggaggttcaatcggttctgaaatctgtcgtcaagttagtcgcttcaatcctgaacgcattgtcttgctcggtcatggggaaaactcaatctaccttgtttatcatgaattgattcgtaagttccaagggattgattatgtacctgtgattgcggacattcaagactatgatcgtttgttgcaagtctttgagcagtacaaacctgctattgtttatcatgcggcagcccacaagcatgttcctatgatggagcgcaatccaaaagaagccttcaaaaacaatatccgtggaacttacaatgttgctaaggctgttgatgaagctaaagtgtctaagatggttatgatttcgacagataaggcagtcaatccaccaaatgttatgggagcaaccaagcgcgtggcggagttgattgtcactggctttaaccaacgtagccaatcaacctactgtgcagttcgttttgggaatgttcttggtagccgtggtagtgtcattccagtctttgaacgtcagattgctgaaggtgggcctgtaacggtgacagacttccgtatgacccgttactttatgaccattccagaagctagccgtctggttatccatgctggtgcttatgccaaagatggggaagtctttatccttgatatgggcaaaccagtcaagatttatgacttggccaagaagatggtgcttctaagtggccacactgaaagtgaaattccaatcgttgaagttggaatccgcccaggtgaaaaactctacgaagaactcttggtatcaaccgaactcgttgataatcaagttatggataagattttcgttggtaaggttaatgtcatgcctttagaatccatcaatcaaaagattggagagttccgcactctcagtggagatgagttgaagcaagctattatcgcctttgctaatcaaacaacccacattgaataaaaaagaaaaacgcatagtatcaagttacacaaccttggtaatatgcgttttattatgtagagacttatactcttcgaaaatctcttcaaaccacgtcaacgtcgccttgccgtatatggttactgacttcgtcagttctatccacaacctcaaaacagtgttttgagytgacttcgtcagttctatccacaacctcaaaacagtgttttgagctgacttcgtcagttctatccacaacctcaaaacagtgttttgagctgacttcgtcagttccatccacaaccttaaaacagtgttttgagytgacnttcgtcagttccatctacaaccttaaaacagtgttttgagctgcccgcagctagtttcctagtttgctctttgattttcattgagtattacttcattttcttctgaaatggaattgttacccagtctatgctattgaaaatacgccaaaacttctaagggtttgtgagcgatataatcaggttgatagtttagtagatctgcttgctctccaaatccccaagtgatggccaatttctgaatacctgtttctcgagctcccagcatatcaaacttggtatctccgatgatgatggcttgttctggtgctagttgatgtgtctgcaaggcttggtgaatgacatctgccttatggggtgcttcagggctagaaccataaatgccatcaaagaaatgatggatttccaagttttttgccatgtcttgagcagtagatgtatcctttgtcgtggtgatgtagagtggataactgctcgataactcctcaagcaagtctataatctgaggaaagagttgagcttcatagatgccttttgccttatagtaagaacgatatatctgcacggcttcagaaatttggtctttggacaggcaggtcgcaaaactactttcgagaggtggtcccataaaaccacgaatagttttggcatcagggctaggcacccccagctctttaaaggtataggtaaaggcattgtgaatcccgatagaactatcaacgagggttccatccaaatcgaaaaaaatcgctgtgatagaggtcatggtttctcctatttgataagcttattctccgaaaatttctttttggaggcgacgaccagtaggggtggtagcgagtccaccttcagctgtttcacgaaaggcagttggcatgcttgctcctacttggtacatggcatcgatcacttcatccacagggattttagattcgatacctgccaaggccatgtctgctgcgatgaaagcaaagctagctcccatggcattacgtttgacacagggaacttcgaccaaacctgcaacagggtcacagatgaggcctagcatatttttaatgacaaaggcaatagcttgactggcctgataaggtgttccacctgcagccagagtcaaggcggcagcactcatagcagaggctgaaccaacttcagcttgacacccaccctcagcacctgagatggaggcattgtttgcgatgactagtccaaaggcaccagcagcaaagaggaaatccaattgttgctcgtggctgaggtctaatttttcaatagcagcagtgagaacggatggcagacagccagcacttccagcggttggagtggcacagaccaagcccattttggcattgtgttcattgactgcgatggcatttcgggcagccgagagaatcgtataatctgacagagtttttccgttttcgatgtagtgatccaatttggcagcatctccacctgtcaggccactacgagatttattttcattgaggccaagttggacagaggctttcataacttccagattgcgttccatgagaaggaagacttcttcacgttcgcgaccggtcaattcaaactctgttgtaatcatgagttctgcgacatttccttgaaagtccagatctgcttgctcgaccaattctttgatagaataaaacatgcttcctcctatttaaagaaattgacattgtggagatgagggatttttcgaatttcttcgatagcctcatcacagttgcgactgtcaacttcgataatcataatggctttttcaccagctttttcacgagtgacattcatctgggcgatattgataccatagcgggaaagcgcctctgtaacaagggcaatcatacctggaatatcttgatgaacgatgatgatagtcggtgtattcatattgagagagacggcaaaaccattgagttcggttacctgaatatttcctccaccgatagaaataccagtcacgctgatggtcttgtgggcatttttaacagtaattttagtggtgttagggtgaggggcattgctgtctttctgaatggtccagacaatcttgataccacgcttgtgggcaatttccagactatttggaatttcaggatcatctgtatccattcctaaaatacctgcaacaagggctaggtctgttccgtgaccacgataggtcttggcaaatgagttaaaaagttggaattcaacttctgtcggagtatcatcaaaaatggaagagacaatcttcccaatacgaacagcaccagcggtatggctactagatgggccaatcataactggtccgatgatatcaaagacagattgaaaacgaagtgatttcatcagtttccccttataaaaattcttatctctattatatcaaagaatgaggggcttggctttaattgtggatgaaaacctttctaatacctcaaatagcataaaaatagtatcttttatgacaaaaaacaccttatttagggaaataaaaaataattttgtaatatttctacataaaagtgtcaagaaacggtaatatttaaagggtatgatagaactatagaaagaaggagaattttcgaatatgaaatcaataactaaaaagattaaagcaactcttgcaggagtagctgccttgtttgcagtatttgctccatcatttgtatctgctcaagaatcatcaacttacactgttaaagaaggtgatacactttcagaaatcgctgaaactcacaacacaacagttgaaaaattggcagaaaacaaccacattgataacattcatttgatttatgttgatcaagagttggttatcgatggccctgtagcgcctgttgcaacaccagcgccagctacttatgcggcaccagccgctcaagatgaaactgtttcagctccagtagcagaaactccagtagtaagtgaaacagttgtttcaactgtaagcggatctgaagcagaagccaaagaatggatcgctcaaaaagaatcaggtggtagtatacagctacaaatggacgttatatcggacgttaccaattaacagattcatacctgaacggtgactactcagctgaaaaccaagaacgggtaccg

SEQ ID NO: 163 - DNA, 8494 bp; double-stranded, linear
tacccctttcgaattttggcaaaaattcggtaaggctttgatggtagttatcgcggttatgccggctgctggtttgatgatttcaatcggtaagtctatcgtgatgattaacccaacctttgcaccacttgtcatcacaggtggaattcttgagcaaatcggttggggggttatcggtaaccttcacattttgtttgccctagccattggaggaagctgggctaaagaacgtgctggtggtgctttcgccgctggtcttgccttcatcttgattaaccgtatcactggtacaatctttggtgtatcaggcgatatgttgaaaaatccagatgctatggtaactactttctttggtggttcaatcaaagttgctgattactttatcagtgttcttgaagctccagccttgaacatgggggtattcgtagggattatctcaggttttgtaggggcaactgcttacaacaaatactacaacttccgtaaacttcctgatgcactttcattcttcaacgggaaacgtttcgtaccatttgtagttattcttcgttcagcaatcgctgcaattctacttgctgctttctggccagtagttcaaacaggtatcaataacttcggtatctggattgccaactcacaagaaactgctccaattcttgcaccattcttgtatggtactttggaacgtttgctcttgccatttggtcttcaccacatgttgactatcccaatgaactacacagctcttggtggtacttatgacattttaactggtgcagctaaaggtactcaagtattcggtcaagacccactatggcttgcatgggtaacagaccttgtaaaccttaaaggtactgatgctagtcaatatcaacacttgttagatacagtacatccagctcgtttcaaagttggacaaatgatcggttcattcggtatcttgatgggtgtgattgttgctatctaccgtaatgttgatgctgacaagaaacataaatacaaaggtatgatgattgcaacagctcttgcaacattcttgacaggggttactgaaccaatcgaatacatgttcatgttcatcgcaacacctatgtatcttgtttactcacttgttcaaggtgctgccttcgctatggctgacgtcgtaaacctacgtatgcactcattcggttcaatcgagttcttgactcgtacacctattgcaatcagtgctggtattggtatggatatcgttaacttcgtttgggtaactgttctctttgctgtaatcatgtactttatcgcaaacttcatgattcaaaaattcaactacgcaactccagggcgcaacggaaactacgaaactgctgaaggttcagaagaaaccagcagcgaagtgaaagttgcagcaggctctcaagctgtaaacattatcaaccttcttggtggacgtgtaaacatcgttgatgttgatgcatgtatgactcgtcttcgtgtaactgttaaagatgcagataaagtaggaaatgcagagcaatggaaagcagaaggagctatgggtcttgtcatgaaaggacaaggggttcaagctatctacggtccaaaagctgacattttgaaatctgatatccaagatatccttgattcaggtgaaatcattcctgaaactcttccaagccaaatgactgaagcacaacaaaacactgttcacttcaaagatcttactgaggaagtttactcagtagcagacggtcaagttgttgctttggaacaagtaaaggatccagtatttgctcaaaaaatgatgggtgatggatttgcagtagaacctgcaaatggaaacattgtatctccagtttcaggtactgtgtcaagcatcttcccaacaaaacatgcttttggtattgtgacggaagcaggtcttgaagtattggttcacattggtttggacacagtaagtcttgaaggtaaaccatttacagttcatgttgctgaaggacaaaaagttgcagcaggagatctccttgtcacagctgacttggatgctatccgtgcagcaggacgtgaaacttcaacagtagttgtcttcacaaatggtgatgcaattaaatcagttaagttagaaaaaacaggttctcttgcagctaaaacagcagttgctaaagtagaattgtaatatacttgaggttggaagctgtattccaacctcttattttgggagaaaagaatgaaatttttaacactcaatactcacagttggatggagaaagaagcagaggaaaaattccagattttgcttgaagatattcttgaaaaggactatgatttgatttgttttcaagaaatcaatcaggagatgacctcgtcagaggtggaggttaatgacctttatcaagctttgccagcagctgagcctattcaccaagaccattatgttagactcttggttgaaaagttgtctgagcaagggaaaaattactactggacctgggcctataaccatatcggctataaccgctaccacgaaggtgtggctatcttgtctaaaacacctattgaagccagagaaattttggtttcagatgtggatgatccaacagactatcatactcgccgtgttgccctagctgaaactgtagtcgatggcaaggagctagcagttgccagtgttcatctctcttggtgggataaaggtttccaagaagaatgggcacgatttgaggctgtcttgaaaaaattgaacaagccacttttactagctggagatttcaacaatccggctggacaggaaggttaccaagctattttagctagtccattaggcttacaagacgcatttgaagttgctcaagagaaaagtggtagctatactgttccgcctgaaattgatggctggaaagggaacactgaaccccttcgaatcgattatgtctttactaccaaagagttagcggtggaaaatttacatgtcgtatttgatggtaacaagagtccacaagtgagtgatcactatggcttgaatgctatattaaactggaaataataactgaaaagaggttggaactataaaattccagccttttcttactagagaagctactggaaatagcctaaataagtgagactactgtaatggaataaaatatggtataattgataaggtagatagaatcgaggatgttatgtcatttacgaaatttcaatttaaaaactatattagagaagccttgaaggagttaaaatttacaactccaacagaggtgcaagacaagttgattcctattgttttggcaggtcgtgacctagtaggagaatcaaaaacaggttcaggtaagactcatactttcttgttaccgattttccagcaattagatgaagctagcgatagtgtacaagcagtgattactgcaccgagtcgtgagttggctactcaaatttaccaagtagcgcgtcagatttcagctcactcagatgtcgaagttcgtgtggttaattatgtgggtggtacggataaggctcgccagattgagaaattggcaagcaatcagcctcatattgttattggaacaccaggccgtatctacgacttggttaaatctggtgatttagctattcataaagccaagacatttgttgttgatgaagcagatatgaccttggatatgggattcttggaaactgttgataagattgctggcagtcttccaaaagacttgcaattcatggtcttctcagcgactatcccacaaaaactgcaaccattcttgaaaaaatacttatcaaatcctgttatggagaaaattaagaccaaaacggttatttctgacaccattgataattggttgatttcgaccaagggacatgataagaatgctcaaatttaccagttgactcagttgatgcagccgtatttggcaatgatttttgttaacactaaaacgcgtgctgatgaattgcattcatatctgactgctcaaggcttgaaggttgcaaaaatccatggcgatattgcccctcgtgaacgcaagcgaatcatgaatcaggtgcaaaatctggattttgagtatattgtcgcaacagatttggcagcgcgtgggattgacattgaaggtgtcagccatgtcatcaatgatgccattccgcaagacttatctttttttgttcatcgtgttggtcgtactggacgaaatggcctaccaggtacagctattaccctttatcagccaagtgatgactcggatatccgtgagttggagaaattgggaatcaagtttagtcctaagatggtcaaagacggggaatttcaagatacctatgaccgtgatcgtcgtgccaaccgtgagaaaaaacaagataaacttgatatcgaaatgattggtttggttaaaaagaaaaagaaaaaagtcaaaccgggttataagaagaaaattcaatgggcggttgatgaaaagcgccgtaaaaccaagcgtgctgaaaatcgcgctcgcggtcgtgcagagcgtaaagctaaacgccaaacattttaatagaaattgttggagtattgagctccaacttttttatttatgagaacgaactatctaaaccgaaacactacattaaagactgcaaattgcgattaaaaatggtataatgataaagttatatagtcccgataagatggtaggtatttattacgaagagttttcctatcagtactttgtaactctataacaatattttttaaggggggacatttttatgtcagagcgtaaattattcacgtctgaatctgtatctgaggggcatccggataagattgcagaccaaatttcagatgcgattttggatgctattttagcaaaggatccagaggcgcacgttgctgctgaaacagctgtatatactggttctgtccacgtttttggtgaaatttctacaaatgcctatgtggatattaaccgtgtggttcgtgataccattgcagagattggttataccaatacagaatatggattttctgctgagacggtgggagtacacccatctttggtggaacaatctcctgacatcgctcaaggtgttaacgaagccttggaggttcgtggaaatgctgatcaagatccactggacttgattggagcaggtgaccaagggctcatgtttggatttgcagtagatgaaacagaagagcttatgccattgccaattgcactcagtcataaattggttcgtcgtctggcagaacttcgtaagtctggagaaattagctatctccgtccagatgcaaaatcacaagttacagttgagtacgatgaaaatgaccgtccggtacgtgtagatacagtcgttatttctactcagcatgatccagaggccactaatgaacaaatccatcaagatgtgattgacaaggtcatcaaagaagttattccatcttcttatcttgatgataagacaaaattctttatcaatccgacaggtcgttttgtaatcggtggtcctcaaggggactcaggtttgactggtcgtaagattattgtagatacttatggtggctactctcgtcatggtggtggtgccttctctggtaaagatgcgactaaggtggatcgttcagcctcttatgcggctcgctatattgccaagaatatcgttgcagcagaccttgctaagaaggcagaagtgcagttggcctatgctatcggtgttgcgcaacctgtttctgttcgtatcgatactttcggtacaggaacagtagctgaaagtcaacttgaaaaagcggctcgtcaaatctttgaccttcgccctgcagggattatccaaatgctggacctcaagcgtccaatttaccgtcaaacatcggcttacggtcacatgggacgtacagatattgatcttccatgggaacgtttggataaggtagatgctttgaaagaagcagtaaaataagattttaagaggggaacgtcctctcttttttatagtttttaactatactgggatactgttctgaaaatccattttgcgaaagtagagatttacatgtatagtagattgaaactagaatagtacacctcaacttctaaaacattgttagcaatcaatttgactgtcctgatcgatttctcctgttcttgtttcattttactatatttctttaaaaatgataaaggttaagatttctcctcgtaatagataatcttggggatatttcaatccaaagttttattcgttatcacttgactattgcaaggttttctagagcaacagagtcatggaatggactcatggttgagatttctccttgttgcttggacttcattcaaaagtctgttacccaagccttgttcaaacttctaatacactagctgtttccatagcatgacttctgtactagactttcttttccgaataaatagatagaaccacagaatctagtaaacctagaattaaaattatggtataatattagcaataaaagaaatctggaggattagaatcatggtatcaacgaaaacacaaattgctggttttgagtttgacaattgcttgatgaatgcagcaggtgtggcttgtatgacgatagaggagttagaagaggtcaaaaactcagcggcaggaacctttgttactaagacagcgaccttggacttccgtcaggggaatcctgagccacgctaccaagatgttccacttggttccatcaactctatgggcttgccaaataatggcttagactattatttggattatcttttagatttgcaggaaaaagagtcgaaccgaactttcttcttatctctggtcggcatgtctccagaggaaacccatactattttgaaaaaagtccaagagagtgattttcgtggtctgactgagctaaatctttcctgtccaaatgttccaggtaaacctcagattgcctatgattttgagacaacagaccggattttggcagaagtgtttgcttacttcaccaaacctcttggaattaaattgccaccttattttgatattgttcactttgaccaagcggcagctattttcaacaaatatccgctcaagtttgtcaactgcgttaactctatcggaaacggcctctatatagaagacgaatctgtcgttattcggcctaagaatggttttggtggaattggtggagaatacatcaaaccgactgctttagccaatgttcacgccttttatcaacgtttaaatcctcaaatccaaattatcggaacaggtggcgttctgactggtcgagatgcctttgaacacatcctctgtggagcaagtatggtgcaggtgggaacgacccttcacaaagaaggcgtcagtgcttttgaccgcattaccaatgaactgaaagcaatcatggtggaaaaaggctacgagagcttagaagatttccgtgggaaattgcgctatattgactaaattaaatcgaaaaatctgaagaaaggagagacgatgctagccattgaagaaagtcagaagttgactttatcaaatttaccgagcctgagcctatttacagggacagatcagggtcagtttgaagtgatgaagagtcaaatgttgaaacagattgggtatgattctgctgacctcaactttgcctactttgatatgaaagaagtagtttacaaggatgtggaactggagttggtcagccttcctttctttgcggatgagaaaatcgtgatattagattattttatggatatcacgactgctaagaaacgctttttgacagatgatgagcttaagtcatttgaggaataccttgacaatccttctccaacaaccaagttgataatctttgcagaaggaaagctggatagcaaaagacggttagtcaaattacttaagcgtgatgccaaggccttcgatgcagtagaagtaaaagaacaagaattgcgccagtacttccaaaagtggagtcagaaacaaggtctgcagtttaccaatcattcttttgaaaatctcctcatcaagtcggggtttcaatttagcgaaatccagaaaaatcttctctttttacagtcctataaggcgaattctgttattgaggaagaggatattgttaacgcaattcccaagacttgcaggacaatatttttgatttaactcagtttattctgactaaaaagatggatcaggcgcgcgatttggtgagagacttgaccttgcaaggggaagatgaaatcaaactgattgcagtcatgctgggacaatttcggacttttactcaggtgaagattttggcggagtctggccaaacagaatcgcagattgcaagtagtttaggtagttatctgggacgtaacccaaatccttatcaaatcaagtttgcattaagagattcgagaggactttctttgagctttttgaagcaagctatttcctatttgattgagacagactatcagattaagacaggtctttatgaaaaaggtttcctttttgaaaaggcactcttacagattgctagtcaggtcaattgacatttgttgaaactactaacccgcgg

SEQ ID NO: 164 - DNA, 9707 bp; double-stranded, linear
ccggtcagttcgttcagtacaaggaatcataatgaacgatcaatcagaaaaaaagactagaaagaagactgtatggataatcgaccaattggttttttggattcgggtgtcgggggcttgaccgttgtgcgcgagctcatgcgccagcttccccatgaagaaatcgtctatattggagattcggcgcgggcgccctatggcccccgtcctgctgagcaaattcgtgaatatacttggcagctggtcaactttctcttgaccaaggatgtcaaaatgattgtcattgcttgtaacactgcgactgcggtcgtctgggaagaaatcaaggctcaactagatattcctgtcttgggtgtaattttgccaggagcttcggcagccatcaagtccagtcaaggtgggaaaatcggagtgattggaacgcccatgacggtacaatcagacatataccgtcagaaaatccatgatctggatcccgacttacaggtggagagcttggcctgtcccaagtttgctcccttggttgagtcaggtgccctgtcaaccagtgttaccaagaaggtggtctatgaaaccctgcgtcccttggttggaaaggtggatagcctgattttgggctgtactcattatccactccttcgccctattatccaaaatgtgatggggccaaaggttcagctcatcgatagtggggcagagtgcgtacgggatatctcagtcttactcaattattttgaaatcaatcgtggtcgcgatgctggaccactccatcaccgtttttacacaacagccagtagccaaagttttgcacaaattggtgaagaatggctggaaaaagagattcatgtggagcatgtagaattatgacaaataaaatttatgaatataaggatgaccaggactggtatgttgggtcttatagtatttttggtggcgttaacagtttgagcgactataagacagattttcctctgtttgaattctccaaaatatttggagatgaagagtatggtttcccgctttcagttactgttttacgctatggttctatctaccgtttgttctcctttgtggtagacatgcttaatcaagaaatgggacgaaacttggaagttattcaacgtcatggggccctgctcttggttgaaaatgggcaactcttgtatgtagaattgcctaaagaaggggtcaatgttcatgatttctttgagacaagcaaggtcagagaaaccttgttgattgcgactcgtaacgaaggtaaaaccaaggaattccgagctatctttgataagttaggctacgatgtggaaaatcttaatgactaccctgacctgcctgaagtagcagaaacaggtatgacctttgaagaaaatgcccgccttaaggcagaaaccatttctcaattaacgggcaagatggttttggcagatgattctggtctcaaagtcgatgtccttggtggcttaccaggcgtctggtcagctcgtttcgcaggtgtgggagcaactgaccgtgaaaataatgccaaactcttgcacgaattggccatggtctttgaactcaaggaccgctcggctcagttccacacaaccctagtcgtagccagcccaaataaggaaagtttagttgttgaagcagactggtcaggttatattaactttgaacctaagggtgaaaatggctttggctatgatcccctcttccttgtaggagaaacaggtgagtcatcagctgaattaaccctggaagaaaaaaatagtcaatctcaccgtgccttagccgttaagaaacttttggaggtatttccatcatggcaaagcaaaccatcattgtaatgagcgattcccatggcgatagcttgattgtggaagaagtccgtgatcgctatgtgggcaaagtcgatgctgtttttcataacggcgattctgaactacgtccggattctccactttgggagggcatccgcgttgttaaagggaacatggacttctacgccggctacccagaacgtctggtgactgagcttggttcgaccaagattatccaaactcatggtcacttgtttgacatcaatttcaactttcaaaagttggactactgggctcaggaggaagaggccgctatctgcctctatggtcacttgcatgtgccaagtgcttggttggaaggcaagatcctctttctaaatccaggttctatcagtcaaccacgaggtaccatcagagaatgtctctatgctcgtgtggagattgatgatagttacttcaaagtggactttttgacacgagatcacgaggtgtatccaggtttgtccaaggagtttagccgatgattgccaaggagtttgagactttcttgttggggcaggaggaaacttttttgacccctgctaaaaatctagctgtgttgattgatacccacaatgcggatcatgcgaccctcttgctcagtcagatgacctatacccgtgttcccgttgtgacagatgaaaaacagtttgttgggacgattggactcagagatattatggcttatcagatggagcatgacttgagccaagaaatcatggcggatacggatatcgttcatatgacaaaaacggacgtagcggttgtttcgcctgatttcaccattacggaggtcttgcacaagctagtagatgagtccttcttaccggttgtggatgcagagggtattttccaagggattattacgcgcaagtccatcctcaaggccgttaatgccctcttgcatgactttagtaaggaatatgagattcgatgccaatgagagacaggatttcagcctttttagaggaaaagcagggcttgtctgtcaattccaagcagtcctataagtatgatttggagcaatttttagacatggtaggtgagcggatttctgagaccagtctcaagatttaccaagcccagctagccaatctaaaaatcagcgcccagaagcgaaagatttcggcctgtaaccaatttctatactttctctatcaaaaaggagaggtggacagcttttaccgcttggaattagccaaacaagctgaaaagaagacggaaaagccagagattctatacctagactctttttggcaggaaagcgaccatccagagggccgcttgctagcgctcttaatcctagaaatggggctcttgcccagtgagattttagccatcaaggttgcggacatcaatctggattttcaggtgttgcgaatcagcaaggcttcccaacagaggattgtcaccattcccacggccttgctttcagaattggaacccttgatggggcagacctatctttttgaaagaggagagaaaccctattctcgtcagtgggcctttcgtcagttagaatcttttgtcaaggagaaaggttttccatccttatcagctcaagtcttacgtgaacagtttattctaagacaaatagaaaacaaggtcgatttgtacgaaattgcaaaaaaattaggattaaaaacagtcctgaccttagaaaaatatagataatggatattaaattaaaagattttgaaggacccctggacttgctcttgcatctggtttctaagtaccagatggatatctacgatgtgcccattacggaagtcatcgaacagtatctagcctatgtctcaaccctgcaggccatgcgtctggaagtgacgggtgagtacatggtcatggctagtcagctcatgctgattaagagtcgtaaactccttccgaaggtagcagaagtgacagacttgggggatgacctggagcaggacctcctctctcaaatcgaagaatatcgcaagttcaagctcttgggtgagcacttggaagccaagcaccaagaacgggcccagtattattccaaagcgccgacagagttgatttacgaagatgcggagcttgtgcatgacaagacgaccattgacctctttttgactttttcaaatatcctagccaagaaaaaagaggagtttgcacaaaatcacacgacgatcttgcgggatgagtataagattgaggacatgatgattatcgtgaaagagtccttgattggacgagatcaattgcgcttgcaggatttgttcaaggaagcccagaatgtccaagaggtcatcaccctctttttggcaaccctagagttaatcaaaacccaggagttgatcctcgtgcaagaggagagttttggagatatctatctcatggaaaagaaggaagaaagtcaagtgcctcaaagctagacttgatagagaggaaagatgagtactttagcaaaaatagaagcgctcttgtttgtagcgggtgaagatgggattcgggtccgccagttagctgaactcctctctctgccaccgacaggcatccagcaaagtttaggaaaattagcccagaagtatgaaaaggacccagattccagtttggctttgattgagacaagtggtgcttatagattggtgaccaagcctcaatttgcagagattttgaaggaatactctaaggcgcctatcaaccagagcttgtctcgggctgcccttgagaccttgtccattattgcctacaaacagccgattacgcggatagaaattgatgccatccgtggagttaactcgagtggagccttggcaaagttgcaggcttttgacctgataaaggaagacgggaaaaaggaagtattggggcgccccaacctctatgtgactacggattatttcctagattacatggggataaaccatttagaagaattaccagtgattgatgagcttgagattcaagcccaagaaagccaattatttggtgaaaggatagaagaagatgagaatcaataagtatattgcccacgcaggtgtggccagtaggagaaaagcagaagagctgattaagcaaggcttggtgacggttaacggccaagtggtgcgtgaactagcaaccactatcaagtcaggcgacaaggtcgaagttgaaggtcaacctatctacaacgaagaaaaggtctactatctgcttaacaaaccacgcggtgtgatttccagtgtgacagatgataagggtcgcaagacggttgtcgacctcttgcccaatgtcaaagagcgtatttaccctgtgggtcgtttggactgggatacatcaggtgtcttgattttgaccaatgatggggactttacagacgagatgattcaccctcgtaatgagattgacaaggtttatgtcgcgcgtgttaaaggtgtggccaataaggacaatctccgccccttgacccgtggtcttgagattgatggtaagaaaaccaagccagctgtttatgaaattctcaaagtggacccagtcaaaaatcgctctgtggtgcagttgaccatccatgaagggcgtaaccatcaggttaaaaagatgtttgaagctgttggtctccaagtagataagttgtctcggactcgtttcggacacctagacttgacaggactccgtccaggagaatcccgtcgtcttaataaaaaagaaatcagccaactacacaccatggctgtaactaagaaataatgaaacgaattttaatagcgcctgtgcgcttttaccaacgttttatctcaccagtctttccaccctcttgtcgctttgagctgacttgttccaactacatgattcaggctattgaaaaacatgggtttaagggggtattgatgggcttggctcggattttacgttgtcatccctggtcgaaaacaggtaaggaccccgttccagaccgcttttcccttaaacgaaatcaagaaggggaatgaggtggggtaaatagatttcaaaatgataaaaacgcatcctatcaggtttgagtgaacttgataggatgcgttttagaatgtcaaaattttatactcttcgaaaatctcttcaaaccgcgtcagctttcatctgcaacctcaaaacagtgttttgagcaacctgcggctagtttcctagtttgctctttgattttcattgagtattaaattgagtttgaagtggcttatttcaaagctttttgtatgtcttcaatcatgagttttgttgattcaagtccgcctccgcttagataccagaggtctggtgttagttggataatcttaccatttttagcagcaggtgtttcagcgataagggcattttctaggacaccgtcgttgctagagttgtccccaccgatggcaagggtacggttgatgacaaagaggatgtcagggttgatttctttgacactttcaaagctgacttcttgtccgtggcgtgagtcttcaaattttgtatcagttggtttgaatttcaaggtttggtacaagaaagagaaacgagatttggcaccaaaggctgccatttttccttcattaaggaggatcgcaagggcttttttgtcagagctttcatttttagtagcgacttcttggatgctcttgtctagcttggtcaattcttccttggctttctgtgtaccagtttcgccgaaggcacttgctaaggattcgatattagccttggtagaagtccagtagtcgtccttgcttgcttggaagagaacggttggggcgatttctttgaatttgtctacgaatttttgtgtacgtggcgaagcgataatcaaatcaggctcaagggcggcgatagcttctaaatcaggttctttcatagaaccaacatttttgacagttcccactaggtcttttagataagtcggaacagtttttgtaggcattccgacgatatttttttcaaatcctaaagcgcgaatagtatccgcagcgccgaggtcaaaggtcacaatcttttcaggaactttggaaagtttgacctcgtccagtgaacttttaatggttacctctgttggagcagagctactggtctctgtctgactagtgcttgagtttgtactacatgcaccaagtaggagcaagaagctggccactagggcagtgaaataaagtttaagggatgttttcataatttctcctttttaaaatgtgataacgatttagggagtctcttaatcttattgactaagagactgaaggttctctaacttgagcttttatgttactagctatagatacagatctttttgtcattgatatcagctagcgtgatgggaatctcataaagttgactgagcaggtcagcctgcatgatttgatcggttcttcccttgctaaagacctggccgtccttgaaggcgacaatttcatctgcatactgactggccatgttgatatcgtggaggacgatgataatggtcttgccgagttcctccaccagtcgtcgaagaatctgcatcatgctgacgctttgcttgatatcgagattgttgagtggttcgtccagcaagataaagtccgtatcctgggccagtaccatagcgataaagacgcgctggagttgcccccctgacaggctattgatgtagcggtcttttaagttggtcagttctaaatagttcagagtttctcggattttttcccagtcttctgatctaagtcgacctcggctgtagggaaaacgtccaaaactgaccagttcttcaacagtcaatttggcttggtaattgattttctgttttaggatggttagttcttgggccagttcttgcgaattccagctctcgatttcacgtcctttgatactgagaactccctgatctttcttggttagcctgctcatgatggagaggagagtcgattttccagcaccatttggaccaataaaggctgtcagtttttgaggactgacttcaagcgaaatgccttgcaaaatatcctgtttttgaatggatttgtcaatgttttccagtttcactgacgagacctcctatatagtaagataaagaataagaagccacccacactctcaatgatcatactgatacgaatttccagtgcaaagactcgttcaatcaaggcttgccccaaggttaagctaataaatccaaccagaatggccactataaagagtaacttgtgctgatagtctttgacaatcaggtaggtgaggttggccagtataaagccgaagaaggccataggtcctaccaaggcagtggccgttgaggtcaaaagcacgattccccagaggagctctttctgttctttttcaacatcgagtcccaatatctgagccgtttctctttgcaggtgcaagacatctagaacgactgcttttcgaaagaaaaagattgtcaaagcgaggatgatcagagaaccgatggctaggatggaagtgttgagatgttgaaaggaggcaaaaagactattttgcagtttatcgtattcgtttggatccattaggacttgaaggaaggtgctgatatttcgaaagagacttctgagcgctagacagatcagcaggacgaagaccaggtcttgcttcatcagtgtcttcaagtaaccttgtaaggcgagaaagaagagggactggacaagaagtaagactaggaattctaagataggggatttgccaagttgaagaaacttgctttcaaaaaccagtagtagggtttgtagtaggacgtagaaggattcaattcccaaaatactaggcgtcaggaagcgattttccgtcagggtttgaaaactaatggtcgaaatcccagtcgcgatggctaccaagagataaacgatgatcttttgggaacgcaacttccaagcaaaggctgacaagtgagtgatgggccaaaagtagagaagacaagctccgatggcaagaataatgagaatccagaagagcttggtatgtttgcttttagtctgcatcttttcgtccccctctccagagaagtaggataaagacgagactaccgatgattcctagcaagagactgacagacaactcatagggcctaatcagaactcgggataggatatcgcaagccagaactagattggcaccaaccagtgcgaccatgagtttggtttgacttagattatctccatagcgcttgcgaacaagattgggaacgataactccgagaaatggtaggccacccacggtaatcatggtgacgcttgtcgttagcgccaccagaaagagggccagtttttcaagtagggagtaggaaatccccaaactctcgctggtttctttccctagattcatgatggtgaaggtttgggataatttccaaacggttatcaggatgatgaggcctaagaagagccactcatactgatgggtctgaatcatggagaaggagccctgggtccaggcagtcatactctgaaccagattgaaacgataggcgataacttctgtgactgagccgataatcccgctatagatgatcccaatcagaggcaacatccacctttcctttacagtaaaaatggtcataaaggctaggaagaagagggtgaatacgatggatgaaacaaaagcgaagagcatcttgtgggtcagactagccgatggaaagacaaaaaggctcagcaccattcccagtttggcggcttcagtcgttccaactgtactcggtgcagcaaactgattttgggtaatagtctgcatgagaaggcctgccatactcatactagaggcagtcaggagaatactgatagttcttgggagacgggactcttgaaagaggagccaggtctgctggtcgaaatcaaatagctttccccatgaaaaatcactggtcccaatgctaatagagagaaagactaggagtagaagtaagccagg

SEQ ID NO: 165 - DNA, 5910 bp; double-stranded, linear
ccgcaattatgcttgaaaaggagtatacttataagtaacgcaaacgtttgcgtctgaaaaatacgcaacgttccattattttaacacacgaggtgctattatgaaaaaacgtcaaagtggtgtgttgatgcacatctcttctcttccaggagcttacggaatcggatcatttggtcaaagtgcttacgacttcgttgatttcttggtccgtacaaaacaacgttactggcaaatccttccattaggagcaactagttacggggattctccttaccaatctttctcagccttcgcaggaaacactcattttatcgatttagatatcttggtggagcaaggtttgttggaagcaagtgaccttgaaggagttgactttggtagcgatgcgtctgaagttgactatgctaaaatctactatgcacgtcgtcctcttttagaaaaagcggtgaaacgtttctttgaagtcggagatgttaaagattttgagaaatttgctcaagacaaccaatcatggcttgagctctttgctgagtatatggctatcaaagagtattttgacaatcttgcttggactgaatggccagatgcagatgctcgtgctcgtaaagcttcagcacttgaaagctatcgtgagcaattggcagacaagttggtttaccaccgtgtgactcaatacttcttcttccaacaatggttgaaattgaaagcttacgctaacgacaaccacatcgaaatcgttggggacatgccaatctacgtagcggaagattcaagtgatatgtgggcaaatccacatctcttcaaaacagatgtcaatggtaaggctacttgtatcgcaggatgcccaccagatgagttttctgtaactggtcagctttggggtaatccaatctatgactgggaagcaatggacaaagacggctacaaatggtggattgaacgcttgcgtgaaagcttcaaaatctacgatatcgttcgtatcgaccacttccgtggcttcgaatcttactgggaaatccctgctggttccgatacagcagcacctggtgagtgggtgaaaggtccaggttacaagctttttgcagccgttaaggaagaacttggtgagctaaacatcatcgcagaagaccttggcttcatgacagatgaagtgatcgaattgcgtgaacgtactggcttcccaggaatgaagattcttcaatttgccttcaacccagaagacgaaagcattgatagcccacacttggcacctgctaactcagttatgtacacaggaacacacgataacaatacggttcttggttggtaccgtaatgagattgatgatgcgactcgtgagtacatggctcgttacacgaaccgtaaagaatacgaaacagtggtacacgctatgcttcgtacagtattttcatcagttagctttatggcaattgcaactatgcaagatttactagaattggatgaggcagctcgtatgaacttcccatctacccttggtggaaactggtcttggcgtatgactgaagatcaattgacaccagctgtcgaggaaggtttgcttgacttgacaacaatttatcgccgaattaatgaaaatttggtagatttaaagaaataagacaataatcaggagacaactaaacatgttatcactacaagaatttgtacaaaatcgttacaataaaaccattgcagaatgtagcaatgaagagctttaccttgctcttcttaactacagcaagcttgcaagcagccaaaaaccagtcaacactggtaagaaaaaagtttactacatctcagctgagttcttgattggtaaactcttgtcaaacaacttgattaaccttggtctttacgacgatgttaaaaaagaacttgcagctgcaggtaaagacttgatcgaagttgaagaagttgaattggaaccatctcttggtaatggtggtttgggacgtttggctgcctgctttatcgactcaattgctactcttggtttgaatggtgacggtgttggtcttaactaccactttggtcttttccaacaagttcttaaaaacaaccaacaagaaacaattccaaatgcatggttgacagagcaaaactggttggttcgctcaagccgtagctaccaagtaccatttgcagactttactttgacatcaactctttacgatattgatgttactggttatgaaacagcgactaaaaaccgcttgcgtttgtttgacttggattcagttgattcttctattattaaagatggtatcaactttgacaagacagatatcgctcgcaacttaactctcttcctttacccagatgatagtgaccgtcaaggtgaattgctccgtatcttccaacaatacttcatggtttcaaacggtgcgcaattgatcatcgacgaagcaatcgaaaaaggaagcaacttgcatgaccttgctgactacgcagttgtccaaatcaacgatactcacccatcaatggtgattcctgaattgattcgtcttttgactgcacgtggtatcgatcttgacgaagcaatctcaattgttcgtagcatgactgcctacactaaccacacaatccttgctgaagcgcttgaaaaatggcctcttgaattcttgcaagaagtggttcctcacttggtaccaatcatcgaagaattggaccgtcgtgtgaaggcagagtacaaagatccagctgttcaaatcatcgatgagagcggacgtgttcacatggctcacatggatatccactacggatacagtgttaacggggttgcagcactccatactgaaatcttgaaaaattctgagttgaaagccttctacgacctttacccagaaaagttcaacaacaaaacaaacggtatcactttccgtcgttggcttatgcatgctaacccaagattgtctcactacttggatgagattcttggagatggttggcaccatgaagcagatgagcttgaaaaacttttgtcttatgaagacaaagcagttgtcaaagaaaaattggaaagcatcaaggctcacaacaaacgtaaattggctcgtcacttgaaagaacaccaaggtgtggaaatcaatccaaattctatctttgatatccaaatcaaacgtcttcacgagtacaaacgccaacaaatgaacgctttgtacgtgatccacaaataccttgacatcaaagctggtaacatccctgctcgtccaatcacaatcttctttggtggtaaagcagctccagcctacacaatcgctcaagacattatccatttaatcctttgcatgtcagaagttattgctaacgatccagcagtagctccacacttgcaagtagttatggttgaaaactacaacgttactgcagcaagtttccttatcccagcatgtgatatctcagaacaaatctcacttgcttctaaagaagcttcaggtactggtaacatgaaattcatgttgaacggagctttgacacttggtactatggacggtgctaacgtggaaatcgctgagttggttggagaagaaaacatctacatcttcggtgaagattcagaaactgttatcgacctttacgcaaaagcagcttacaaatcaagcgaattctacgctcgtgaagctatcaaaccattggttgacttcatcgttagtgatgcagttcttgcagctggaaacaaagagcgcttggaacgtttttacaatgaattgatcaacaaagactggttcatgactcttcttgatttggaagactacatcaaagtcaaagagcaaatgcttgctgactacgaagaccgtgacgcatggttggataaagtcatcgttaacatttctaaagcaggattcttctcatctgaccgtacaatcgctcagtataacgaagacatctggcacttgaactaatactcttcgaaaatctcttcaaaccacgtcagctttatctgcaacctcaaagcagtgctttgagcaactgcggctagcttcctagtttgctctttgattttcattgagtataagatacaaatttatactaatacattttgtaaaaaagcgagtttcgattgaaattcgcttttttaatgatgtagatttgggtcaatcttgtctaaaaatagggaaatcctagatacagtgaaggctttaaatgctggtttttactgtcctcagccttatattttttcgtagttggttacctcatatctattatattcgcttacataaagtattataatataattgtaggaaagaaggtgtttttatgatatacacacttaaattggtgttgtttattacctttcttgtaataagcttgttacctgataagatttttggaaaaaataaaaaaatttggaaaatagtttttgcaatattgacggcagtggcagcattgtcatttatgtactaagttattttaagaatgtagggaaataaaccctacattctttttagttttttctgttttctaaattctatttatccaagcgattcaacatttcttgcttcttcgcttcaagttctgcacgcttttcttcgatttcggcatgttttttctcgagttcagaacaacttgcaccattgctaaattcttttcgccatcaggagatagggtgagtcgacatgtctattactcacccaaagcagtcctacaaagcaggaattttctgttacttttttggaaatagtaacgtttatacagctttgacacttcgtatcaaagcgccaaacacactccgaggggtttacagaaagcagaaaaggaatgatctggtataagatcattccttttcyctctttttctttaagtaattatatacaatgtacgacgaagtcgtcattgcaatgctgatccaccacctaaagggaactttaaacaacattgataagataaagaatataaacaacgaaaatacgttatacccaattaattttattgtatatctcatgattaaaagttaatccttccgttgttaggaatggcatcatttttatcccataattgtgctaaataagtccccggtgataataaattcatagcgaattctaaagcaacatcatttacaaaccaactacctagatatctagaaattgctgaacgaatagcactttttgctgcatgttttccttttactttaattagatttgcaaggcctgcagtagttcctcctaatgctaaagctattgcagtatctaatagagcacccatttgattaactgtaataccttgccaaactgctctaaatggagagtatgtaggtgggattgtataatcgccttgtaattgtcggttaattacttctttgatccattgttgtgagacgtctggatgaaaagattggatttcgtttgcaagtgtattgatttgttcttctgttagagaagtgacaggttgaagttccatatttgtttcaatttgtgatacttgttcagaagcgtatacagctgaaacacttggaatcgctgatacaattaacacaattgacgtcaaaaaaaccgaaataaatttcattaatttgttcatgagcttttctcctttttatttgcatctgcttacattttatcatatactgttattatagtcaaaaaaatatgctattatgttaaaaaaatatttttcaaaatataaatggacggatttattttggattttatttgttattttgacctgcctctatattggtaaccatgatttgtttactctcaatcatcaagaattctcttttcgtggtagcgtttggggtctggtactggccttatatcacttactattcattgataagtttgttatatcgaatcgaaaataaagattagagctatgcttgactgtgtacttttaggatttattttggaggaagattttgtctctattatttattattttaaatttatttattttgtataagatctattcttt

SEQ ID NO: 166 - DNA, 5406 bp; double-stranded, linear
ggcatagcgactcattttttcaactgtccaggctggataccagactaatttaacctcagtatccgttacttctggaacctctatcatagcatcataaatctggtctgtcaaaaggtctgctaagggacaacccatagttgtcaaagtcatgtcaatctctgtttgccctgtgtcaccgtcaaaacgaatctcatagatcaaaccaagattgacaatatcgattcccaactcagggtcgatgacttcttccaaggctgttaaaatccgtgttttgatgttttcaatttgctcttctgtataagccatattttcctcactcttagtcttcaataaaatcacgaagcggtttgctacgacttggttggcgtagttttctcaaagcctttgcttcaatctgacggatacgctcacgagttacgttaaagactttccccacatcttcaagtgtgcgcatttttccatcatctagtccaaaacgtagacgcagaacattttcttcacggtctgtaagagtatctaagatttcatccaattgctcacgcaagacgatacgagtcgtataatccactggattttcaatcacttcatcttcgataaagtctccaaggtggctatcgtcctcttcaccgataggagtttcaagagatactggttcttgggcaatcttcaagatttcacgaaccttatcaggtgtcatatccattcgttcagcaatctgttctggtgtcggatcttgccccaattcttgaaggagattccgctgttcacgaaccaatttattgatagtttcaaccatgtgaactgggatacggatggtacgagcttggtccgcaatagcacgagtgatagcctgacgaatccaccaagttgcataagttgaaaacttgaaccctttagaatagtcaaacttgtcaaccgccttcatcaagcccatatttccttcttgaatcaagtcaaggaactgcataccacgaccgacatagcgtttggcaatggaaacaaccaaacgaagattggcttccgcaagacgttgtttggcttcgatatcaccagcttcaacagccagtgccaactctttctcctcttcattggtcaagagaggaacgacccctatttctttcaagtacatacggacagggtcattgaccttagcagaagttgacccaatcaagtcctcatcgctgagttctggttcttcttcattgctgagaacacgcgcacttggatttccttcgttatctgtgatagaaatgcctgcatcctgaatccgttgcaagagatcttcaatcccatcagcgtccaaggtaaaaggaataaccagacttgcattgatttcatcatctgttgctgtccctttttgcttatgattacggataaattctgctacctgtacgtcaaatgttgttacttctttttgttttgttgccattattactccattcttctcttttgggaaattaaacgttccaattcttctagggctgtatctgtatctcctacatggctagcttcctgcaccttctttttgattctcatattgtcctgattcaagagagccttgtttcgagtcatctctacttcactaagttcctgcggcgatatctcagcaggcaaatcctgagctaaaacttggtaccaagctctttcaacttcctctgtctgctctgctaaaacttctggaggaagatttccatactggccaagcaagtcatataagacctgaaattcaggtgtagcaaatgcaaagtcttctcgcaaacggtaatcgttcaaaacaagaggggattccatcatccgatagagtagatgggcttctgccctcataatagccgataactgcttggtgacaggcatggtgattggcgtcggtctggaaattccttccatgcgattctgcctttgcacctgacgactctcattaacaatctgctcaatctgggtataatcaaaggacgccagactgtcagctaaaatatgaatatagctgttttgagcagcgatggacttttcttgaacaatcaagggagctattttttcaagaaactcaatctgagcctgcagattttcactgttttcaggtttgtactgatgaatgtagaactcaatcggactaatacgagttttcgttaatagataggccaagtcttctggaccatttttttgtagatactcatcaggatccaagttatcaggcatgctgacgatttgcacaggcatatcaccaatttcatccaatgctttcaatgtcgcggcttgcccagccttatctccatcgtaaacaagaaccaatttcttggttaaccttttcagatgctcaacatgctctcgactcaaggctgttcccatcgacgccacagcattttcgattccagcccgataggctgcaataacatccatgaatccttccatcaggtaaatctcactagcttttccagaagatctttttgccctatccatatgatataattcgtaacttttgttaaaaattgcagtcgatcggctgtttttatacttagaagtttgtgaatccgttttttgccagatacgacctgagaaggcaatgacctttccttggtcatttgtcaggggaaacataatgcgattgtgaaaggtgtctacaaattgattggcatccgagagataaaacaggcctgaatccagtaaatcctcttcacgatactgatcagacaaacgttgatagagatagtttcgttctggaggtgctaaaccaatccaaaaatgtttaagcacttcatctgtcaacccccgctgataaaggtaatttctggcctcttcgcccatagtcgttgtcatgagaatagcatggtaaaatttggctgcatcttcgtgcatatcataaagagcttggtgaggtgaggctgacttctgctcactataaagcggtttttcaacctcaattccaacacgctgacctaagatttggactgcttctataaagggaaccccttggtactcctcgatgaacttaaagacatcacctgagcgaccacaaccgaaacagtgataaaactgcttgtcctctacaacattgaaagatggtgttttttcaccatgaaaaggacagagccctagatagttccgtcctgccttttgtaaagaaatcacatctcctatgacttccacaatgttggcattgtttttgatttcttcaatgacttgtttgtcaaccatacacaatacctccatgttatcatagtttactttatatagtatactttatttcagaaaaaaagtaaaccatttcactcattttccctactttattcaaagagttgataataatcagagattttcatttttgctttttcttcttggtttaaatcttggataattcgtccttctttcatgacaatcaagcgattgccgtatttgagagcatcttccatatgatgagtaatcataagggctgttagctgatctttcttaacaaattcatctgtcaattccatcaaagcaacactagtctttggatccagggcagcagtatgctcatctaacaggagtaattcaggtcgcttcaaggttgccatcaagagactcaaagcctgtctttgtccacctgataagaactcaatcggtgtattcaagtgtttctcaagaccatttcctactttttcaatggttgcctgaaattcatccttatagctagtcaagcgtcgtggtaacaatccacgcttttcaccacgaaacttggcgattaaaagattttcagcgaccgtcatacggggagctgtccccatctttggatcttggaagacacgagacaggtacttggcacgcttctcgggtgaaaacttagtgagatcttcacctaaaatacggatagttccactagttagtgataaggtccctgctatagtgttaaagagagttgattttccagcaccatttccgcccaaaatcgtgataaagtcccgttcaaaaatttctaaggaaacatcatttaaaataatcttttcttcatcaaagccatttttaacgattttggttgcattttttaattctacaattgctgtcatttgcttaacttggctcctttcaagattgtttgcttaaatgttggaatcatgaggcagactgctaaaatcaaggcactgtataaacgaaggtaacttgtattaaagccaagtgcgataactgcccacactaaaaattgataagcgatagaacctacaacgatagtaaccaaacgctctgccaagctcaaactcttgaaaataacttctccaataatcaaacttgcaagccccacaacgataaccccgatccctcgagacacatcggcataaccttcttgctgagcaatgagggcacctgcaagggcaatcacaccatttgataagaccaagcccatgagctccatgcgtccagtatgaatcccgaaacttctagccatatcaggattatcccctgtagcaatataggcttgtccgagtttagtgtccaagaaaaagagcatgagagcaataacaatactcacaaagatgagacctgtcaagagttgattcaaatccgaatcaaaaggcaaaacatcctgaatttgcttggttccaagcaggcctaaattcgcacgtcccataatcaagagcatgattgagtgacaagaagtcatcaccaaaatccctgagagcaaggttgggatcttcccttttgtataaagaaggcctgctgccattccagccaaacaacctgctcctacagcaacaagtgtcgctaaaaatgggttcacgcctttggttatcaaagtgacagcaacagctcccccaagagggaaggaaccttctgtcgtcatatctggaaagtttaaaatcctaaatgtcataaagattcccagacctagaatagcccagacaaatccttgagaaataatggaaacaatcatattttatttaatcctttctatattcatctttttaaaaaatgggaagagtctcctcctccctaccttatttattcgatgacttgtcctgcttctttgagaacagactcaggaatagtaatacctagttcttgtgctatttttttattgatgactgacttaccagttgaaaagacattgactggggtatcggctggttttgcacctttcaagacttgcacaatcattttacctgttgccacaccaaggtcatgttggtcaattacaactgatgccaaaccacctacttctaccatagctgtcgcactgggataaattggtttcttagaactttgattgctagagacaaccgttggaaatcctgatgcaatggtgttatcaattggaacccaaatagcatctaccttgctagtcataacagtgacagttgaggcaatttcatttgttgaaggaactgcaaatgtttccactgtcagacctgccttttcagcataagccttaaattc

SEQ ID NO: 167 - DNA, 9711 bp; double-stranded, linear
cagcttgctcttactattatagcagatgttatagctggaattatcttgtatttcgtctgcaaatggctagatggtaagaagtagaccgaatgactagcctataaacacccgttaaatcgctaagatacgtcaaaaaagcccttaactatggcactagttaggggctttggtgttctaatgaaccttatacactaactacattctagcatataagcccagatatttcaagagttttatttattgtttaaagttctgaaaggtctataatgaagttagccatctagtatcaaaaaaccgactagctcttatgaactagtcgatttctcatcaatgcgccaacatttcttgggcgatttcttggccagataggttatctgggtagtaggttggccagttgtccatttcttcaaagagggcttcttggcttgtgcctccaaagaagatatggaaatgttctgccttaactggggcaacattgtggtcactaaactgaacatacttgaattgtccagcgtcagcatctgtggcttcaaagaggaaacgcacgccacgattgcctttcttgtaagtcaaaattttcttaccgacatacttgtaagtgtatttcttgctttgtccaccttgaacaaattccatagtattatcagtaatgttaatcttagtcacatctgtatgatagccttttgtatagtaagccttgtactcagcctgggtcatcttaccagtcaacttagccttgtagtcaaagacttggtcaaacgtgccgtcttcaaggaaaggataaactgattgccagttacctgcatagtcactcaaggtgcggtccttgacagctgcatcctcgaagtaaccattttggactgtcttggtatcctctgccttttcaggttcaattgctgggccttcttggtctgttgtttgtttcaaagccttgaggtttttctccatcacggaaatgtagttttctccagccttggtgtcctcttctgtcagactttctaaaggattgaggacatcagttttgacacctgcttcttttgaaagtgtgttagcaagggcttgtgaggcatttcttcaaaatagatataggcgattttatttttcttgacatactctgtcaattctgccaagcgagcagctgatggctctgcatctggagaaagtcctgagattgcgacttgtttgagtccatagtccaaggcaagatagttaaaggctgcgtgttgagtcacaaagctcttttgttttgcttgagacaaaccttctgcgtaagccttatccaaggcttgcaatttttcgatataggcagctgcattcttctcaaaggtctcttttttatcaggataatctgctgacaagctgtcgcggatgtgctctactagtttaatggcacgaactggtgataaccaaacatgggggtcaaactcatggtgatgaccttcttctccatggtcatggtctccctcttcttcctcgccacctggcaagagcaacatatcgcctgtcgccttgatggttttcacttttttcttatccaaggtatctagcaatttaggtacccatgtttccatgttttcattttcataaacgaaggtatctgcatcttggattttggcaactgccttggcagatggttcgtattcatgaggttctgtcccagcaccgattaggagttctacattagccgtatctcctgcgacttgcttggtaaattcatagacagggtaaaaggttgtcacgatattgagtttaccatctgcctgtttttgattggaacaagccactaaaaacaaggcacatagactggctagtaataagctaatttttttcacgttcgtctcctatttgataaaacgtcttactaaactgattagtataaagacagttacaaaaataatggtaatacttgcacttgcaggtgtttctgcatagtaggaaatgtaaagtcctgctaccattcccaaaaagccaatcgcactggcaagcagcataaccgatttaaagtttttccccagacgcagggcaatactagctggcaagaccataatggtcgataccagaagagctcctgctgcaggaatcataagggcaatagccacccctgtcaccatgttaaaaagaatggacatggtacgaactggcaagccatccacaaaggccgtatcttcgtcaaaagttaagatatacataggacgaagaaagagaaaggtcaaaatcaaaacaaccgccgcaatgacaaagagggaaatgacctgttcttcactgatagtcacgatcgaaccaaagagatattggtccaaactcattgaactcgagcttttacccttgctcatgacaatcagagaaacagccagacctgttgacatgaggatagctgtcccgatttccataaagctcttgtaaaccgtacggagatactccagaaagaccgccgcaatcaagacaatggcaatagtagaaacagttggagaaatccccaaaaccagaccaaaggctacacctgaaagtgagacgtggctaagggtatcactcatcaaactctgacgacgcaagatgaggaaggttcccaataccggtgagaaaagactcatagcaataaccgccaaaaaggcgcgttgtataaagtcgtaagataataaactaagcatggcccacctcctggccattctcatgaacattgaaacaacgccatggcgagtcttggttacggactagatgaatattgcgatccgcataatccttaacttcttcagggtcatgggtaatcatcaaaacagccttgccatgatgatgggcgctgtggtgcatgagttcgtaaaattcatttttacttcctgcatccatccccgttgtcggctcgtctaggataaacacatcagggtcagaagcaaacatacgcgcaattaccgctcgctgcttttgtcccccagatagagaccccaagcgtttgtctcgatgttcccacatgccaactgagtccagactagccttgatatgctcctcatcatgagcattcaaacgacggaaccagccttttctcggatagcgacccgacttgacaaattcatagaccgtacttggaaaaccagcattaaaactggcaatttgttgaggaagataggctattctcaatttcttaccttgcgtatttgtctttgaaatagccacctttccaatgcgtggttgcagaattccaagactagccttgatgagcgtcgtcttagccgctccattttccccagtcaaggtaacaaattccccactatcaacacaataattgatatgttcaagaacaggctccttatcataatagaaggacaaatcctctaccgtaatatatctcattatttgatttctcctactaaagcagtcaaaaaccgctgaatcactttttgttcatttggagtaaactgagtcgccacttgttcataggttaaaagtgtatgctcatggtgatggtggtgctcctcagcgattggacgagccaagtcagtcaactgataaaaaatcacacgcgcatctttagaatctttagatgtttccaacatcccttccttgaccaaagacttaatggccttggtaactgccgcctgactgacattgagacgacgggccaattctgaatttgttaaagattcctctgacaagagcataaggatatgctcctgagtattggtcagggccacctcgctagtgcaatgacctattaggatttcatgctgattttccgcctgcaaaatcacctcattcaaaaaagcattgatatcctttgctagctgtctcatatctgactcctttccttttagacttctcttttttaagagaaaaatactattctttgacattttgtttaccagttaattatatcacaagcaaaaaaagagtcaagaaaaaacgtgaaaactagtttcattcttgaactcttctatattatattatctattgaaattctttgacatctccatcataagtcgcccaatctttgctgaaaaagcgctcattcagatggtaagtcggagctggtgtgggattggataggaaaggatcaactgccttgtcaaaagccaaccaacccaaccaaccaaggtgaatggtgtccttcataaagaaaggctccccgccgtccttagaaaaatctgctatattggtaaaaccttgactttctaactggtagcgaatcttctgcaccgtttgttggtacatatcctctcgtagaccagcatagttcatccattttttattaacaggtggaatgataaaaatcgggtttaccttagatttagaaaactgtgttaaaaccaactgcaagtcattatactctggcgacttgagataggtaaagcttttctgagaatcctttaatttcttcaaatccttcttgatctgctcattatagaaataattttccattcccatctcattattggaagtatttttttcagcatctgctttgacaacatcttctattgcctgataagaaaactggtctggcaagatttttaaatacttagctacatgcttatcgtagttaacatagcctctaaccgaaaactgaccaaaaaaggaagcttggcgttcattaaaacgagccaataattcaatcatttcattgtctgctgtcgacaattcttctttacttgccaacttctgaaccaggtccttcatagctacgtttgggaactgttgcagtaagcgagtcgctgcatattgactagcctgatccccagattgatgtttcagaaaactagtcaactggtctccattaaaatactgctggaaggctgctggatcatagccatttttactgaaccactgaggtgagataacatacacaacttgtttattctccagctgtggtaacatctgttgcattccaaaatattggttaagcgatgcagctcccccctgtcctaaaagataaggacggtaggaacgattgtatttctcagctaataccgcaggatgagcaccgtcaaaacgaagccattcactagagccaaagaagggaacaaaacgcacatttggatcagatagtgctctgactttttgacttcgctccttaaaactatcgatagtagtagccactgctgaacgcttttcagctcctagattatgatgcatctcagtaggataaaagaaaatgagcagaaaaaccaacaaaccagcgatcaagaccggtccgaagatcatccataagcgtttaagcattttgtagctccacaataccagctatgattttattagctgtattccagtcgtcacgaccaaactctgttacagggacacgaatgtcaaaacggttctcaatctccacaatcaactcaaccgttcccatactatccaagacacctgcatcaaaaagatcttcatccatcatgtcagaaacatcttccataaacaactcatcaataatttcaataacttctgatttgatatccatattttatttccttttattttttaaaccatagattattcaagaatccagaaaagattaagaatgacaacatgacaacatggaaagtgacaaccatgccaagcaactgaatccagcgattctcaggtagggcagccttccctgcttttttccgttccttattgagcgtttttttcttgcgaacccaggcatcattgatgaccaagcctagtccatgaaagagtccataggcgatatagtaccaggtcacaccatgccaaaatcccataatcagcatatttacaatgtaggccatgcttgaggttacattacgatttttaaagactttctttctggttaacaccatcaccattcgcataaagacaaagtcacggaaccagaaggacagactcatatgccagcgattccaaaactcctttaaatcccttgataaaaagggcttgttaaagttgatagggctacggattcccatcaagtttgagatggccaaagcaaacatagaataacctgcaaagtcaaagaagagttccagaccaaaagtatacataactgccaaggcatagagattaaagaagccacctgactgcaaggctaaattcttcagaggaggtagtaaggtctctcctaaaacatgagctaggataaacttatacaaaaagccccacatgatatagcggacagattcatccagcatatccatcaactcatctcgctcaggaatagcctgataattttcattaaatcgcttaaagcgatcgattggaccactcgagaaagttggcatgaagagaaggaaacggaggaattcccagagggtaaaatccttaatcactccatctctcagctcgatgacaattccaaccgaacgaaaggtcaggtaagaaattcccaagaacccaagcaaagactgcgttccattgatagctggttgcaccttgacaaagataatcggaagtagggacagaaaactaactaagtagaagacccacttgccatccttgctttttcgataatgcttgtagaaaagcaggagcaatatttcccagcaaaggtaaatacccaaggcagctagttgattggtctttccacccaccaacatggtgacaataaagaagagacttaccaacacttcataccaggcaaagcgtttcttgaaaaagagacctataaagatgggcaaggttgcagcaatcacataaacaaaatactgaggattgccatatggctctaaatgaggaagctgttgaaaaaactccatcatctcttattcacctcgttaatcaatcctttgatgtcaatctttccatttggagttagtggcaaactgtctcggtaaaggaatttagatggcatcatataggacatcatgatgtctgtcaggtcttccttgatggccttggtaatatcgatatctcgctcaaactgctcacgaacaccgtcttttaagatgacataagccaatagattttgtaccttgtggtccttgttatagcgcggtactgcgacagcagattcgataaagcgagacttgttgaggttttgagagacatcttctaactcaatgcggtaaccgttaaacttaatctggaagtccatgcgtccgccgtagagaagcaagccctcatctgtcatggttcccacatcgcctgtgtgataggctggcagatcttcaaactcaaagaaggcttctgctgttttttcaggattgttcatataaccttttgaaacagctggcccagaaacaatgatttctccctgctcaccatttggcagtttatttccttcctcgtcaatgataaaggttggagaatcagccttggtatagccgattggtaggcgtttgagagtcgctaacatctcgtctgtcacggcaactgctgacagagctactgtcgcttctgttgggccgtaagcattgatgatacgggcatttgggaaacgctcgcgcagtttttgagctgttttgaccgtcaattcttcaccatcaaagtagaaatgcgtgattccaggcattttctcactgttgaagtattcagacaacatggccatatctgcaaaggatggtgttgatgtccagatagcgattggcaatgaaaagatagccgcaaagagttgcttaaagtcctgagtgatgactgaaggaagagtgaaaagcgtaccaccaagtgccaaggtcggtgcccaatacatgacagacaagtcaaaagaataaggtggctgtgccagcatttgcggacgactcggtgtcgcaaattccttatccgtaatcatccagtttgtaaagctgaggagattatcatgtgaaatctgcactcccttaggcttaccagtcgtaccagaagtaaagataatgtagtaattatcatctcccttgactggatgcgtgatttcatagttattcccttgggcaaaggcttcttgaacctgagctagatttatcattggtgtagaaacctgctccaagggaaaggctgaaatggcaataatcaagcttggctctgctacttctaaaatagctgaaactcgctccaaggccgaatggctatcaattggaatgtaggcatgacctgacttagtcagcgctacaaaggttgccaacatttcatattcttggccaccaaaaacaaccacaggagacttctcaggcaagcctagttggtcaatgactgcagccaaactatccgaatcagcctttaaatcgccataagtgtgttcctgccccaaaacattatagacaggatagctaggctgtgtctgagcaaaatgctcaatggtttcaatcatatctgctattggtttatttgacacaatagggattctccttcaagttaaaattcattatagataaagcttccttgaccctgaccaagatagctaaagaagtaaagcagccctagaaagataagaaaatacaaggctgtccgaccaagaaagaggtacaattcttttctctgtttcatcaagaaaaaccattcatttctgtaatttttcgctaaaataagagtgattcttactagcttatttttctaccattgtaccactttatatagtatcttttcaattgtttaccgtatgtttccaatagatttcagcttattttaaggattatacagtttttctatgtatattttcaaatagagtgatcctgcttcaaaactccatttcaggagacaatgaagtaaatcttcccataataaaacacacaatatcaagttttttcaacacctgatactatgcgcttttctgatttttaaagactttttaaccactctctcatttaaaataatctcgtctgatataaattaaaatagcttctatcatcagacaaatggctgatagccaaaaactgatgctaataccaaaactctcagtaatatagctcattagcaaaacaaatactgaaaatgctaatgtagaaatcacttcaagaacggaatagacattaactaaatgattttcctctactgtttcctgaagaaatacactttcaggaacttcttttagttgcgataacataccaactaaagctgaaaataataaaaacatctgtgcgtttggaaaatatagaatagtcagtgtcactatttccatagctacaagaggaaaaagaatactttccccccaaatcattcatacctctctcaactagatgtaacttacaaaacccctgacctcatgagccactttcttcctcctcatgaggtcagttttactttctgctgttccagtatcgtttttcctcgctagatttcctcaaaagggcagactcctcccttggtgcgtcacacgattttttcatctcgactgttctttaatgcatcattaacgacgcttttcttctaggtggttcataaggaacaggaagattcaggttgacttttctaatcctagaataaagtgctgaaaacaattcggaataggcatagagactagacaatttgaggagctgcttgcgtcctgttcgaacacattttcccaccacgtgaagaaaaagatggcggaagcgtttgattgttaaagtttggaagtcacctccagctagatgtttgagaaaaagatagagattgtaggcgatacagctcatcatcatacgaacttcgtttttgattaaggttgaactatccgttttatcgccaaaaaatccctccttcatctccttgatgaaattctcggcttgaccacgtccacgataaagctgaaactggtcttggctgttccactcgtcatatttgtaacgagagaaataacatcgtagaacaagtatccttcttttc

SEQ ID NO: 168 - DNA, 3025 bp; double-stranded, linear
cccctttgtcaaaactgtaaaattaacgactcaacaattcatctttacaccaatctcaatggaaaacaaaaacaaattgacctctgtcaaaactgctataagattatcaaaacagatcctaacaatagcctcttcaaaggtatgacggatctgaacaatcgtgacttcgatccctttggtgatttcttcaatgatctaaacaatttcagaccttctagcaatactcctcctattcccccaacccaatcaggtggaggttacggtggaaacggcggttatggttcccaaaatcgtggatctgctcaaactccgccacctagccaagaaaaaggcctgctggaagaatttggtattaatgtaactgaaattgcccgtcgtggagacattgaccccgttattgggcgcgacgatgagattatccgtgtcatcgagattctcaatcgtagaaccaagaataatcctgtccttatcggtgaacctggtgtcggaaaaacggccgttgtcgaaggtctagctcagaaaattgtcgatggcgatgtgccacataaactccaaggtaaacaagtcatccgtctggatgtggttagcttagttcaaggaacggggattcgaggacaatttgaagaacgcatgcaaaaactcatggaagaaattcgcaaacgtgaagacatcatcctctttatcgatgaaatccatgaaattgttggtgctggttctgcgagtgatggtaatatggacgcaggaaatatcctcaagccagcccttgctcgtggagaactgcaactagtcggtgctactaccctcaatgaataccgtatcattgaaaaggatgctgccctcgagcgtcgtatgcagcctgttaaagtcgatgaaccaacggtggacgaaacaatcactattctcaaagggattcaaaagaaatacgaagattaccaccacgttcaatatacagatgctgcgattgaagcagctgcaactctttccaatcgctacatccaagatcgcttcttgcctgacaaggccattgacctcctagatgaagctggttctaagatgaacttgaccttgaattttgtggatcctaaagtaattgatcagcgcttgattgaggctgaaaatctcaagtctcaagctacacgagaagaagattttgagaaggcggcctacttccgcgaccagattgccaagtataaggaaatgcaaaagaaaaagatcacagaccaggatactcctagcatcagcgagaaaactattgagcacattatcgagcagaaaaccaatatccctgttggtgatttgaaagagaaagaacaatctcaactcatccatctagccgaagatctcaagtctcatgttattggtcaagatgatgcagtcgataagattgccaaggctattcgccgtaatcgtgtcggacttggtacccctaaccgcccaatcggaagcttcctcttcgttgggccaactggtgtcggtaagacagaactttccaaacaactggctatcgaactttttggttctgctgatagtatgattcgctttgatatgagtgaatacatggaaaaacatagtgtggctaagttggtcggcgctcctccaggttatgttggctatgatgaggctggtcaattaactgaaaaagttcgccacaatccatattctctcatccttctcgatgaagtggaaaaagctcacccagatgttatgcacatgtttcttcaagtcttggacgatggtcgtttgacagacgggcaaggacgcaccgttagcttcaaggatgccatcattatcatgacctcaaatgcaggtacaggaaagaccgaagctagcgttggatttggtgctgctagagaaggacgtaccaattctgtcctcggtgaactcggtaacttctttagcccagagtttatgaaccgttttgatggcattatcgaatttaaggctctcagcaaggataacctccttcagattgtcgagctcatgctagcagatgttaacaagcgcctctctagcaacaacattcgtttggatgtaactgataaggtcaaggaaaagttggttgacctaggttatgatccaaaaatgggagcacgcccacttcgtcggactattcaagactatattgaggacacaatcactgactactaccttgaaaatccaagcgaaaaagatctcaaagcagttatgactagcaagggaaacattcagattaaatctgccaaaaaagctgaagttaaaagttctgaaaaagaaaaataaatcctataaaaaaggagtagaaaatgaaatttttctgcttctttttttactaaaataactgtaatttcttgacagcttgccctttgtccattatgatatatagtagactgaatctgaaatagtacgaaacaattgctaaaacatttatagaaattaattttactttcccaatcgatttgttctcatcttatttcaatctgctatagtcaattgaaacaagaacaagacaaaagagcctcataaaaggtattgcaacttggtaatacctttttgaggtgctttttgatatgagcccatgttttctcaataggattgtactcaggtgagtagggaggaagaggtaaaagtttatacccaaactcttcacacaagagttctaacttacccattctatggaatcttgcattatccataataataaccgatggtgtggttaatgttggtaagagaaacttctgaaaccaagcttcaaaaaagtcgctcgtcatcgtctcttcgtaagtcattggagcgattaactcaccattcatttgttagacctgcaaccaaagaaattctctgatatcttcttccagatactttgcctcttcttaactgaccttttaatgagcgaccatattctcgataaaaataagtatcgaatcctgtttcgtcaatctaaacaggtgctaggtgctttaaactattaaaattcttaagaaataaggctactttttctgggtcttgttcatagtaggtgtagttcttttttttttcgagtgtagcc

SEQ ID NO: 169 - DNA, 4104 bp; double-stranded, linear
tttaaggttttaaaaaaagttttcgaaaggtttcttctttattttttaagggagagataacgttgatatctaaatcgtggtcaaagccggcaatttttcctttagatgtgtattggtgaatatcataatctaaatcagttttaggactgctctccaaaaatcctgagtctgagccgtagacggaatccaaacagaggtaaacttgcctgtatcaatactgtgttcttccatgaagtagacaccaacgtagatgccgatgtttttagcacccagtgatgctagttttgctcgaaagttttcgacaccttcgttcatattagacatggttttgtcttccacgtcaagccaatagtaactagggctgtaaggagaggcagcattgtagaaaacttcggcagccttttccatttcttggacactttttccagctacataagcgtagacagcaactgggacattccgcttttgaagttcagtgatatgactcttataggccttgtctattccattgataaatgaagcatcattttcttttgtcgtttgagcaccactgtgaacacgaacaatagcacctgaaatattttgtgagagggcatcgtagttgatttcctcaggacgctgccagccagagaggtcaataatcggtttgtctaagtgtttcaaagcctgtgcttcaatctgtgctatattggattttgttttaaacgattggctgtcattaagtgggcgattgatgattaaaatgaacatcataatcccaaaaaaactaaataaaataagtggatgaatttgttttctcatatcttataattctaccctaaaaatcaaaaaaaatcaaaaaaatgggttaaggaagagactttagagcattttttcattcaagagtgcggaatgatttgaaatatggtataataaaagggaatttctacagaaaagagaagattatgtcaaattttgccattattttagcagcgggtaaagggactcgcatgaaatctgatttgccaaaagttttgcacaaggttgcgggtatttctatgttggaacatgttttccgtagtgtgggagctatccaacctgaaaagacagtaacagttgtaggacacaaggcagaattggttgaggaggtcttggctggacagacagaatttgtgactcaatctgaacagttgggaactggtcatgcagttatgatgacagagcctatcttagaaggtttgtcaggacacaccttggtcattgcaggagatactcctttaatcactggtgaaagcttgaaaaacttgattgatttccatatcaatcataaaaatgtggccactatcttgactgctgaaacggataatccttttggttatggacgaattgttcgtaatgacaatgctgaggttcttcgtattgttgagcagaaggatgctacagattttgaaaagcaaatcaaggaaatcaacactggaacatacgtctttgacaacgagcgtttgtttgaggctttgaaaaatatcaataccaataacgctcaaggcgaatactatattacagacgtcattggtattttccgtgaaactggtgaaaaagttggcgcttatactttgaaagattttgatgaaagtcttggggtaaatgaccgtgtggcgcttgcgacagctgagtcagttatgcgtcgtcgcatcaatcataaacacatggtcaacggtgttagctttgtcaatccagaagcaacttatatcgatattgatgttgagattgcttcggaagttcaaatcgaagccaatgttaccttgaaagggcaaacgaaaattggtgctgagactgttttgacaaacggtacttatgtagtggacagcactatcggagcaggagcggtcattaccaattctatgattgaggaaagtagtgttgcagacggtgtgatagtcggtccttatgctcacattcgtccaaattcaagtctgggtgcccaagttcatattggtaactttgttgaggtgaaaggatcttcaatcggtgagaataccaaggctggtcatttgacttatatcggaaactgtgaagtgggaagcaacgttaatttcggtgctggaactattacagtcaactatgacggcaaaaacaaatacaagacagtcattggaaacaatgtctttgttggttcaaattcaaccattattgcaccagtagaacttggtgacaattccctcgttggtgctggttcaactattactaaagacgtgccagcagatgctattgctattggtcgcggtcgtcagatcaataaagacgaatatgcaacacgtcttcctcatcatcctaagaaccagtaggagcctatcatggagtttgaagaaaaaacgcttagccgaaaagaaatctatcaaggaccaatatttaaactggtccaagatcaggttgaattaccagaaggcaagggaactgcccaacgggatttgattttccacaatggggctgtctgtgttttagcagtaacggatgaacaaaaacttatcttggtcaagcagtaccgcaaagctatcgaggctgtctcttacgaaattccagccggaaaattggaagtaggagaaaacacagcccctgtggcagctgcccttcgtgaattagaggaagaaacagcctatacagggaaattagaactcttgtacgatttttattcagctattggcttttgtaatgagaagttaaaactatatttagcaagcgatttgacaaaagtggaaaatccgcgtccgcaggatgaggatgaaaccttggaagtccttgaagtgagcttagaagaagcgaaagaattaatccaatcaggtcatatctgtgatgccaagacaattatggctgttcagtattgggagttgcagaaaaaatagaggaggtcagtatgggtaaatctttattaacggatgaaatgattgaaagagctaatagaggcgaaaaaatttcaggtcctcctttgctagatgataatgaggaaactaagattttaccaacctcttcttcccgttttggttatgccaatcctaaggatcatggttttagccaggaaaccttgaagattcaggtcgaaccatctattcataaaagccgtcgtattgaaaataccaagagaaatgtcttcaattctaagttgaataaaatcttatttgcggtcatctttctcttgattttgcttgttttagcaatgaaacttttgtaatagaaaaggaattgaaatgaaaataggaattattgctgctatgccagaagaactggcttatctggtccagcatttagataatgcccaggagcaagttgtttttgggaatacctatcatacaggaaccattgcttctcatgaagtcgttcttgtagaaagtggaattggtaaggtcatgtctgctatgagtgtggcgattttggctgatcatttccaggtggatgcccttattaatacgggttcagctggggcagtagcagaaggtatcgctgttggggatgtcgtgattgctgacaaattagcctatcatgacgtggatgtcacagcttttggctatgcttatggacaaatggcgcaacaaccgctttatttcgaatcagacaaaacctttgttgctcaaatccaaaagagtttatctcaattggaccaaaactggcatcttggtttgattgctacaggagatagttttgttgcaggaaatgacaagatagaagcgattaagtcccatttcccagaagttttagccgtggagatggagggggcagctattgctcaagcagcgcatgccctcaatctcccagtcttagtcatccgagctatgagtgacaatgccaaccatgaagcaaacatcttttttgatgagtttattatcgaagctggacgtcgctctgcccaagtcttgttgacctttttgaaggctttagattaagcggaaatttgacagtttttctagcttatgataagatttaagtaaagaaaagctagaaaacgtttcagaggatattatgagtattgaaatgaccgtcagtgagattgcagaggtcttaggattatctcgccaagcaatcaataaccgtgtcaaagaattaccagaagaagacacagataaaaatgacaag

SEQ ID NO: 170 - DNA, 8876 bp; double-stranded, linear
cacggataggctcggctttcatcagtcctcaggctgatttactaatagcaactttcctcgacaaagtccacagcgatacgtntgggtatcaatcctacgcttacgctgatacctttgctggcaggattggcaacgatagagcttgattggcttggagttactattgggcaaggatggtacaaaccgtaatccatccactgctttcaacagttccttaaaatcccgatccttgtgttgatagcctttcccttgaaaatagaggtgataatgacagagttcatgtcggacaattttcctaaaaacgtccaaccccagttcctgataaaccttgggattaaaatccaaatgcccatctttggggaaaaatcgcccacctgtcgaacgtagacgcctattccactggacatgatggataaaaggtctgccgaagtcttctagtgaaacctgcttgacgtaatcagtcagtttcatttggagctaggagagacagattaactttttcacgttcagtatcaattttcttaacccaaacgctcaccaaatctccaactgccaccacttgactagggtgtttgataaacttgcgactcatatgggaaatatggatgagaccgtcctcatgaattccgatatcaacaaaagcaccgaaatcaacaacgttacgcaccactccttctagcttttgtccaaccactaagtccttgatatctaggacatcttggcgaacacaggtgcgtcaaaggaatcacggaaatctcgacctggtttgagaagatctgcaatgatatctttaagagtttctggaccaaggtctaactcttgcgccatttccttgactgaaagcgacttgagtttgctttgggcttcttcgtttaggtctttaatatctaaacgtttgaagagttccttaactgcagtgtaattctctgggtgaactcctgtattatcaaggatattgctactttcagggatacgaaggaaaccagcagcctgctcaaaggccttggctcccagacgaggaactttcttgatttgggcgcgtgaagtgatttttccttcttcctcgcggtatttgacaatattttcagagatagttttgttgagtccagctacgtgtgaaagaagagctgggctagctgtattgacattgacaccaacttggttaaccactgtatcgacaacaaagtccagactctcagatagtttcttctgactgacatcgtgttggtattgaccgacaccaattgacttaggatcgattttgaccaattccgcaagaggatcttgcaaacgacgggcgatagaaatggcagagcgtttttcaacggtcaagtctggaaactcctgacgagcaagttcgctggcagaatagacagaagcaccactttcattaacgataacatagctgacttcagggaaatctttcagaacttccgctacaaaagcttcactttcacgactggccgttccatttccaatggcaataatctctacaccgtattgaccaattaaatctgctaaatctttcttggcttcttcgatttgacgagctgatgctggtttaacaggataaataacctgagttgtcagcatttttcctgttgcatccacgacagctagcttggcacctgtacgaaaggctgggtcaaatccaagaaccacgcgccctttcagtggagcaaccaagaggagattgcgcagattgtcagaaaaaagttggatagctccttcttcagctttctcagttaattctgtccgaatacgacgctcgatagcaggcaagacctttttcttaacggattgctgaacaacttcatcaatataagcatttttcaccttgaaacgagtagcaaagaaggcaagaatacggtccgtcgcatgttcaaaaccgatcttcaagacaccaagtttctccccacgattgagagccaaggtacgatagccttgcatagttccaactgtctctgaaaaatcataataaatctgaaaaacctgcttttcatcaagactttcatccttggcttgagaagtaagtttagagtgtctcagcacttcctgataagtcatagaacgcaaggtcacatcttccgataaggcttcgaccaaaatatcaactgcaccggtcaaggcttccttgccagtcgcaaatccttcacagacgaacttttcagcttctttctctaagtcaactatattctgcaaaatcaagcgagcaagaggaaagagtccagcttcacgggcaatggttgccttggtacgacgcttttccttataaggaagatagagttcttcaacgtctgctaatttttcggcaactaagatagcttcttccaattccttggtcaacttaccttgttcttgaatcttagctaagacagcttccttacggtcattgagatttgtcagacttttatccaaatcaataatagccttaatcgccacctcatccagactaccagtcatgtccttgcgataacgcgcgataaagggaatagtcgccccttcagctgtcaaacttagaacggtatcaatttgctttaacgtcactcccaaatcctgagagattttttcatattttttatccataaatctattataccacaagctaaacgtttcaaattaactcgtagaacatttaaaaaatatgtaggaaatagatttatatgctacagcgcaataacttgcacttaaagagcattgccacctttttttaaccaagccatgatatcaaaagtatttaatggatcagacataatagccagttctggaagatgttcctgacctggaataacacattgacttttcaaatttttatatggacgattgactaaaattaatttattagaataaggaagattatccatcttatttaaaatttcttcactagctgaatctttattatcaaatttaaaataaagattattccaatttatgcgtttttttcttttttcccacttagttcgtgcttcttcaatactagaataatgtagaaaatgaatatctatatctcctaagtgccccaaaggataaacttcatgagtccagctcggtgaaataagttcctcttcgaaaacaagttcttgttccatataataacgaaaatgctttgtaagtttataataatcatcaggaagaataaataaaccaacaaaaggtgttctatattgaaaaccaagctgtttataaattaatcctccaacacaattattacttataatcgtaaaatctaatctatcaagctcaagaaaagggaaaattcctttctctgcagctattaacttatgataaacaatatcagaatctaaatattcaccgtcattttttaaccaagcactaaaatttgccaattcttgaatatattgttttttcgctctttctatatcatagttttctaagacggcgcaatctttgattctattttcataattttctaatatgattttgtaggagtcttttagaggtttagcatctataacaggtttatagatatatgtcgggaaattaatataggttgcagttttagagtgaatataaagtctccaaataaggttgtttatatcaaattgatttatttttcgtaaaagcttactattgaataattttccaaataatgagcgatattgttttctaattcgatgatctgtatcatccatcttttgtaaaacttgaacattcgttaaattttctgtcaaccaattatccccccaaaaaggataaaagtaaaatactccatcaaccaaatcagcaaaatgaccaagaacaacatcagaatcggataattttatcgcatgatacatcttttcaaatgtccaatcaaataatgaatcatttgaagatagaaacgtaatataatctcctgtaatcatatcagacaactcagcaaaagaattctcatctataatcttaatattaaatgatagattcatctgttggctaatggaagctatctcctctgtagattgatttacaataataacttctatatcttttaatgtttgtctctccactattgacaaagactctaataaactatttttatctccttgatgtaacaaaacaacactaattgagtaagtcagtttgactacctcccataattttctgataatgattttctttttatttaattatagcacaattatgatatatatcaggtaatatcaagctatattatctcttagctactcaatttgaaattttaacttttcccttttccgcaaaataatagtataatagaggtagaatctagaatcgaggtacacctatggctgtcaaatttacaaaacgagacgacttggacaagatgtttgaagagtttgctaaactccctgatttgaaacaagttactttccctgatgacaaagagaaaaaagtcaaagcagaaaagaaaaactagatgactgcttttcaacaactcccatctagtgtacttcaaactggagccatttttctctccattatcattgaagcccttcccttcgttctgataggaagcattgtctcagggctgattgaagtttatatcacacctgacaaggtttatcattttctccctcgaaatcgttgggggagaatcttttttgggacctttgtcggtatacttttcccttcttgtgaatgtggaatcgtccccatcatcaatcgttttctggaaaaaaaggttccaagttacacggccgttccttttcttgtgacagcacctgttatcaatcccattgttctttttgcgacctattctgcctttggcaactccttccatgtcgccctattacgagctctgggttccattcttgtggctgtaatactaggaatttttctaggatttttctggcaagaaccgattcagaaagaaaatcgtctggcttgtcatgagcatgatttttcttacttgagttctgcaaaaaaagtttttcaagtctttgtgcaggccattgatgaattttttgatacggggcgttatttggtatttggctgcctctttgcttctataatacaggtctacgttccgactcggattctgacctctatcagtgcgacccctctttttgccatcctgctcttgatgattttagcctttcttctttcgctctgtagtgaggcggatgcctttataggtgcttctcttctctcgagtttcggtttggcaccagttctggcctttctcgtcattggtccaatgctggatatcaaaaatattctcatgatgaaaaattacttgaaagcacgatttatcagtcacttcataacaattgtaactcttgtcgtcttagtctattctctcttgattggagttatcctatgattcgatttttagttttagctggctattttgaactgactatttacctccatctgtcgggcaaactaaaccagtacatcaacatgcactattcctatctggcctatatctccatggtgctttcttttatcttggctatcgttcaattgtatatctggatgaagcaagtcaaaacccacagtcatctgaacagccgattagccaagataacgagtatttctcttctggctattccacttgtcatcggcttaactttcccaactgttagcttggattctcagactgtttctgctaaaggttatcatttccccctatcggaaggaacggatctagccattcagacaagcgaagggacgacaagccaatatttgaaaccagataccagttcttatttttcaaaatcagcctatgaaaaggaaatgcgaacggcggcggataaatacttatcccaagatagtattcagatcactaatgaaaactatatggaagtcatggaggctatctacgactatccagatgagtttgagggcaagacaatccagtttacaggctttgtctataacgaccccagtcatgccaatagtcaatttctgttccgattcggcattatccactgtatcgcagattctggtgtctatggattgctgaccaagggcaatacccggcagtatgaaaacaacacttggataacagccaaaggaaaactggtcaatcactaccataaagaactcaaacaaaaccttccaaccttggaaatcgacagctttaccaaagtcgataaaccagaaaatccctatgtatatagagctttttaagaaaatcaagataaaaacgaacaagttctcttctgaataacagaaaaagagcctgttcgttttttgttatatgaaaattagtgacttgtagattttcatcttataccattcccagcaatacaagtagctcatagaaaataagcgagccactcattcattagactagcgatttctttaggtgcttgagtataaagctcatggccaaagttttctaaaaaaatagtatcaaaatagtctggcaattcttttagggcttcctctctccatgtagcttcattaggatagcgaggactaataaacaaggtatctcccacttctctcttaaaagcttgtatttttctccgtagcggagtatcgcttctatattttcataatttatagccaactcatatctattatactcaacattccagtgataagactgtcttacagctttctccatattttctgaccaatgctttgcttcagatttttctttagaagtaagaacatctaagtccgaaacaatttgagatttgatataatttttagtttcctctaactctgtatccaaaggtaaaatcttatctaaatctagatagccaccatccaaaagaatcagtttctttacttcttcaaattccgatgcgaaataacgagctaaatctcctccaagagaatggcctatcagacagatagattcttcctctacaatttcatttttaaaccatgatttcaattctgtttcatctcgaagatgcttttcatatggatttagaaaatagacctgcgaatctagttcttgaagaaaatccttgctatgataggcattgcttcccaaaccgccaataaaatattttttcattctctacttaatactatgcttattcatcttttgttcaaagatagttgtgataatctgacgcaattcttcgcgttttttttctggaatctcaccacttgtttgagctacagcgtagagttcagggtattcaattgaaatgcgtttaatcgtacgtgttgtagcatgttttctgacaaaaaacgggattcgcttaatcaagtcttgtgggactagcgccagaatcttctcagtagtttctttgtcactaatattagacattgtaagccttttcttaatcatttcctgttctttttctgtaaaatcttttaattccattcgattagtcctcctattttctctaagttaaattatgtactaatacagatgaaactacaaagaataaactttaagaaatcttctcactgataagattttagcattagacttcctgcgaaacaaaatatggtatagtagttctatgaattatgaagcaagtaaacaactaactgatgcacgatttaaacgtcttgttggtgttcagcgcacgacttttgaagagatattagctgtattaaaaacagcttatcaacttaaacacgcaaaaggtggacgaaaacctaaattaagcctagaagaccttcttatggccactcttcaatatgtgcgagaataccgcacttatgaagaaattgcggctgattttggtattcacgaaagcaacttaatccgtcggagccaatgggtttaagtaactcttgttcaaagtggtgttacgatttcaagaactcctctcagttctgaggacacggtaatgattgatagccattcccatcaatatcgtatctttggacatagccaataaatgtttcatttttgcgtggtttctggctattaacgattgaaataacccaccaacttatcaaaaatagaaataaaaatcctaagattactgtcatatcataacactattaaagtttaacccacttatcattatccatgataaaaggcttagccagtccctcgcctgtataatccgcatacttggtgcccaaatacttgtagcaatcttccttactagcaaatttaatcgcttggtagggctcttcgaaagtcaatttctctacaaataagaaaccgtcatcagcaggtactaagaccccaacgtggcctacaaacagatactcgccatccaaattgtcgtgcaagactacagacagcattcgagctttttcattgaattgaaattgtgagaagaatgcttccatcttttcagcgtgaaccttgacatctgtagttgactcagttggaactctcgaaaatagaatatcaaactcttccttatcttgtgaatcaaagacctttcctttatcaatcgcatcattatctaggaaaagcaactggtcattcttttcaagctttggaatggtgactgaatttttcaaaagacaataactattgatacggcagttggtcccaacaaaatcgcccttcttttgattccagagatgactgattttctcaacatcgtattcggtgtgagtaaaggaagtgaaatctcctgataagccagttgagccgacaatggtattatagtcattaacgagattaaaaaatgcatcaacactatttggatccaagtgagctgataagagagatttgacctcttctgtacttacctggttgtttaggttggtgtatgaagctttccatggaactttcgctgaactgctttgcctttgattcgtcccctcagaagtagcatgttgttgttgacaagcagccaagcctaaaaacaaggctgaacagattcctaatgtggctaattttcttgatttcttcatttctttctcctaaatgtcttggattaaagtttctttaactattgctttacagatattgattactttctcatttaatgtgttcatcgtctttcctccgg

SEQ ID NO: 171 - DNA, 14736 bp; double-stranded, linear
cgcaaactttcgcggtcggaaggtagttttatgacacgatttgagatacgagatgatttctatctcgatggaaaatcatttaagattttatctggtgccattcattattttagggttcctccagaggattggtatcattcgctctataacttgaaggctcttggttttaatacggtagagacttatgttgcttggaatttacacgagccttgtgaaggtgagtttcattttgaaggtgatctggatttagagaaatttctccaaatagcgcaggatttgggtctctacgcaattgtgcgtccgtctccatttatctgtgcggaatgggaattcggtggcttaccagcttggctcttgaccaagaacatgcgaattcgctcatccgacccagcatatatcgaggcagttggtcgctactatgatcagttattgccaagactggtgcctcgtttgttggacaatggtggcaatattctcatgatgcaggttgaaaatgagtatggttcttacggagaagataaggcttacctgagagcgattcgacagctaatggaagagtgtggcgtaacctgtcccctctttacatcagatggtccatggcgagctactctgaaagctggaaccttaattgaagaggacctctttgtaacaggaaactttggttctaaggcaccttacaacttttcgcagatgcaggaattctttgatgaacatggtaagaaatggccactcatgtgtatggagttctgggatggttggttcaatcgctggaaagaaccgattatcacacgggatcctaaggaattggcagatgcagttcgagaggttttggaacaaggctctatcaatctttacatgttccacggtggtacaaactttggtttcatgaatggttgctcagctcgaggaactttggacctgccacaagttacgtcttatgattacgatgcccttctggatgaagaaggaaatccaactgctaaatatcttgcagtcaagaagatgatggcaacacatttttcagagtatccgcagttggaaccactctacaaagagagtatggagttggatgctattccactagttgaaaaagtttctttgtttgaaaccttagatagcttgtcaagtcctgtagaaagtctctatcctcaaaagatggaggagctgggacaaagttatggctacctactttatcgaacagaaacaaactgggatgcagaagaagaaagacttcgtatcattgatggtcgagatagggcccagctgtatgtcgatggtcagtgggttaaaactcaatatcagacagagattggggaagatattttttatcaaggtaaaaagaaagggctatctaggttagatatcttgatagaaaatatggggcgtgtcaactatgggcataagttcttagcggatacgcaacgtaagggaattcggacaggggtctgtaaggatctgcatttcttactaaactggaaacactatccactcccactagacaatcctgagaaaattgatttttcaaaaggatggactcaaggacaaccagccttttacgcttatgactttacagtcgaagagccaaaagatacttacctagacttgtctgagtttggtaagggggttgcctttgtcaatgggcagaatctaggacgtttttggaacgttggcccaactctctcactttatatccctcatagctatctcaaggaaggtgccaaccgcatcattatctttgaaacagaaggtcaatataaagaagagattcatttaactcgtaaacctacactaaaacatataaagggggaaaacttatgacaattgtaggatgccgtattgatggacgtttgatccacggacaagtagccaatctttgggctggaaaactaaatgtttcacgcattatggttgtagacgacgaagttgtcaacaacgatattgaaaagagtggtttgaaacttgcgacaccaccaggtgtgaaattgagtattttgccagttgagaaagctgcagccaatattcttggtggcaaatacgatagccaacgtctctttatcgtggctcgtaaaccagaccgcttccttggtttggtagaagcaggtgtaccacttgaaacccttaatgttgggaatatgtctcaaacaccagaaactcgttctattacacgttctatcaacgtagtagacaaggatgtggaagacttccacaaactggcagaaaaaggtgttaaacttactgctcagatggttccaaatgatccaatttcagactttttgagcttattaaaataggaaaaaaatttttaggaggtcattgttatgatacaatggtggcaaattttacttctcactttgtactcagcttatcaaatctgtgatgagttgacgatcgtttcatctgcaggttcccctgtatttgctggtttcattactggtttaatcatgggagatgtgactactggtttacttatcggtggtaacttgcaactgttcgttcttggggttggtaccttcggtggtgcttctcgtatcgacgcaacttctggtgcggttcttgcgacaccttctctgtttcacaaggaattgatgcaccgcttgccattactacaatcgctgtaccagtagcagctctcttgacttacttcgacgttcttggtcgtatgactactaccttcttcgctcaccgtgtggatgctgcaatcgaacgctttgactataaaggtattgaacgcaactacttgcttggtgcgattccgtgggctctatctcgtgcccttccagtcttctttgcccttgcttttggtggtgcctttgtacaatcagtagtagacttcgttgaagcctacaaatgggttgcagatggcttgacacttgcaggacgtatgcttccaggtcttggatttgcaatcttgcttcgttaccttccagttaaacgtaaccttcactaccttgctatgggatttggtttgacagctatgttgactgttctttactcatatgtaacaggtcttggtggcgctgttgctggtatcgtaggtactcttcctgctgaagttgctgaaaaaattggtttcgtgaacaacttcaaaggtttgtctatgattggtatttctatcgtaggtattttccttgcagtgcttcacttcaaaaatagccaaaaagtagctgtagcagcaccttctacaccatcagaaagtggggaaatcgaagatgacgaattctaattacaaacttacaaaagaagattttaatcaaatcaacaaacgtagcttgtttactttccaattaggttggaactacgaacgtatgcaagcttctggttacctttacatgatcttgcctcagttgcgtaaaatgtatggtgatggaactcctgaattgaaagaaatgatgaaagttcatactcaattcttcaatacttcaccattcttccataccattatcgctggttttgaccttgccatggaagaaaaagatggtgtaggttcaaaagacgccgttaacggtatcaagacaggtttgatgggaccattcgctcctcttggggatacaatctttggttcacttgtacctgctatcatggggtcagtcgcagcaactatggctatcgctggccaaccttgggggatcttcctttggattgcagttgcagtagcgtatgacatcttccgttggaaacagttggaatttgcttacaaagaaggggttaaccttatcaacaacatgcaaagtaccttgacagctttgattgacgctgcatctgtacttggtgtcttcatgatgggtgctcttgtagcaacagtgattaactttgaaatttcttacaagttgccaatcggtgaaaagatgattgatttccaagacatcttgaaccaaatcttcccacgtttgcttccagcaatctttactgcctttatcttctggttgcttggtaagaaaggtatgaactctactaaagctatcggtattattatcgtacttgctttggctctttctgcccttggtcactttgcacttggaatgtaattccttatgactaaatcattaattttggtgagccatggtcgcttctgtgaggagcttagaggtagcacagaaatgattatgggcccacaagacaacatttacacagtagctcttcttccagaagatggcccagaagaatttactgctaaatttgaagctgttattgaaggattggatgatttcctagtctttgcggatcttctcggtgggacaccttgtaatgtggtgagtcgcttgatcatggaaggtcgtgatattgacctttacgcagggatgaatcttccaatggtgattgaatttatcaatgcgagccttacaggcgcagatgcggactacaagagccgtgctgcagaaagcattgtgaaagttaatgacctgttagcgggcttcgatgatgacgaagatgaataatactcttcgaaaatctcttcaaactacgtcaacgtcgccttgccgtaggtatatgttactgacttcgtcagtcttatccggcaacctcaaaacggtgttttgagctgacttcgtcagtcttatccggcaacctcaaagcagtgctttgagcagcctgcggctagtttcctacagattttagttggaactcgattcaattcatgtgacaacgtgaaaatcgttagagcattttatatagaatatacatgggaatgtagcttactcccattcccatatttaatagaaaaagaggaactcaatgctacattatacaaaagaagacttgctcgaattgggtgcagaaatcactacgcgtgaaatctaccaacagcctgatgtatggagagaagcttttgaattttatcaagcaaaacgtgaagaaattgcagccttcctacaagaaatcgctgataaacatgactatattaaggttatcttgacaggtgctgggacttctgcttatgtgggagataccttgctaccttattttaaggaagtctatgacgaacgcaaatggaatttcaatgctattgcgacaacagatatcgttgccaatccagcaacctatttgaaaaaagatgtggcaactgtccttgtgtcttttgctcgtagtgggaattcgcctgaaagtttggcgactgttgatttggccaaatccttggtggatgagctttatcaagtgacgattacttgtgcagcagatggtaaattggctcttcaagctcacggtgatgatcgtaatctcttgctcttgcaaccagctgtctctaatgatgctggatttgccatgacttctagctttacgtctatgatgttgacaactctcttggtctttgatcctacagaatttgctgttaagtctgaacgttttgaagttgtatctagtcttgcccgtaaagttttagacaaggcagaagatgtcaaagagctcgttgatttagactttaaccgtgtcatctatctaggcgctggtcctttctttggacttgctcatgaagctcagctcaagattttggaattaactgctggtcaagttgcgaccatgtatgaaagcccagttggcttccgtcacggtccaaaatctcttatcaacgacaatacagttgttttggtctttggtacaacgacagactacactcgtaagtacgacttggacttggttcgtgaagttgctggtgaccagattgctcgtcgtgttgtgcttttgagtgatcaagcttttggtcttgaaaatgtcaaagaagtggcccttggttgtggcggtgtcttgaatgatatttaccgtgtcttcccttacatcgtttatgcccaactctttgctttattgacttcactcaaggtagaaaataaaccagatacaccgtctcctacaggtacagtaaaccgtgtagtacaaggtgtcataattcacgaatatcaaaagtaagacagtgtttatgaattcttgacaagaggatttgtaaattatcagataaaccatagattgtcagtacgctttctatggtttgtttgcttgagagaaatagtaaaaggagaacagaatgaaagcatacacagagcgtgtatttggaaatgttgagggtgaggatgtcttggcctatcgatttgagacagacggtggctaccaacttgaggttatgacttatggtgcgactatcttgcgctatgtcgcacctgacaaggctggaaattttgccaatgttatcttgggatttgatgactttgatagttatgtaggcaatagtcccaagcatggagcaagtgtaggtcctgtagcgggtcgtattgcaggtgcgacctttgagctcaatggtaagacctatgaccttgaggttaataatgctagcaactgtaatcacagtggttcaactggttgggattccagcttgtttgaagttgaagaagtaagcgatcatggcttgactctctacacagagcgtacagatgggacaggagggttccctggaaatctcaagatttggatcagttatcacttggaagaaactggtgcctatgaaatcagctacaaggtaacgaccgatcaggatacgctggtcaatccaaccaaccacagctatttcaacttgtctggtgatttcacgcagacgattgaccgtcatgtcttccaactaaacacagagggcatttactcaatcgctcctgacggtgttcctgccaaaactccagaagccaaccgtgatgtggtcaaacacgtctacaatggtaccttgttgaaggatatctttgcagaagaagatgagcaaatccagctggcatcaggtttggatcatccatttgcccttcctgcaggccatgacaatgctggattcctttatgaccaaaattcaggtcgcttcctgcttttcaagacagaagctccttgctttgtggtctacacagcaaactttgtggatgaaagtgtcatcataggaggtcagccaatgctacagcacaatgggattgctcttgaagcgcaagctttaccagatgccattcacagtgaccttaaaggccaagtcattcttaaagctggtcaaaccttcaccagtaagacacgttatgaacttgttgtgaagtaaaagagtcattgcgcctacttttgggagctaggaataggtacgcagagacaaatagtaggaaaatatgatataactaagcgttgaaagctatctgttaatataatattcaaactacaataaggagtaagaaagaaacgaagaaaattgtatttgctagtgccttggctttgaccttggctggagcagttttgacaaatgatgtttttgcgaacgacagacttgtggcaacacaaactactgatggtaaaaatgaaaatgtattgacctcagaggtgctaaaaccttctagtggcaatgttttggttggaatcaaaggagaatttgtggctcctcatcaacaatctattttggatgccatcaatgctatctgtaaagaagcggctgacgaaggtttggtagataagtatgtccctatcaaatgatcaactgacctagaaaaggcagcttttgccagagctacagaagcatctataaccatggatcatacccgtctttctagcaaagatctttggagtgcctttccaacttctaatagtataatgggagaaaatttggcatggaatcatgacggttttctaaaagctattgaacaatggcgtgctgaaaaagcagattatgtggagaaaaaaatagtggttcagacaacgggaaatctggtcactatgagtcgctaattaaccctaaatttacacacatggggatggcagcttttaaaaatcctaacaatcaatacaaagctattacaattgctcaaactctaggtgatgatgcttcttcagaggaattggctggtagatatggttctgctgttcagtgtacagaagtgactgcctcaaacctttcaacagttaaaactaaagctacggttgtagaaaaaccactgaaagattttagagcgtctacgtctgatcagtctggttgggtggaatctaatggtaaatggtatttctatgagtctggtgatgtgaagacaggttgggtgaaaacagatggtaaatggtactatttgaatgacttaggtgtcatgcagactggatttgtaaaattttctggtagctggtattacttgagcaattcaggtgctatgtttacaggctggggaacagatggtagcagatggttctactttgacggctcaggagctatgaagacaggctggtacaaggaaaatggcacttggtattaccttgacgaagcaggtatcatgaagacaggttggtttaaagtcggaccacactggtactatgcctacggttcaggagctttggctgtgagcacaacaacaccagatggttaccgtgtaaatggtaatggtgaatgggtaaactaggctcaggccataggtaaagcattcatcttacttagcaaaaagaatgaacgataagaaagaggttgatggcgaacattggcctcttttgatttataaagattggattcttgtcgcctcaatttcagacttttctattgtaagctaatattttatagcccattaaaagcataagcggtaatctaatttaaaaaatgctgtaattagtctgaagtccacacttacttgttgagatgttatctctgttttttatcgttataatttactgtattttttatagtatgcagaatatttttaagtatatttcaatagaaatttctatcgatttattgtataatgataagtaattgttgaaaagtactcagaaaattccatactatattatttttatgtttatacttttatgctataaaatatagattgatataaagaatatagaaaaagcgaggttaatatgagccgaaaaagcattggtgagaaacgccatagtttctcgatgagaaagttgtcagtgggattggtatcagttactgtatctagtttctttttgatgagtcaagggattcaatcggtatcggccgataatatggaaagtccaattcattataagtatatgaccgagggtaaattgacagacgaggaaaaatccttgctggtagaggcccttccacaactggctgaagaatcagatgatacttattacttggtttatagatctcaacagtttttaccgaatacaggttttaacccaactgttggtactttcctttttactgcaggattgagcttgttagttttattggtttctaaaagggaaaatggaaagaaacgacttgttcattttctgctgttgactagcatgggagttcaattgttgccggccagtgcttttgggttgaccagccagattttatctgcctataatagtcagctttctatcggagtcggggaacatttaccagagcctctgaaaatcgaaggttatcaatatattggttatatcaaaactaagaaacaggataatacagagctttcaaggacagttgatgggaaatactctgctcaaagagatagtcaaccaaactctacaaaaacatcagatgtagttcattcagctgatttagaatggaaccaaggacaggggaaggttagtttacaaggtgaagcatcaggggatgatggactttcagaaaaatcttctatagcagcagacaatctatcttctaatgattcattcgcaagtcaagttgagcagaatccggatcacaaaggagaatctgtagttcgaccaacagtgccagaacaaggaaatcctgtgtctgctacaacggtgcagagtgcggaagaggaagtattggcgacgacaaatgatcgaccagagtataaacttccattggaaaccaaaggcacgcaagaacccggtcatgagggtgaagccgcagtccgtgaagacttaccagtctacactaagccactagaaaccaaaggtacacaaggacccggacatgaaggtgaagctgcagttcgcgaggaagaaccagcttacacagaaccgttagcaacgaaaggcacgcaagagccaggtcatgagggcaaagctacagtccgcgaagagactctagagtacacggaaccggtagcgacaaaaggcacacaagaacccgaacatgagggcgaagcggcagtagaagaagaacttccggctttagaggtcactacacgaaatagaacggaaatccagaatattccttatacaacagaagaaattcaggatccaacacttctgaaaaatcgtcgtaagattgaacgacaagggcaagcagggacacgtacaattcaatatgaagactacatcgtaaatggtaatgtcgtagaaactaaagaagtgtcacgaactgaagtagctccggtcaacgaagtcgttaaagtaggaacacttgtgaaagttaaacctacagtagaaattacaaacttaacaaaagttgagaacaaaaaatctataactgtaagttataacttaatagacactacctcagcatatgtttctgcaaaaacgcaagttttccatggagacaagctagttaaagaggtggatatagaaaatcctgccaaagagcaagtaatatcaggtttagattactacacaccgtatacagttaaaacacacctaacttataatttgggtgaaaataatgaggaaaatactgaaacatcaactcaagatttccaattagagtataagaaaatagagattaaagatattgattcagtagaattatacggtaaagaaaatgatcgttatcgtagatatttaagtctaagtgaagcgccgactgatacggctaaatactttgtaaaagtgaaatcagatcgcttcaaagaaatgtacctacctgtaaaatctattacagaaaatacggatggaacgtataaagtgacggtagccgttgatcaacttgtcgaagaaggtacagacggttacaaagatgattacacatttactgtagctaaatctaaagcagagcaaccaggagtttacacatcctttaaacagctggtaacagccatgcaaagcaatctgtctggtgtctatacattggcttcagatatgaccgcagatgaggtgagcttaggcgataagcagacaagttatctcacaggtgcatttacagggagcttgatcggttctgatggaacaaaatcgtatgccatttatgatttgaagaaaccattatttgatacattaaatggtgctacagttagagatttggatattaaaactgtttctgctgatagtaaagaaaatgtcgcagcgctggcgaaggcagcgaatagcgcgaatattaataatgttgcagtagaaggaaaaatctcaggtgcgaaatctgttgcgggattagtagcgagcgcaacaaatacagtgatagaaaacagctcgtttacagggaaacttatcgcaaatcaccaggacagtaataaaaatgatactggaggaatagtaggtaatataacaggaaatagttcgagagttaataaagttagggtagatgccttaatctctactaatgcacgcaataataaccaaacagctggagggatagtaggtagattagaaaatggtgcattgatatctaattcggttgctactggagaaatacgaaatggtcaaggatattctagagtcggaggaatagtaggatctacgtggcaaaacggtcgagtaaataatgttgtgagtaacgtagatgttggagatggttatgttatcaccggtgatcaatacgcagcagcagatgtgaaaaatgcaagtacatcagttgataatagaaaagcagacagattcgctacaaaattatcaaaagaccaaatagacgcgaaagttgctgattatggaatcacagtaactcttgatgatactgggcaagatttaaaacgtaatctaagagaagttgattatacaagactaaataaagcagaagctgaaagaaaagtagcttatagcaacatagaaaaactgatgccattctacaataaagacctagtagttcactatggtaacaaagtagcgacaacagataaactttacactacagaattgttagatgttgtgccgatgaaagatgatgaagtagtaacggatattaataataagaaaaattcaataaataaagttatgttacatttcaaagataatacagtagaatacctagatgtaacattcaaagaaaacttcataaacagtcaagtaatcgaatacaatgttacaggaaaagaatatatattcacaccagaagcatttgtttcagactatacagcgataacgaataacgtactaagcgacttgcaaaatgtaacacttaactcagaagctactaaaaaagtactaggagcagcgaatgatgcagccttagataacctatacttagatagacaatttgaagaagttaaagctaatatagcagaacacctaagaaaagtattagcgatggataaatcaatcaatactacaggagacggtgtagttgaatacgtaagtgagaaaatcaaaaataacaaagaagcatttatgctaggtcttacttatatgaaccgttggtacgatattaattatggtaaaatgaatacaaaagatttatctacgtacaagtttgactttaacggaaataatgagacttcaacgttggatactattgtcgcattaggaaatagtggactagataacctgagagcttcaaatactgtaggtttatatgcgaataaacttgcatcggtaaaaggagaagattcagtctttgacttcgtagaagcgtatagaaaactgttcttaccaaacaaaacaaataacgagtggtttaaagaaaatacaaaggcatatatagtcgaaatgaagtctgatattgcagaagtacgagaaaaacaagaatcaccaacagccgatagaaaatattcattaggagtttacgatagaatatcagcaccaagttgggggcataagagtatgttattaccactactaactttacctgaagaatctgtgtatatttcatcgaatatgtctacacttgcattcggttcgtatgaaagatatcgtgatagtgtggatggagttattctttcaggagatgctttacgaacttatgtaagaaatagagttgatatagcagcgaaaaggcatagagaccattatgatatttggtacaatcttcttgacagtgcttcaaaagaaaaacttttccgttctgtgatagtttatgatggattcaatgtaaaagatgagacaggaagaacttattgggcaaggttaacggataaaaacatcggctctattaaagaattcttcggacctgttgggaaatggtatgagtataatagtagtgcaggagcgtatgcgyatggaagtttaacgcactttgtgttagatagattattagatgcttatggaacgtcggtttatactcatgaaatggttcataattctgattctgcaatctactttgaaggaaatggtagacgtgaaggattgggagcggagttatacgcacttggtttactgcaatctgtagatagtgtaaattctcatattttagctttaaatacgttatataaagcagaaaaagatgatttgaatagattgcatacatataatccggtggaacgtttcgattcggatgaggcgcttcaaagttatatgcatggatcatatgatgtaatgtatacacttgatgcgatggaagcaaaagcgatattagctcaaaataatgatgttaagaaaaaatggtttagaaaaatagaaaattattacgttcgtgatactagacataataaagatacacatgcaggaaataaagtccgtccattaacagatgaagaagtagctaacttaacatcgttaaactcattaatcgacaacgacatcataaatagacgtagctatgatgatagtagagaatataaacgaaatggctactatactataagtatgttctctcctgtatacgcagcgctaagcaattcgaaaggtgctcctggagatattatgtttagaaaaatagcttatgaattacttgcggaaaaaggttatcacaaaggattcctaccttatgtttctaatcagtacggagcagaagcatttgccagcggaagcaaaacattctcatcatggcatggaagagatgttgctttagtgacagatgatttagtatttaagaaagtattcaatggtgagtactcatcatgggctgatttcaaaaaagcaatgtttaaacaacgtatagataaacaagataatctgaaaccaataacaattcaatacgaattaggtaatcctaatagtacaaaagaagtaactataacaacggctgcacaaatgcaacaattaattaatgaagcggctgcgaaagatattactaatatagatcgtgcaacgagtcataccccagcaagttgggtgcatttattaaaacaaaaaatctataatgcatatcttcgcactacagatgactttagaaattctatatataaataagattgtagagtttcattgttgagtagtgtttcttgtaaggatgaggagtcagatgacaaatcgactcctttttcttatggatcgatgtagagatttgattgaatgcagattgcaggaatcatcttcaactcatcaacgaccaatggtgacaaggtggatttcaatcccacagaaaatgttgatttgagaaataactttgctagtctagtaaaataaatacaaaacaatcctagaagattttttctgggattgttttttgctgagtgggatgcttcaagttgtctggcttgactttcttgagggaagttatataatagttgtaataattag

SEQ ID NO: 172 - DNA, 11770 bp; double-stranded, linear
acaggaaagcacgatagcaatctctttggaagatttaaaaaatattcctcaaagtttcgctgttgcttacggtgatacgaaagtatcttcgattctctctgtcttgcgtgctaatttagtaaatcatttgattacagacaaaaatacaattttaaaagttttggaagaagatggggatttgacttttagagagattctaggtgagtgaaaatgatagactgattcagtttatcgtttttctttttagttgattgcacatttgtgcttatataaacaaaaatagtttatctgttgtttttggattgacaactttattatgtagttgtattctatagttacaaaagaaaattttaaaatttcaaatgaaaaaagctttttacatagtgaaatgaggaggaatttatggaaatgattgttccagatcaaattatcatgggtttaattttatatgctggtgatgcgaaacaacatatttataaagcgttagattacataaaaaatggtacatgtgaacggtgtgaagaagaaatacagttagctgatgcagccttattagaagctcataatctacaaacaaaatttttggcacaggaagcgtctggtacaaagacagaaattacagctctctttgttcattcacaagatcatctcatgaccagtatgacggagattaatttaatcaaagaaattattagtttgagaaaagaacttcataaaaaataatactagagtattatcattgttattaacatagaggaggaaaacataatggtgaagattggtttgttttgtgcagcaggtttttctactggtatgcttgtaaataatatgaaaattgcagcgcaatctagtggagttgaggcagaaatagaggcgttttctcagtctaaattagcggattatgcgccaaatatagatgttgcactattgggtccacaagttgcttatacattagataaatcaaaagaaatttgtgataagtgtgatgttccgatagctgttattccgatgatggactatggtatgttagatgggaaaaaagtattagatttggccctatctttgattagtgggtaagaaaaggagatttattatgtcaaagatggatgttcagaaaatcattgcaccgatgatgaagtttgtgaatatgcgtggcattatagctctaaaagatgggatgttagcaattttgccattgacagtagttggtagtttgttcttgattatgggacaattgccgttcgaaggattaaataagagcattgctagtgtttttggagctaattggacagagccgtttatgcaagtatattcaggaacttttgctattatgggtctaatttcttgtttttcaattgcctattcttatgctaagaatagcggagtagaggctttaccagctggagttctatctgtatctgcattctttattttgctaagatcatcttatatccctaaacaaggtgaggcgattggggacgctattagtaaagtttggtttggaggccaaggaattatcggtgctatcattataggtttggtagtaggaagtatttataccttctttataaagagaaaaattgttattaagatgccagaacaagttccacaagctattgccaaacagtttgaagcaatgattccagcatttgtaattttcttatcttctatgattgtatatattttagcgaagtcattgactaatggcggaacattcatagaaatgatttattctgctattcaagttccgttgcaaggtttaactggatctttgtatggtgctattggaattgcattctttatatcatttttgtggtggtttggtgttcatgggcaatcggtagtaaatggagtagtgacagctctgcttttatctaatcttgatgctaataaagctatgttagcctctgctaatctatcattagaaaatggtgcacatattgttactcaacaatttttagattcatttttaattctatcaggttcagggattacgtttggtcttgtagttgccatgctttttgcagcaaaatcaaaacaataccaagccttaggaaaagttgcagcttttccagcaatatttaacgtaaatgagccagttgtatttggatttccgattgtcatgaatccagttatgtttgtacctttcattcttgttcctgtacttgcagctgtgatagtatatggagctattgcaacaggtttcatgcagccattctcaggggtaacattgccttggagtacaccagctattttatcaggatttttggtgggtggatggcaaggagttattactcagctggtgatattagcgatgtctacattggtttattttccattctttaaagtacaggatcgtttagcttaccaaaatgaaatcaaacaatcttagaggtatttgtgtgttactgttaaactcacacatttgtgctaaaaattagagagttaaaatttttctagttaaaagcttgaaaatttctataaaaatcggtattatattttcgaaagaaataaaaatattttcgaaagaaaggtgcttacgatggtaaatacagaagtagcaagaacaacaatcaagacagaatattttggcagccttactgaaaggatgaacaaatatcgagaagatgttttaaataaaaaaccttatattgatgctgagagagcagttctagcaacacgcgcctatgaacgatacaaggaacaacctaatgtcctaaaacgtgcatatatgctgaaagaaattttggaaaatatgactatctatattgaagaagaatctatgattgcgggaaatcaagcttcttccaataaagatgctcctatttttccggaatatacgctagaatttgttctcaatgagttggatctttttgaaaagcgtgatggagatgttttctatattacagaagaaacaaaagaacaacttagaagtattgctccgttttgggaaaataataatttacgtgctagagctggtgccttattacctgaagaagtgtctgtttatatggaaacaggattcttcggtatggaaggtaagatgaattctggagatgctcacttagcagttaactatcagaaacttttgcaatttggtttaagaggttttgaagagcgggctcgtaaagcaaaagtagctctagatttaacagatccagcaagtattgataaatatcatttttacgactctatatttatcgtaatcgatgctattaaagtatatgcaaagcgctttgttgctcttgctaaaagtttagccgaaaatgcaaatcctaaacgtaagaaagaattacttgagattgcagatatttgctctagagtcccatatgaaccggcaactacttttgcagaagctattcaatcagtttggtttattcaatgtattttacaaattgaatctaatggccactctctttcatatggccgttttgatcaatatatgtatccatatatgaaggctgatttagaaagtggtaaagaaacagaagatagcattgttgaacgtctgacaaatctttggattaagacaattacaattaataaggttcgcagtcaatcacatacattttcttcagcaggaagtcctttatatcaaaatgttacaattggtggacagactcgagataagaaggatgctgttaacccattatcttatttggtattaaaatcagttgcacaaacccatctaccgcaacctaatctaactgtacgttaccatgcaggtttagatgctcgtttcatgaatgagtgtattgaagtgatgaaacttggttttggtatgcctgcatttaataatgatgagattattattccttcttttattgcaaaaggagtattggaagatgatgcttatgattacagtgccattggatgtgttgaaacggcagttccagggaaatggggctatcgttgcacaggtatgagttatatgaacttccctaaggttctacttatcacgatgaatgatggaattgatccggcttcgggtaaacggtttgcaccaagctttggtcgttttaaggatatgaagaacttttctgaattagaaaatgcttgggataaaacactaagatatttgacacgaatgagtgttattgttgaaaattctattgatttatcattggaacgagaagttcctgatattctatgttcagcattgactgatgattgtattggtcgtggaaaacaccttaaagaaggtggagcagtatatgattatatatcaggattgcaagttggaattgcaaatttgtcggattcattagctgcaattaaaaaattggtgtttgaggaagaacgtataagcccaagtcagctttggcatgcactggaaacagattatgccggagaagaaggtaaggtcattcaagaaatgttgattcatgatgcacctaagtatggtaatgatgatgattatgctgacaaattggttactgctgcttatgacatttatgttgatgaaattgctaaatatcctaatacacgttatggaagagggcctattggaggaattcgttattcaggaacatcttctatctcagccaacgtagggcagggacgtggaacattagcaactccagatggacgcaacgcgggtacaccgttagcagagggttgttcaccatcacataatatggatcaacacggccctacatctgttttaaaatctgtttcaaaattaccaacagatgaaatcgtaggtggggttctcttaaatcagaaagtaaatcctcaaacgttagccaaagaagaagataaattaaaactaattgctttgttacgaacattctttaatcgtttacatgggtaccatattcaatacaatgttgtttccagagagacgctgattgacgctcagaaacatcctgaaaaacacagagacttaattgttcgtgttgcaggatactctgcattcttcaatgttctttctaaggcaacccaagatgacattataggacgtactgagcatactttgtaaaataaagaggttctttttatggaatttatgcttgacacattaaatttagatgagattaaaaagtggtctgaaattttgccgctagctggggtaacttcaaatcccactattgcaaaaagagagggttctattaatttttttgaacgaatcaaagatgtaagagaattgattggctctacaccctctattcatgttcaggtgatttctcaagattttgaaggcatcttaaaggatgctcataaaattcgaagacaagcaggagatgatatatttatcaaagtacctgttactccagctggattacgtgcaataaaggcgctaaaaaaagagggctaccatatcactgcaacagctatttatacagttattcagggattattagctatcgaagcaggagcggattacctagctccatattataatagaatggaaaatctgaacattgattcaaattctgtcattcgtcaattagctcttgctattgatagacagaactctcctagtaagattttagctgcatcctttaaaaatgtagcacaagtaaataatgctttagctgcaggtgcgcatgctgttacagcaggagcggatgtttttgaatcagctttcgccatgccatctatccaaaaggcggttgatgatttttctgacgattggtttgttattcaaaatagtcgttccatttagatagagaggaaatacatatgagaatttttgctagtccttctagatatattcagggggaaaatgccttgtttgaaaatgccaaatcaattttggatttgggaaattgccctattctattatgcgatcagttggtttatgatattgttggaaaacgatttgaagattacctacataggtatggtttccatattgttctggcgctatttaatggtgaagcttctgacaatgaaatcaatcgagttgttgccttggctgagaaagaaaattgtgatagtattatcggtcttggtgggggaaagacgattgatagcgcaaaagctattgcagatttgattgaaaagcctgttattattgctccaacaattgcatcgaccgacgcacctgtatctgctttatctgttatttatacagatgaaggtgcatttgatcattatctattttattctaaaaatccagatttagttttggttgatacaaaagttatttcacaagcccctaagcgtttattagcgtctggtattgcagatggtttagcaacttgggttgaggcgcgtgcggttatgcaggcaaatggaaaaactatgttgggacaacagcaaacattggctggagttgcaattgcgaagaaatgtgaagaaacgctgtttgcagatggtttacaggctatggcagcttgtgaagctaaagtggtgacaccagcattagaaaatattgttgaagctaatactttattgagtggtctaggttttgaaagtggaggattagctgcggcgcatgcaattcataatggttttactgcattgacaggtgacattcatcatttaacacatggtgaaaaagtagcttatggaactttagtacaactattattggaaaatagacctaaagaagaacttgataagtatattgagttttacaaaaaaattggtatgccaacaactctaaaagaaatgcatttggatcaagttggatatgatgatttaataaaagttggtaaacaagcaactatggagggtgagacaattcatcagatgccgtttaagatttcgccttcagatgttgctcaagctattatcgctgtagatgcctatgtaaattcaaaataaacaataaggactactgttttccaaatggtagtcttttattgatccctgtattgaattctatagaagattgaaataggatgagaacaaatcgattgggaaagtaaaattaatttctataaatgttttagcaattgtttcgtactatttcagattcagtctactatatgttcttcataaatcaaaaagcgacataggttgtcggctatttattgtgaatacattaattagcattccagttttatcttcggtctaaaataagtattttgtgctatacgagataagcttcttgacttactccttgatttactgcataacaatgggataaaaagtgggagatagagcaattcatagtcatcaaaattaatgagatacagtatacagtttttcctttaaacacatttcaaattccctcaaaaatggtataatagtaacatcacaaaattggagagagaccatgagtttttacaatcataaagaaattgagcctaagtggcagggctactgggcagaacatcatacatttaagacaggaacagatacatcaaaacctaagttttatgcgcttgatatgttcccttatccgtctggagctggtctgcacgtaggacacccagaaggttatactgcaaccgatatcctcagtcgttacaaacgtgcgcaaggctacaatgtccttcacccaatgggttgggatgcttttggtttgcctgcagagcaatacgctatggatactggtaatgacccagcagaatttacagcggaaaacattgccaacttcaaacgtcaaattaatgcgcttggattttcttatgactgggatcgtgaagtcaacacaacagatccaaactactacaagtggactcaatggattttcaccaagctttacgaaaaaggcttggcctatgaagctgaagtgccagtaaactgggttgaggaattgggaactgccattgccaatgaagaagtgcttcctgacggaacttctgagcgtggaggctatccagttgtccgcaaaccaatgcgccaatggatgctcaaaatcacggcttacgcagagcgcttgctcaatgacttagatgaactagattggtcagagtctatcaaggatatgcaacgcaactggattggtaaatcaactggtgccaatgtaactttcaaagtaaaaggaacagacaaggaatttacagtctttactactcgtccggacacacttttcggtgcgactttcactgtcttggctcctgaacatgaattagtagacgctatcacaagttcagagcaagcagaagctgtagcagactataaacaccaagccagccttaagtctgacttggctcgtacagaccttgctaaagaaaaaacaggggtttggactggtgcttatgccatcaaccctgtcaatggtaaggaaatgccaatctggattgcagactatgtccttgctagttatggaacaggtgcggttatggctgtgcctgcccacgaccaacgtgactgggaatttgccaaacaatttgaccttccaatcgtcgaagtacttgaaggtggaaatgtcgaagaagctgcctacacagaggatggcctgcatgtcaattcagacttcctagatggattgaacaaagaagacgctattgccaagattgtggcttggttggaagaaaaaggctgtggtcaggagaaggttacctaccgtctccgcgactggctctttagccgtcaacgttactggggtgagccaattccaatcattcattgggaagatggaacttcaacagctgttcctgaaactgaattgccgcttgtcttgcctgtaaccaaggatatccgtccttcaggtactggtgaaagtccactagctaacttgacagattggcttgaagtgactcgtgaagatggtgtcaaaggtcgtcgtgaaaccaacactatgccacaatgggctggttcaagctggtactacctccgctatattgacccgcacaatactgagaaattggctgatgaggacctcctcaaacaatggttgccagtagatatctacgtgggtggtgcggaacatgctgtacttcacttgctttatgctcgtttctggcataaattcctctatgacctcggtgttgttccgactaaggaaccattccaaaaactctttaaccaagggatgattttgggaacaagctaccgtgaccaccgtggtgctcttgtggcaaccgacaaggttgaaaaacgtgatggttccttcttccatgtagaaacaggggaagagttggagcaagcgccagccaagatgtctaaatcgctcaagaacgttgttaacccagacgatgtggtggaacaatacggtgccgatacccttcgtgtttatgaaatgtttatgggaccactcgatgcttcgattgcttggtcagaagaaggtttggaaggaagccgtaagttccttgaccgagtttaccgtttgattacaagtaaagaaatccttgcggaaaacaatggtgctcttgacaaggtttacaacgaaacagtcaaagctgttactgagcaaattgagtctctcaaattcaacacagctattgcccaacttatggtctttgtcaatgctgctaacaaggaagataagctttatgttgactatgccaaaggctttattcaattgattgcaccatttgcacctcacttggcagaagaactctggcaaacagtcgcagaaacaggtgagtcaatctcttatgtagcttggccaacttgggacgaaagcaaattggttgaagatgaaattgaaattgtcgtccaaatcaaaggaaaagttcgtgccaaactcatggttgctaaagatctatcacgtgaagaattacaagaaatcgctttagctgatgaaaaagtcaaagcagaaattgacggtaaggaaatcgtgaaagtaattgcggtaccgaataaactcgttaatatcgtcgttaaataacgagtttattagctctatctgccaccttcaatagtccactggactattgaasccaactaaattagttaacattgttgtgaaataagataggagtccttcagagtagaatctggaggattttttgaatcttcttatgaaagtatgatatactatgggcaactataaagtttgaaaagtgaaataaggagaataagatgccagtaaatgaatatggtcaaatgattggggagtcaatggaagcttatactccaggtgaattgccttcttttgatttcttagaagggcgttatgctaggatagaggctctttcagtggaaaagcatgcggaggatttattagctgtttatggccctgatacgcctcgggagatgtggacctacctctttcaggagtcagtagcagacatggaggaactggtcagccttttaaatcagatgttggctcgtaaggaccgtttttattatgcaatcatagacaaggcaactggtaaggctttgggaactttttccctcatgcgaattgatcagaataaccgagtaatagaagtgggagctgtcactttttctccagagctcagggggacacggataggaacagaagcccagtatctcttggcttgctatgtctttgaggagcttaactatcgtcgctatgagtggaaatgcgatgctcttaacctgccatccagacgagcagcggaacgtttgggatttatttatgaaggaaccttccgtcaggcagtggtttataaggggcgtacaagagatacggattggttgtctatgattgataaggactggcctcaagtcaaagctcgattggaaatatggttgcgtcctgaaaactttgataaaaatggacgacagcacaagagcttgagagaactttaagaggtgttgagatgattactattaaaaagcaagaaattgtcaagctagaggatgttttgcatctctatcaggctgtcggttggacaaactatacccatcaaacagagatgctggagcaggccttatctcattcattagtaatttatctggcacttgatggtgatgctgtggtgggcttgattcgtttggttggagatggtttttcatcagtttttgtacaggatttgattgttttgcctagctatcagcgtcaagggattggtagctccttgatgaaagaggctttaggaaattttaaagaggcctatcaagtccagctggcgacagaagagacagaaaaaaacgtgggattttatcgttctatgggctttgaaatcttatccacctatgactgtacaggaatgatttggataaacagagaaaaataaaaaaacttgtttgttcttaagcaaagtttaaggatggtctagtatcatatagtcattaaataaagacctcctaactttatttaataaaatcctaaacttttttcatcacaatctcctaatgaagccacccaatcaggtggcttttttgcggtacgacgggcatgtcgtatatctgaggtgtaagtcctcagcctgactatcgtgaggtagcagggagaggaagggatagcgaaatcgtggctctacgaacaggaacgtgatagtaaggcgtatatagcggataaggaggcttcaaactctaaagtccaaaaaggtagtcgtaacctatatgtgtaaatcacgagagtaattgaattcggactaaggtttgtgtgaaaaagataaatctttctagagtctaaagactctgcgtcagatttcctattttcactgtaaccttttaacgtcctcatatcttgtataaacgaggaaagatgtacgacttatcccgtgaggtttcatgagcgctgaaagcgtagtaacaacgaatcatgagaagtcagccgagcccatagtagtgaggaaacttccgtaatggaagtggagcgaaggggtgaatactcaaacagtctggggagagactgtttgaggtctgtcgctagaaagagaaaacgacagatcgaagtaatcctacttcacttgtgtctgtaaaatgagtggtctgatagaactggactttgagg

SEQ ID NO: 173 - DNA, 4185 bp; double-stranded, linear
cgcgaaactactttcttagtataacactttcagaatcattgtcaatagaaatgacttgattttttcaattttttcaagctatttccaagggttgtaaaatcgtccctgattctgcaagataagtagtaaactaactactaaaaacaaggttgccaagagcaaggtaatatagtctccttttttcaaggcctgataactataccatgtgcgttttttctctttcccaaagcggcgaactccatggcagtcgcaatggtatcaatgcgttctagcgagctaaaaatcaagggcgtaataatgagcagattgcctttgattcgttgcataagagaagctttcttggataattccatcccacgcgcctcctgagacatcttgatagtaaagaattcttcctgcaaatctggaatatagcgcaaggtcaggctgacagaataagcaatcttatagggcacaccaatttgatttaaactggaagcaaactgactaggatgggttgtcatcaaaaagataatagccagaggaatggtgcaaagatacttaatggccaaatttagcagataaaagagctcctggctggttagagtgtagacaccgattccctgccaaatcacacttctctctccataaagtccaaccccatactcgggagaaaagagatagaccatcaaaacgtttaaaacggcaaatatcgtcgcaaaaacggctacaaaggaaacatctttaaagcgaatttctgataaatagaggagaaagactgaaaagatggcaatcagcaagagcattctggtatcatagctaatcatggccgccaatgataccagaatgaaaaagagaagtttcccagctcctgacaagcgatgaatcacagtatctctatgctggtaaccgattaatttagcttgcatccctctctcctttctttgtaaaatgccgttaaatccagtggatccacatctagtttcttagccaagttaaagatggaggtttcttttagattggcttttactaacagctcaggatcgctcaacagactggctggaacagtatcggcaatcaattctccatccaccatgacaaggacccggtctgaataatccagcatcaattgcatatcatgggtaatcatgacaatggtatgccctttttgatgtaactcttcgagaaattccataatctcagtatagttcttctgatcttgacctgcagtcggttcatctaggagaataatttcagctcctaagaccaaaattgaagcaatggtgacacgttttttctgaccaaatgacagggcagaaataggccaattacggaattcataaagtccacagattttcaaggtttcatatactctcgtttcaatttccttctcatccacacctcgcaaacggagccctagagccacctcatcaaaaatcatattggttgaaatcatttgattaggattttgtagcacatatcctactcgttccgcccgctctgcaacagaatcgccttttatatcctgtttttcccaaagatagcgtccttccgtctgaataaagctacttatagccttggctagagttgatttccctgctccattttttccgacaatagcaatcttttcaccctttttaatatctaaatgtagggattttaaaatcggtctatcatcataagaaaaagatacttcctctagtctaaagagtgactgcaatgctggggtttcttttgccagttcattctgcaactgaacctgaccttttgagatagacaagttatccagattcgctaattgttcttccttgactaagtccacacctaattgacggagagtcgttagataaaggggttctcgaattccattttgagtcaataaatcagtcgcaagcaactggtcagggctcccattaaaaaggatacgaccatcgtttatcaagacaatccgatccacagggcgatgcagaacgtcctccaaacggtgctcgataataagagtcgtcgtcccctcttccttatgaatctggtcaatcaattcgataatatcctgacctgacttgggatctagattggcgagtggctcatcaaacaagagaatcggactttcatcaatcaagacaccagccagactgactcgctgcttttgtccacctgacaaatcctgaggacgctgatccagtaaaggaagaaggtccagcttttcagcccatttataaacacgacctttcatctcatctagggctgtcacatcattttccagagcaaacgccaaatcttctgccacagacaagccaataaactgcccatctgtatcctgcaaaactgtgctaaccagatgagacttatcatagatgctcatatcaaaggctacttgaccctttatcaaaaattctccatatgtctgacccttgtaaatattgggaataatcccattcaaacactgacccaaggtagatttacctgacccagatggtccaacaattaagactttctctcccttgtaaatggtcaagtctatcccttgcaaggtcggttcttgttgtgtttcataccggaaagagaaatccttccactcaattatagcttctttcatcttactctcttcattcgcttcttagacttctattttatcataaatcaagcccttcttgcagtctctcctcttaaaatcttagcgccaaaaagattcctatcctagcttacttgcctaactaatctataaacatcgaaaaagactagttgcccagccttccccatcattttatactcttcgaaaatctcttcaaaccacgtcagcttcgccttgccgtaggtatggttactgacttcgtcagtttcatctacaacctcaaaaccatgttttgagcctgcttcgtcagttctatccacaatctcaaaacactgttttgagcaactgcggctagcttcctagtttgctctttgattttcattgagtattagtcctttttcaaacttcctgcacgagtttgggttcctgcataggcaagtaagagaagagttcctgcaatagctacagatacaccattggcaattcccgcaacaatcccttgtgcaaatactttttctgccgcttcttgataaatcacaacatctccaagtggtgccaagacaccccaaacaagggcatttgcaagtagttgaatgagattaaaaataagaatatctttccagtcaaaaacaccattgatcacgcgaacgtactttctaaaaagtcccacaactaaaccaaagagtccgctagcgataatccaagtccaccatagaccataaccaacaagagagtccttgattgcatgaccaatcaacccgacaagcaaaccgataatcggtccaaaaataatagaaagtagcgcttgtaccgcatactgaagctggatgcttgtatttggaacaggggttggaatgttgatcatcccgatgacgacaaagagggcagcgccaattccgacagcaacaacttgtttaattgtaaatttgatttccatactattctcctattttatccttctattttctttatttcaatggtccaagatgaaccgacacctacattataggccttggcaaaggaaccttggttgatagccaaacctaaacgatagagagagttgatgtaaaggatgggttgcccaattctcacatctgcaaatgatttgccatagacaacctgattttgatagaccagcatatcagcatgatagatggtcacttcaaaacgatcaccaaattctggttccagcttgtaaaattcttcccgtgtgatagaggtccaaagcgaaccgaaacgcacatccagaatatcaatggctcccttcaccagatgatcttctatgatggtcgctacgactggaagctctacaatctgttccacactgagctctggccctacttcctcaaaagtaatgtgaccactggccagtttagcaccagtataggcatagacatcacgaccgtggaaggtataagaatgctctgtgttttgacgcctattggccacctcagaaatctcacgaatggctacaatgccaacgtgtttcttgataaaggaaagcgtcccattatctggcgtgacaatgtattgattttttgcagtcttggcaactacactcttacgtttcgaaccgacacctggatcgacaaccgatacaaacgtcgttccctcaggccagtaatccaccgtct

SEQ ID NO: 174 - DNA, 2069 bp; double-stranded, linear
tgatagagttaaagccgctgagtcattcaatccatctccaaccatcaaaatagtgtgacctgctttctgcagtttctctactaactcaaatttcccatcaggtttcaagtctgtatagacctgatcaaagggcaaatctttgactaattcctctgtcctaatcaaggtgtctcctgttgccagaatcaatttttycccctgtgccttaagtttatccaaggctgtttttgcttcttttctcaaaggagtatgaatgcagaacattccaatcaattcattttgataagccaagaataagagattgtagtgactcttgtactcttcaattaaagcattttgttctgaactgatatgaatctgctcatcctgcatcaagacataattcccaataagaactggttggccatctatatgagatttgatccccttgcttgcgatatattggagtttcccatgcatttcctcatgttcaattccctctatctcagcttgcttgacgatggcattagcaataggatgataaatgtgttcctcaagacaggcactgattctgagaatatcttcctcactatagtctccaaaaggtaacaccttttcaactataggataactagttgtgattgttcctgtcttatcaaacaagaaagtatcaacttccagatatttctccagaacatctccatccttaatcaccatttcacggttcaacccttccttgataactgtcaaataagctacaggagtagagattttcaaagcgcaggagaaatcgaccaataggaaagaaatagccttagaaaaagaacctgtcaataggtaagtcagcccagcccccaagaaattatatttgacgactttatccgccatcttgatgaaatagcgttgtttcgttttcttgttttcttcagatttcttcatcaactcaatcagctgtaaaatacggctgttcatctgattatctgttacacgaatgcgtaactctccagtttctaatactgtatttgcacaaaccaaatcagactctcttttttcaactggaaaactctctcctgtcaaggaactttcgttgaccatacctaaacctgaaactacttgtccatcaaacagaatttcatttccttgagataagatcaagacatctcctatttgaacatcggaactcttgatactaacaaccgtatcgccctgtactaggaatacatcgctctcttttgcaagaagactctgttctaaatctgttgcagtttttttcaaggaccactgatctaaatgattccccaaatcaagcataaacatgatattgctagctgtcttggattggttcataaacaaagacaataaaatagccgaacagtccaagacttccatcgttagtyccttacgcgctagtgtttgataggcttctctaatataacccaaagcctgataacaagtccatatatagcgaataggatacggcacaaaactacgaaaaagtacacgcttaaccgctgcacctgaaacaatagaataagcactctcttctctacgaatgggaagagtcatcaactcagaaactttccctttatcaattctttttaaaaaggcttctgcattatctaatacagaaaagccttcttttatgcgtagagtaaagtgctgttgatccatgtaaaactggatagactcaatccccttttcatctctcgccaaggaacgaagatagtcttgaatatccaaggtaagtgaaaaagaagatgatagtcggatatgttggtatcctctatgtagcactttaaaagacatattattcacctataaggctatctaattgctcttcttttttctcttgctcgtacaaatatttggcatcttgcaagacatcgtctccatgttgcttcacaacagaaacagatgcatctagctcgtctttcaacttgtaagccttagccaaagctttagaataaccttttttagcttccttacttgctaagattttcaaaccaagggtaccaaatgcgacaccacccaaaaataatgaagattttttcgcaacttttgcaacggttaatacttcttttaacataggg

SEQ ID NO: 175 - DNA, 4597 bp; double-stranded, linear
aaatcttgcgcaataaagctcatctccatctcccgattgaaacagtcactccccggactgtttcaacgtcccaagacataatcttaggcagatttctaaaattacactcaaagtggaagtcattgagctttcgaatgacagttgaagttgaaatggccagctgatgggcaatatcggtcatagaaatcttttcaattaacttttgcgcaatcttttggttgataatacgaggaatttggtgatttttcttgacgatagaagtttcagcgaccatcattttcaagcaatgatagcacttaaaacgacgttttctaaggagaattctagtaggcataccagtcgtttcaaggtaaggaattttatagggtctttaatgtctagtaattttgtgataaaatgtaattgttccatatgattctttctaatgagttgttttgtcgcttttcattatagatcttatgggactttttttctacccaaaataggctccataatatccatagggaatttacccactacaaatattatagagcccaaagttttaggtcgcttgataatatgcgttttttgaattttatagactgctcgtttaaactctatttacttcgtaccttctggagcgagacggaatattagtcacatacaaaatgagtactattaggattttattttcatgtacaatttcagccagtcttgttataatcagcctataggaatcaaggaggtgactcttatggctgtttttgtgtctttggatggaattgtggtagaagtccttgatgtcttttcttcttttaatggggatagtgagtttttcttgtgtatagcattttgaatctggaataggacgccatgactgctaaaagatttctataaattaatttgattttcctaatcaatttgttcatatcttatttcattccactataaacgtcttaaagacaagagtcagtttgttatggaacgctctcagttcgaggagatgttccaacttcaaagtagtcgcttgacgacgcaagaaaaattacaattgtttacctctgtgtttgctggccgttatgatgtttatgctaagaattttatcaatgaacaagggaaaattcagtattttccttcctatgattatggttggaagcagttgccacctgaaaaacggagtttccagacattgacgaactccgttttgaaatctcattttcgtggggaggcagctatcggtatctttcctatgcacttagatgatagctgttattttttggtactggatttggatgaaggagattggaaagaagctggtttaaccattcgaagaatagccagggaacgccagatggaagcccatttagagatttctcgttcgggtcacggactccatatttggttcttctttgaggaagcgattccgagtcgagaggctcgcttgtttggaaagaaactgatagaactggcaatgcaggaaagtatgcaactgtcctttgattcttttgatcgcatgtttccaaatcaggatgtccttcctaaggggggatttggaaatttgattgccttgccttttcaaggagaagcttaccatcaagggcgaacggtctttgtggatgaacagtttcagccttatgaagaccaatggaggtatctacaagaaattcagaggatttcaactgctaaagtggcactgttaatccaagaggagttaggcaagcaagaattggataaggagttgaaggtcgttttatccaatatgatccaacttgaaaaatcgtctgtgacatccaaggcacttttttcttgaaaaatatggcttccttttctaatcccgaattttatagtagattgaaactagaatagtacacctctgcttctaaaacattgttagaaatcgatttgactttcctgatcgatttgtcctgttattatttcattttactatatttaaagcaggctatgcgacagccaacctatcaaattcctgagagaatgtatttatttggagaatccgatcattatttatggttgccaagaggtttgctgtatccattgcaagataaatttaagcaggtatctgtggaagataggagaaaggtacaaaggtctattagcgtggaatttaagggagaactcacttttgagcaagagttagccctgtcagatatgacttctaaagaaaatggtttacttcatgcggagactggttttgggaagaccgttttaggtgctgctcttatctctgaacggaaaacaaaaacaattattctagtccataataagcaactcttagaccaatggctagatcgcttaaactgctttttgactttcgaagaggaggaggctatccgttatacggcatcaggtcgtgaaaaggtaatcggctatgttgggcagtacggtgggactaagaaatggctgagtaaactggttgatgtcgttatgattcaatctctatttaagttggaaaatagtcaaagtcttttggatgagtatgagatgatgattgtggatgagtgtcatcatgtctctgccttgatgtttgaaaaagttgttgctcagtttagagggaagtatctttacggtttgacggctacgcctgagcgtaagaatggtcatgagcctattgtttttcagagaattggtgagatactccatactgctgataagagggaaacggattttaaacggcaattgcaattaagattcacttcttttggtcatttggaaattgaaaagaccaaagcaagtaattttatacagcttagtgattggattgctactgactcagtgaggaatcagatgattctcaaggatattctagcccaagtggcagaaggacggaatatcttggttttagttaatcgaattcaacagatagatgtctttgaaaaattattgaaagagaaagaggttgatgactgttacattattagcggaaaaaccaaagtccgagagagaacgagtttactggagacgttagaacagttagataaagggtttgttttgttgtctactggaaaatacattggcgaaggttttgacttacctcagttggacacgcttatcttggcagcacccttttcttggaaaaataatttgattcagtatgcaggtcggattcatagaaactacaaggataagtctttggtgcgtattttcgattatgtggatattcatgttccttatttagaaaagatgtttcagaaacgacaagtagcttatcgaaagatggattatcgtgtcatcgagggtgaggagaaacaattcgtttatgttgatagtagatatgagaaggtgttgagagaggacttagcaggggaaagacaggaatgtctgcttattttaccttatgtgcaccagacaaaactgatgaattttctaaaagaatttaggattagtcaaattgagatatgtataccagagacggttgcaaataaagcatggctagaccagttgaagagccagaaaattaaagtgtcttttactcaatcaaaaatagtaacgcctattcttttggtgaataagactattgtttggtatggtgcaatgccattattagggaaggtagatgagatgaccatattacgtttggaatcagctagtatagtttctgaactagtggcaggtttacgatagagaaaatttttaaaaatttctatgtatgattttcatttctttagtgagactgttgccattatcacattcgaatcacacaaaataaaaaaatttttataagtacttgacaaatagattgaaatatcataaaataaaaacggttacagagttattaattatttaagcttcatgtcaccattaaaaattgaaataaaaggatgttatcactaatacaagtgagcaggaacctatttaatcacatcagaagaagtttcttgatgtttttaagtaggttccttttattttaaaagggaaattttatgatcataaaacgaatactaaaccacaatgccgtaattgcgcaaagtaaaaaagatatcgatattcttctttttggaaggggaatagcttttggaagaaaaactggagataaagtaaatccaattgatattgagaaaagtttttttctcaaaaatagagataatatgacccgttttacagagatgtttattaacgttcctttggagttggtgtacatcaccgaaaaaataattaacctaggtaaaataacattgggtaataattttgatgaaattatctatattaatttaacggatcatatttcttcgagcatagaacgttataaagaagggattattatttcgaatcccctacgctgggaaatatcgaaatattataaagaagaatttgaacttgggaaaagggctttacaaataataaaaaaagagttaggtattgaacttccaattgacgaagctgcattcatagcgctacattttgttaatgctaatttagaaaataattttcaagagtcgtataaaatcactgaaataattatgggaattgagaaaatcattcaagatttctattgtactgagtttaaccaagattctattgattattatagattcataactcatatgaaattatttgcccatcgcttggttgagaatacaacttattgtgacgatgatga

SEQ ID NO: 176 - DNA, 3984 bp; double-stranded, linear
cggcttatttactacttgttccatcatatatggaatatgcatgaaacctgctctcatattagggaattttttatccactaaataaagagcttggtacatcaaatgattgcaaacaaaggttcctgcactattggatacaactgccggaagtccctgttttttgatagcttgtaccatcgctttgataggtaaactactaaaataggccgatgctccatcaatacgaatcggtgtatcaattggttgattgccttcgttatcaggtatgcgagcatcatcttgattaatagccactcgttcaggtgttaagccggtcctgccgcctgcttgtccaatacaaagtacagcatctggttgatatcgtaatatttctgcctctaaaacttctgacgacttataaaaaaccgttggaatttctacccagcgaacttcagccccattaatctcagatggtaataattttacagcctccaaagctggattaatcttttcacctccaaaaggattaaaacctgtaaccaatattttcattttattttcctttactaaaatgcgagaaagtacattaagaatatgtgaataacaatcattactagagcaacacctgcttgagcctttataacgccattctgatctttcatatccatcaatgctgctggtagagcgttaaaattagcagccattggggtcaataaggtcccacaataacctgctgtcatggcaagagcaccagccacaattggattagctcccagagcaaatacaaagggaactccaacacctgctgtaataacggtgaatgctgcaaaagcatttcccataatcattgtgaatagaaccattccaagaacataggccaaaactcctataaagcgactatctgaaggaacaataccgctaatcagatgagagataacatcaccaacacctgctacagtaaaaatagcccccaaagcccctaataattgaggaacaatcccacttgttgaaacttgctgagtcattcgattattttctgataacagactcttagggtgactattggtaatcacaagaacagaaattgtagcaaacaaggcggcaaggctaatcgaaatcttgctaaattctggaatcatttgcgctaagaccaacgcaagtattgccatcagcataactggaataaaaattttatttttcaacctgttagattcaatattggctttcatttcatctaaggatggcaaggttccgatacggacttgcttaaacaatgttaacagcgataataggattacaataataccaatactcatatttggcatataggaaccacctataaacgtaatagacaatagagtccaaaatgcagatgtcccaagtcgaactgggtttgttttatctttataactacaataggctgtatggagaaattgacaaccaatcacaatataggtcaactctaatagttgctttgccaactctgtcatttttgttctcctcccctagtcttttttgatatcaattttttatcaaataaataattataaatccccactacaataagtgttataacagcaacaataatagatgtagaagcaatccctgcataattgctttcatagcctaactgatctaatgttccccctatcaagaggactcccccagcacctacaaacgtattttgagcaaagaaatttccaaaattttcattcgcagccgcacgcgcttttattgtctcatcttcaacctctgttaactttctacctaattgagactctgcagctgcttctcccataggttgaaccaaaggtctgacaaactgagggtgtcctcctagacgaattgaaaagaaaccagctaactctcgaataaagaaataaactgtatagaagtttccaactgtcagacctttaatctttcgaatcaaatcgattgatcgttgcttgagtccaaaggtttctgacagccccacaagaggcaaggtaaccataaaaatcgtgagcactcgctgattgctaaattcttttcccaaaatctccaaaaattcaacgagagaaacacctgaaactaaagctgtaaccaaaccagctaagactactgttgcaattgtatcaaattttaaaataaaacccacaacaatgattgctattcctattaatctaatccactccatatcaaactcctttatattcaaaatgacagtatttttaaaattttatcaagatcaataccattccttatttaatgtgtttttctagttctttttggtatttgctattggattccaatttttctttttgccattttttaaaaacctcgttatattcttttgttgtaacaatatctttttgcaatttcattcctttaaagatatatggatcccccttaataccaacttgtgagtatggttttgagaatggtactacgttacttacaactggagaaccaccagatgaagctgttggcatcaataatgaactatctgtcgaccaagcttgagctttggcatatttttcatatcttttctctaggtcagtggtctcagaaacagcatcttctaacaatttcttatatttatccaaaccaggtttagctacaacatccttatcttttcctttcgtaataccaaggtgtttcatggcagaaccagattttggatctataatattcaagtgagacgctggatcttgatagcttggagcccatcctgtactgttcaaatcatagtctttttgagaaggagcaacattgccgtatttatcattttccatcaaaccatcaataacatttccaataacgtctgtcctcgatgttcgagtcgctatactgtagcccaatgatgctggatctactgcatagacataagaaaatgttgtcggtgcatctgcttctttatcagtttttccacaagccactaaaatagctgacgtgctcaggaccactcctgctgttaagagccactttttctatttcataaagaatctcctttggtttattttaatctacttttacaatccaaccttctggcgcttcaatatcgccaaactgaatacccgtcaattcattatataatttacgcgtcacaggacctacttctgtttcactatagaatacatggaaatcatcaccatgttgaatacctccaattggagaaataaccgctgctgtaccacaggcacctgcctctacaaaacggtcaagattatcaattggaacatcaccctcaataggagttaatcccaagcgatgttctgccaaataaagcaaggaatacttggtaatagatggcaagatagatggactcaatggtgttacaaattcattatcagctgtaattccaaagaagttagctgatccgacttcttcaatctttgtatgagttgatgggtccagatagataacatctgagaaatgacgtgacttggccatttttcctggtaagagacttgcagcatagtttccaccaaccttagccgcacctgtaccatttggtgctgcacggtcgtactcatcctgaatcaagaagttggttgggaccaaaccacctttaaagtaatttccaactggcatagcaaagatggtgaaaatgtactcttctgccggttttaccccgataatatctccgacaccaatcaaaagagggcgaagatataaggttccacctgttccgtatggtggtacgtattcttcattcgcacggacaactgctttacaagcttctacaaacatgtctgtcggaacttgtggcatcaagagacggtcacatgtacgttgcagacgtttagcattttcatcaggacggaacagttgaacactgccatccttagtacgataagctttcaaaccttcaaatgcttgttgtccatagtgaagacttggagaagactctgaaatatgcaaagttgcatcctctgtaagctctccttgatcccattgtccatttttgaaatgagcaagatagcgataaggtaatttcatataggaaaaaccgaggttttccgg

SEQ ID NO: 177 - DNA, 8703 bp; double-stranded, linear
tatctaattattggtttttatcgctgaccttggctattgttggggttgttttacccttgttgcctacaacacctttccttttgttgtctattgcttgtttctccagaagttccaagcgattcgaagattggctttatcataccaagctctatcaagcatatgtagctgattttcgtgagaccaagtctattgcgcgtgaacgaaagaaaaaaatcatcgtctctatctacgtcttgatgggaatttctatttattttgcacctcttttaccagtcaaaatcggtctgggtgctttgaccatctttattacttattatctcttcaaggtcattccagacaaagaatagttaaaacagtagttatttgccttgataaaattgaaagcatattcataacaatatgatataataaaattgaagtaatattcaaggagaatcaaatgatttacgaattttgtgctgaaaatgtgactttacttgaaaaagcgatgcaggctggagctcgtcggattgaactctgtgataatctagcagttggtgggacaacacccagctatggagtgactaaggcagcggttgaactggcagctaactacgatacaaccatcatgaccatgattcggccacgtggtggtgactttgtctataatgacctagaaattgctatcatgctagaagacattcgtttgactgctcaggctggaagtcaaggggttgtatttggagctttaactgctgataaaaagttggataagcctaatctggaaaagttaattgctgcatcaaaaggaatggaaattgtctttcacatggcctttgatgaactaagtgatgaagatcaagcggaagctattgactggctcagtcaagccggtgtcactcgtatcctaactcgtgctggtgtgtctggcgactccttagaaaaacgttttgttcactatcacagaattttggagtacgctaaaggtaaaattgaaattctaccaggtggggggattgaccttgaaaaccgtcaaacctttatcgaccaggtgggggtaacacaattgcatggtactaaggttgttttttaaaaaatagaaaggaactgctagctttgggtagcagttttcacttatgtttgaaatttttaaatcctatcaatttaatcaagaaaaggctcatgattatggttttatagaaaatagcgaagtctggacatatagttgccagattttgcaaggtgactttgtcatgactgtgtccatcactgctgataatgtgaactttcaagtctttgaccaagagactggtgacctctatcctcacgtttatatggaaagcatgaggggaagttttgtcggaaatgtccgtgaggcttgtctggagattctttaccagattcggaaggcttgttttgatgtgcaagattttatctgtcatcagactaagcgtatcatgactcaagttcaggaaaagtatggaaaccagttggagtatctgtgggaaaaatcgcctgatacagctgtattgcgccatgaaggcaatcaaaagtggtatgccgtcttgatgaaaatctcttggaataagctggaaaagggcagagaaggacaagtggaagcagtcaacctcaagcatgaccaagtagctaatttgctttcacaaaaggggatttatccagccttccatatgagcaagcgctactggattagtgtgtcccttgatgatactttatcagatgaagaagtactggaattgatagaaaaaagttggaacttaacctctaaaaaatgaaatattttaataattttcatgaactttcaattagctaaatattctttactgaagagatttttagaaaatataggatttaccacactagaggaatatggtgccatcttcaaatacctgattgagaatgtcaagacggatcgtcagatcatctattcgcctcactgtcatgatgacctcggaatggcagtggcaaatagccttgctgctgtcaagaatggtgcaggacgtgttgaagggactatcaatggtattagggagcgagctgaaaatgctgctttggaagaaattgcagtggctctcaatattcgccaagattactaccaagtagaaaccagtattgtcctaaatgagaccatcaatacgtcagaaatggtttctcgcttctctggtattccagttcctaaaaacaaagccgtcgttggtggcaataccttctcccacgaatctggtattcaccaagatggagtccttaaaaatcctctcacttatgagatcatcacacctgaattggttggtgttaagattctgcttggaaaattatctggtcgccatgcttttgttgagaaactgagagaattggccctagattttacagaagaggatatcaaaccactctttgctaagttcaaggcactggtcgataagaagcaagaaatcacagatgcagatattcgagctttggtagctggaaccatggttgaaaatccagaaggcttccactttgatgatttacaacttcaaactcatgcagataatgacattgaagcgctcgttagcctagccaatatggatggtgagaaagtcgaatttaatgcgacagggcaaggttccgttgaagcaatctttaatgctatcgataagttctttaaccaatctgttcgtttggtgtcctacactatcgatgcggtaacagatggaatcgatacccaggatcgggttttggtcactgttgaaaacagagatacagaaaccatctttaatgcagcagggcttgattttgatgtgttgaaggcttctgctattgtctatataaacgctaatacctttgttcaaaaagagaatgcaggtgagatgggacgcagtgtttcttaccacgatatgcctagtgtgtaaaggagaaggctatggcaaagaaaatagtagctctagcaggagacggaattggcccagaaatcatggaggttggtttagaagttctggaggctctagctgaaaaaacaggttttgactatgagattgacagacgaccgttcggaggtgcagatattgatgcagcatgacctcccttacctgatgaaacccttaaggcaagtagggaagcagatgctatcctactagtagctatcggtagtcctcagtatgatggagcagtggttcgccctgaacaaggcctgatggctctccgtaaggaactcaatctttacgctaatattcgtcctgtaaaaatctttgacagtctcaagcatttgtcaccactcaaactggaacgaattgctggtgtagactttgtcgtggtgcgtgaattgacaggcgggatttactttggatatcatattcttgaagagcgcaatgcgcgtgatatcaacgactatagctatgaggaagtggagcggattattcgcaaagcctttgaaattgcaagaaatcgcagaaaaatcgttactagtatcgataagcaaaatgttctagcgacctcaaaactctggcggaaagtagctgaggaagtcgcacaggatttcccagatgtaaccttggaacatcagctggtagactcagctgctatgcttatgattaccaatcctgctaagtttgatgttattgtaacggagaatctttttggagatattttatctgatgaatcaagcgtcttatctggtacacttggggttatgccatcagccagtcattctgaaaatggaccaagtctctatgaacctattcacggttcagcacctgatattgcaggtcaaggaattgccaatcctatttccatgattttatcagtttccatgatgttgagagatagtttcggacgttatgaggatgcagagcgtatcaaacgtgctgttgagacaagtctggcggcaggaattttaacgagagatataggaggtcaggcttcaacaaaggaaatgacggaagctattattgcaaggttatgaagttagacgaaaaaattactctagtccttttgatttggaatgtcatcattttcttgatttatggtattgacaaatctaaggcaaggagaagagtttggcgcatccctgagaaaatcttacttattttagcctttacttttggtggttttggtgcctggctagcaggaatcatctttcaccacaagactcgaaaatggtactttaaaatagtttggtttcttgggatggtgaccacactagtagccttatattttatttggaggtaatggatggcagggtcttcgagggaatacgctgcttgggctctagcggactatggttttaaggtcgtgattgcaggatctttcggtgacattcattacaataatgaactcaataatggcatgttgccaatcgttcagcctagagaggttagagagaaactagcccagctaaaaccaaccgaccaggtaactgtggacttggaacaacaaaaaatcatctcaccagttgaagaattcaccttcgagatagatagcgagtggaaacataaactcctaaatagtttggatgatatcggtattaccttgcagtatgaagagttgattgctgcttatgaaaaacaacgaccagcctactggcaggattagaaaaaatagaaaaggagatatagtaaactgaaataagatgtaaacaaatgaattggagcttaacatccatttccagcaattttttagaaactacagtggactattctggattcaacacattataaaattatgacaaaacacattcacaagaaggctacgacattttaaaaggtgagggcggatgtatcgtttgccctactaaagttggttacattatcatgaccagtgacaaggcaggacttgagcgtaagttcgcagccaaagaacgtaagcgtaacaaaccaggtgttgttctctgcggtagcatggatgaactttgcgctttagcgcaactcaacccagaaattgaagcattctactaaaaacattgggatgaagatattcttcttggttgtatccttccttggaaaccagaagcctttgaaaaactcaaagcatacggggatggccgtgaagaacttattactgatgtacgtggtactagctgttttgttatcaagtttggaaaagcaggtgaacaattggctgccaagctttgggaagaaggtaaaatggtctacgcctcatctgcttcaatgacaaaacgattgaaactcgctatgagcaaggtgtaatggtgtctatggtcgataaggacggcaaactcatcccagaacaaggaggagcacgttcaacttcaccagctccagttgtgatccgtaaagggcttgacattgataaaatcatgatgcacctgtcagatacttttaactcatgggactaccgtcaggttgagtattattaggatagagaagaagtctagtgttatgagatattaaagctcctaacactgggcttttgtttagaatttcttttctttttctataggatatggtattctatgtagaaaatatatgttaataagtaatgccaatatttaaacatcattagtaaaaggagttagattgatgaataaaagaaaagttagtttagaagatttttataaatggtatagtctaaataaagaagagttattaaataaggcaactgttggtgaaaagtttaatgataaattaaaagaagagtttctccaggaatggcctttggataggattttaacaatgtcaatcgatgaatatgtaataggaaagggacagcaaaataagtctttatgctacgctcttgagaagggaaaatacaaaaatctatttcttggaatttctggtggctcagcttcaaaatttggtatttattggaataaaaaaacaaacaaatataaagatcaagctaataatgagatttcagagttggatcagcgattttcaaaattaaaatcagatttgtatgaaattatcaaagaaggtattcgttttaactttgaaaatcctatttttgatatgaaaagatcaacaaatgaatttattggtcgttctgctatggtgacaaaattactttgtatctatactgagggagatcctttctttggtgtaaatattaatagtcagaaagaattttggaaccactttgtttctcagacaaatcaaggtggaccttatctgcaaaatcataaaataattgaactggtgtccaaaacttatcctgagttggagccatcgaaattaggaactatgctttttgagtattctaagctttttatggaaaataaggaagacaatagtacaatggattcatcaaacaattttcgtcatcaattaactcaatctctattaaagtctccaaacctcatcctccgcggtgctcctggcacgggaaaaacttatcttgctaaagaaattgctaaagaattaacggatggcaacgaagatcaaatcggatttgtacaatttcacccatcatatgattatacggattttgtagaaggtttaagaccagtatcaaatggggatggagctattgagtttaggctacaggacggtatttttaaagatttttgtcagaaagcaaaagaaacccaattgattggaggacaagataattttgatgaggcttgggattcttacttagaatatataaatgttgctgaagaaaaagaatatataacaaaaacatcttacttatctgttaatagtagacaaaatttgtcagtaaattatgatagtggtgttccaggatggtcactacctagcaaatatgtttacgagttgtataaagataaaaattataataagcaagaatactacaaaagtggtggaaaaactgtcctagaaacattgagaaagagatttggtttgaaagactatgtttccccaacagaaattgatactgataagaattttgtcttcatcatcgatgagatcaatcgtggggagatttctaagatttttggcgaactctttttctctatcgaccccggctatcgtggtgaaaaaggaagtgtttctacccaatatgcaaatctacacgaaactgatgaaaagttctatatccccgaaaatgtttacatcatcggaactatgaatgatattgatcgttcagtggatacctttgattttgctatgcgtcgtcgttttcgttttgttgaagttactgtcgagggtcaagctggcatgttggataaagagttgaatatccatgcagaagaagcaaaaattcgtctaagaaacttgaacgctgctatcgaaaatattcaggaattaaacagtcattatcatattggaccaagttattttcttaagttgaaggatgtagattttgactatgaattactctggtctgattatattaagcctctcctagaagactacttgcgaggttcttatgatgaggttgaaactttggaaactttgaaaaaagcatttgatctgacaaataatgagcaaaaagatcaggcagtagctgatgacaatgaaggcgatgaaaacgatgatgcggattactgataatcaacacaagattattaaagaaaaatttgttgaagaatatcctaaactaagcaatcctcttttagacagaaccttggaaagtctatcccaagatgaacgtattttcatttttccaaatgattwgactcatactcctgatttggataaggaccaaaagatttttgaaacagtcaatcagaaaatcaagacagggaacgtgattggttttcttggatatggtcaggaaagattaacgatttcctcacgattttctgatgagagtaatgaccactttttgcattatctcttaaacaaggttcttcatatcaatctcactagtttagatgttgctttgtctcgtgaagagaggctttatcaacttttggtgtatctctttcccaagtatctacaagctgctattcgaaaaggtctttataaggaatatcatcgattttctcataacgacagtcatgttaagggagtgattgatgtaagaaaccatctcaagaaaaatcttcctttcacgggaaatattgcctacgcaacgagagagttcacctatgataatcccctcatgcagttggtccgtcacactattgaatacattaagaatcagaaaagcattggtcaaggggtactagataatctctcaactagtcgtgaaaacgtatctgaaatcgtgcgtgtaacgccctcttataaactagctgatcgtgctaagattattcggggaaatcaatctaaacctatacgtcatgcatactttcacgagtacagaaacttacaagaactttgtctgatgatcctaaaccaagaaaagcacggtttagggtatcaagatcaaaaaatctatggtattctctttgatgttgcctggctttgggaagagtatgtttacaccttgttgccaaaaggttttgtacatcccagaaataaggataagacggatggaatttcagtattttctgttgggaaacgaaaagtatatccagatttttatgacagagaacgaaagattgttctagatgcaaaatataaaaaactggaattgactgaaaaaggaatcaaccgtgaggacttattccagctgatttcctattcttatattttaaaagctgagaaggctggactgatttttcctagtatggagcagtcagtaaatagtgaaataggaaaagtagctggctatggagctcaattgaagaagtggtctattcgaatccctcagaatgcctcattctatagtacattttgtaaaatgatggaaaattcagaagag

SEQ ID NO: 178 - DNA, 4854 bp; double-stranded, linear
catcaccagttttagatggctttaacagtgaaattattgcttttaatctttcttgttcgcctaatttagaacaagtacaaacaatgttggaacaggcattcaaagagaagcactacgagaatacgattctccatagtgaccaaggctggcaatatcaacacgattcttatcatcggttcctagagagtaagggaattcaagcatccatgtcacgtaagggcaacagccaagacaacggtaggatggaatctttctttggcattttaaaatccgaaatgttttatggctatgagaaaacatttaaatcacttaaccaattggaacaagccattatagactatattgattattacaacaataagaaaattaagataaaactaaaaggacttagtcctgtgcagtacagaactaaatcctttggataaattatttgtctaactgtttgggggcagtacacaagaaagcgctttaaaaccagtagaccttttcataaggttcgcttgatgtaccaagatgaggctggtttcggtagaatcagtaaactgggatcttgttggtctccaataggagtaggtccacatgtccatagtcactatatacgagaatttcgctattgttatggagctgttgatgcccatacaggcgaatcatttttcttaatagctggtggatgtaatactgagtggatgaacgcctttttagaagagctttcacaagcttatccagatgattatcttttactcgttatggacaatgctatatggcataaatcaagtaccttaaagattccgactaatattggttttacctttattcctccatacacaccagagatgaacccattgaacaagtgtggaaagagattcgtaaacgtggatttaagaataaagcctttcgaactttggaagatgtcatgaatcaactccaagatgtcatacaaggattggagaaggaggtgataaagtccatcgttaatcggagatggactagaatgctttttgaaaacagatgagtataaaattgaattgcttataaaaaagctccatacactggatgtgtatagagcaatggggctttatttgatatagagttcttggttttttaggacaatttctcggatacttgcaaactttttaagttttttgatttcttctggatgagtgacgagagtgataacataaccttccttgcccatacgaccagtacggccagcacggtgtgtgtaggtttcgctatctctaggaatatcaaagtttacgacacattctaggctatcgatatcaattccacgagccaaaaggtcagttgcaagaagcagggttagttggttatctttaaacttttctaagatgatttttctaaatttaacattaacatcactagcgagggaaacagccaatatatcacgatactgtagtttttcctcggcattcccaaggtctgacaggctattgaagaagactagaccacggaaatcctctacatgagccagttttcgtagcatatccactcgatgacgttggtctacctgcatgtagaaatgctggatattgtccaatttttgatcagagagatcaatagtgcgtgtattcggcacaatcttttcttggtcaaacttggtcgtggcactcatgtagaccagttggtggtcacgaggtgcgtagtgagtgattttttctacaaagtgaatctgagaatcatctagtaattggtcaaattcatccaggatgatggtttccacattcatcatcttgatttttttaagtttaatgagttcaaagatacggccaggagttccaatcagaatttctggcccctttttaagacgttcaatttgtcgtttctgacttgaacctgaaaggaagagttgagcagtcaatccgatagcttctgcccacgttttacatacatcaaaaatctgtccagcaagttccgtatttggtgctagaatcaagagttgttgggcttttttcttttgtagtctgagaagacttggtaggagatacgctagggtcttaccagttccggtttggctcactcctaggaggttttctccagcaagaaggggctcaaatagttgagtttgaatgggggtgaattcttggaaaccgagttggtcactcagttcttgccattcagtcggtagtttggttttcatttttctgcctcaaatctaatgccagcagtctggcgcatggtatatagtagctcatgaacagagcctgcatcatacagccaagtttggtagagattcagatctggttgctggatcatgtgtgcaaatgcagcgacttcctcagtcatcgtatgaggagcctgttggataggaagctggacttgatttccttggtggtcggtaaaaatagctgagcgaatatgctcaatcgtgttgagagtcaaggttccatctgttgtataaatctcgcaaggaagattggaagtgatgttttttccagccttgatgtgaacttgatagtctgggtagaagaggataccatctccatttaggtcaatgctattgtcaagctgttgagcatggtaagtcgcgtcattggcttttccaaaaagacgaacagcagcatagaggggataaatccccaaatccatgagggctccaccagcaaaacggtctgaaaagacatttggtgtttgtccagccaacaagtcaggcatcttggaagagtatttggcatagttgaaatctgctcctaacacttgcttatctgctaaaaagtttttgatagtagtaaaggctttctcgtggtaattacgagctgcttcaaagataaaacagttatttttttcagctgtttgaatcaaatcaaaccattcttgtggttgagagacagctggcttttcgagaataacatgtttaccagcagacaaggcagcttttgcctgagcaaaatgtaaggagtttggactggcgatatagactaaatcaaaagaagatttgaagaagacttctaattgatcgaatagttggatattctgatagcgagaagcaaaggttgctgcagtttctagttttctagaatagattgcgaccagttggtattctccactggtatgggctgcttctatgaaatgatggctgatagcgccagttccgatgacacctaattttagcataaatactccttttccgattttaaatccttctttcattataacatagatagacgggactatccaacagagaggagaaaatttcaaataagctattagctttcttttccgaataaatagatagaagcatagaatctagcaaacctagatttaaaaatgtgctataatagaaggaggaaaaggaggattctcagacatctaggtatcagcccaactaatgatttgtcaatttatccgcgatatgctggacttgccagcaaaaaatgtgacgattttggagggaagtaacattcacgtcttgccttccatgccctactcagcgtaagatttctatactagtatagacgtcttggcggagttagataatggaatccaagttatcatcgaaattcaggttcatcatcagaattttttcatcaatcgcctatggccttatctgtgcagtcaggttaatcaaaacctagaaaaaattcgccaacgtgaaggtgatacccaccagagctacaaacaaatcgcactagtatacgctatcgcaattgtcgatagtaattacttctcagatgacctagcttttcatagttttatagtaaaatgaaatgagaacaggacaaatcgatcaggacagtcaaatcgatttctaacaatgttttagaagtataggtctactattctagcttcaatctactagaaattccatagatagaaaactacataatctctacagatacggatgttggagttgatgtaagatgctttggcttgctagaggaattgtggattgccaaattgtatcattgaaattattgctcaaatttgttatgatataaatatgaataaaagtagactaggacgtggcagacacgggaaaacgagacatgtattattggctttgattggtattttagcaatttctatttgcctattaggcggatttattgcttttaagatctaccagcaaaaaagttttgagcaaaagattgaatcgctcaaaaaagagaaagatgatcaattgagtgagggaaatcagaaggagcattttcgtcaggggcaagccgaagtgattgcctattatcctctccaaggggagaaagtgatttcctctgttagggagctgataaatcaagatgttaaggacaagctagaaagtaaggacaatcttgttttctactatacagagcaagaagagtcaggtttaaagggagtcgttaatcgtaatgtgaccaaacaaatctatgatttagttgcttttaagattgaagagactgaaaagaccagtctaggaaaggttcacttaacagaagatgggcaaccttttacacttgaccaactgttttcagatgctagtaaggctaaggaacagctgataaaagagttgacctccttcatagaggataaaaaaatagagcaagaccagagtgagcagattgtaaaaaacttctctgaccaagacttgtctgcatggaattttgattacaaggatagtcagattatcctttatccaagtcctgtggttgaaaatttagaagagatagccttgccagtatctgctttctttgatgttatccaatcttcgtacttactcgaaaaagatgcggccttgtaccaatcttactttgataagaaacatcaaaaagttgtcgctctaacctttgatgatggtccaaatccagcaacgaccccgcaggtattagagaccctagctaaatatgatattacaagcggggt

SEQ ID NO: 179 - DNA, 2186 bp; double-stranded, linear
taaacaggtgttaggtgctctaaactattaaaattctaaggaaataaggctactttttctgggtcttgttcatagtaggtgtggttctttttttcgagtgtagcccatagctttgagcgcatagtggatggtagttggatgacagccaaattcagaagctatttcagtcaaataagcatctggattgtcagtaagatagtttttaagtctatctctatcaacttttcttggttttgttccttttacttggtggtttagctctcctgttttctcttttagctttaaccagccataaatggtattacgtgagatttggaaaacgtgtgatgcttctgttatactacctgttcgctcacaataagagagaacttttttacgaaaatctattgaatatgccataagaagattataccacattgtgtactatttttggttcattttactatatttctaaacacttagaaataataaaacaaattaaatattatttctaaatatttgaaaataacatctatttgtattatactatctttgaggtaactattatgaactatatcaaaagaccacattatttagattttttaagaaaacatcgtgaccgaccaatcatcaaagttgtgagtggagttagacgagctggtaaatctgtgctttttcaactctataaagaggagttactagcaactggggtagacgaggatcagattatattcatcaatttcgaagatttgagttactatgatctgcgacattttcaaacattattcgcttatataaaagatcaattagttagcaagaaaacatactatatctttttagatgaaattcaatatgttgaaaaatttgaactggtagcagatagtctattcatcttagcaaatgtagacctctatttgactggatctaacgcctactttatgagtagccaattagcaacaaacttgactggtcggtatgttgagatagaggttcttcctttgtcatttgaagaatatctatcaggtcaatctctcacagagaatctgaatacaacagaaatttttaacaattatctctttagtgctttcccttacttattgcaaacatcatcttacgatgaaaaaattgactatctcagaggaatatataactccatactgttaaatgatattgtcactagattgggaaaaccaaatcctactattattgagcgcattgtccgaacccttctcagtagtacaggtagcttaatatcaacaaataagattcgcaataccctagtcagccaaaatgtttcaatatcccataatactttggaaaattatttgacaactttgacagatagtttacttttttattccgttccacgttttgatgtaaaaggtagagcattattgcaacgtttagaaaaatattatcccgttgatttaggtttacgacatctcttattaccagaccagaaagaagacattaggcatatcttggaaaatatggtatatttggaattgagacgtagatattcacaagtatatgttggtaatttagataagtatgaggttgattttgttgttgtaactgatcttggccactacgcttattatcaggtcagtgaaacaacacttgctccagaaacactagaaagagaacttagaccactagaagccattaaagatcaattccctaaatatctattaacaatggatacgattcagccaacagccaattacaatggaatcgagaagaaaagcattatagattggttactagaaaaatagataaatataaatcatacagctaattagatttgcaacagtctgttatcaatgattctacccaaatcctaacaagatatagtgaatttcgaatacgctatataatacggacacttgaaaatagaaattggggatgaaaggggatctataatttctggaagtactatcaaaaattaatatcatagtcttattagagaatagcatcacccactttctcaaataagattaaattgtaactgaattataatgaaaaagagactgagcaatcagtctttaaaatcagaaaagcgcatagtatcaggtattgaacaaccttgataatatgcgttttattatggaaatatttgcttcattttctcctgaaatagagcttttgctatcctatttttctctatttctaatgatttacttcaacttcttacctcttgggaaaaa

SEQ ID NO: 180 - DNA, 3236 bp; double-stranded, linear
gtcacacgtttgacttcacgtatttcataagtataaactttatttttatcggttagataaatcttcatgccatttttagcattatctaaaggagaaaataacattttattagcattatcaacaccaaagatatggtgactagctagactataatttccttctcccattacttgctcgcgtttcattgtaccagctccgtagaagagattaacattatcaagtcctttaaaaatcggcaaattcatttccaattcaggaattgcaattcccccaataactggtaatttttgagcatcccattgagaagttagaacagcttccgaagagatagctttgacagaatcaaagtcaaaattgccttctgtatcctgattttcttctaatttttcttttgatacctggctaacttgatacttattggtattccagactatgaaaatatttcgaatttgagtattaaaaatcaaagccagtgacagtaatatcagaaatcctgctaggatatttgtcagcagattttttcgcttgtttttctttttattatttttttgagacattatgcttcaccttctgtttcgttttctgtcccaacttcttctttttctgccaccgcaaccgttgtgaaagtcactatctgagcatcttgatccaggcgcattactttaactcccatagttgcacgtcctgtttgtgaaatattggcaagattggttcgaatcatgacacctgtatcagtgataatcatcaaatcctcatccccttgaacagtcataagaccggccagcaagccatttttttcggtaattttagctgtctgcattcccttaccaccacgaccttttgttgggtattcagtagcgactgtacgcttaccatatcctttttctgtgataataagaacctcatcttgatcagtaatcaagctggcaccaacaactgtgtctccttcacgaaggttaacacctttcacaccagtggcgatacggctcataccacgaacggctgattgattaaagcgaactgcataaccaaacttggtaccaatgataatatccatatctccttctgccaacaagacattgattaactcatcttcatcctttaaattcagcgctttgagaccattttgacgaatattggcaaactccttaacactggttctcttcacaataccgtgacgggttgtaaagaagagataagcatcatcactgcgatcagactcaacattgataaccgtctgaatactttcgtcttcatccaatttcaagagattgactactggtagccctttggcagtccgaccatactcaggaatttcataacctttaagacgatagacacgtcccttgtttgtgaagaagagcagatgatcatgggtgctagttgacactaactcacgaacaaagtcatcatctttcactcccgttccttggacaccacgacccccacgtttttgagcagtgaactcgtcctgatccaaacgcttaatgtagcctctgttagaaagggtaatcaagacatccgattcttcaatcaagtcctcatcctcgagactcaagacctgtccaatcatcaactctgtacggcgcttatcagaaaatttacgtttaacttcatccaattcgtctttgataatttgagaaacacgttcaggcttagcaagaatatctgctaaatccgcaatcagagccaagaggtcatcatactcagattgaatcttatcgcgttccaaacctgtcaaacgacgaagacgcatatcaaggatagcttgactttgacgttcagaaagcttaaacttgctcatcaactcagcttgagcttccgcatccgtttcactagcacggatgatacgaatcaytcgtcgatatggtctagcgcaatcaagagaccttctaagatatgagcgcgcgcttccgctttttccttatcaaaacgtgtacgacgaacaaccacttctttttggtgctcgatataagcatccaaaatctgacgaagagacaaaattttcggtataccattttggatagcgagcatattgaaaccaaaattggtttgcatttgggtcattttgaagaggttattgagaataacattggctgaggcgtcgcgcttgacttcaataacaaatcgaacaccttcacggtttgactcatcacgtactgctgtgataccctcaatgcgtttttcctgaaccaagcgaacaatatgctcatgcaccttggttttattgaccatgtaaggaaattctgttacaacgatacgctcacgaccagtcttagtcgtttcaatctctgtacgagaacgtaggacaatcgaacctttacctgtttcataagccttatggatacctgatttccccatgacaagagcaccagttggaaaatctggtccaggcaagacttccatcaagtccttggtagtcacttcaggattatccatgaccaacttcactgcatcaatggtttcacccagattatgaggtggaatattggttgccatcccaaccgcgataccagttgctccattaaccaaaaggtttggaaaacgcgctggcaagaccaagggttcccgttcattggcatcatagttatcaacgaaatcaactgtatttttgttgatatcacgaagcatttccagagcaatcttgctcatacgtgcctcggtataacgttgagcggcagcactatctccatccatggaaccaaaattcccatgaccatctacaagcatgtaacggtagctccaccattgagccatacggaccatggcttcataaatagaggaatccccgtgtgggtgatatttacccatgacatcccctgtaatacgagcagattttttatggggtttgtctggggtcacacccaattcattcattccgtagagaatgcgacggtgaacaggttttaagccatctcgaacatcaggaagagctcgcgctacgataacactcatggcgtagtcgataaaacttgccttcatctcctttgtcagattgacattcactaaatttttatcctgcattaataaatgcctcatttcacaattagtaagtaacaacattataccataaattcccatctatttcagcctctaaaccactaaaacgtttacatcgagaactataaggcatattcgtgacaaagttttttaaaagtgatagaatgaagttgtctagggaaaacccctaatagaataaggagatggttanacaatgactctgactaacacacaaa

SEQ ID NO: 181 - DNA, 8651 bp; double-stranded, linear
aggtcctgaagtattggaacaggaaggtcaagagtttttggaacatttcaaaaaactcttggagtcagttgaagtagtagccatctcaggtagtctgccagctggccttccagttgattactatgcgagcttggtagaacttgctaatcaagctggcaagcatgtagtcttggactgctcaggtgcagcacttcaggctgttcttgaatcaccccataaaccaacagtcatcaaaccaaataatgaagaattgtctcagcttcttggaagagaagtttctgaggatttggatgaattaaaagaagtacttcaagaacctttgtttgcagggattgaatggattatcgtttcacttggtgccaacggtacttttgccaaacatggtgacactttctacaaggtagatattcctagaattcaggtggtaaatcctgttggatctggagactctactgtggcaggaatttcttcaggacttcttcacaaagaatcggatgcagaattactcatcaaggcaaatgtccttggtatgctcaatgctcaagaaaaaatgactggtcatgtcaacatggccaactatcaagctctatatgatcaattaatagtaaaagaggtataaaatggctttaacagaacaaaaacgtgtacgcttagaaaaactttctgatgaaaatggtatcatctcagctcttgcatttgaccaacgtggtgctttgaaacgcctcatggttaaacaccaaacagaagaaccaactgtggcccaaatggaagaacttaaagtcttggtagcagatgaattgactaaatatgcttcatctatgcttcttgaccctgagtatggacttccagcaactaaagctcttgatgaaaaagctggtcttctccttgcttatgaaaaaacaggttatgacacaacaagcacaaaacgcttgccagactgcttggatgtttggtctgcaaaacgtattaaagaagaaggtgcagatgcagttaaattcttgctttactatgatgtagatagctcagacgaactcaatcaagaaaaacaagcctacatcgaacgcatcggttctgagtgtgtggctgaagatatcccattcttccttgaaatccttgcttacgatgaaaaaattgcggatgcaggttctgtagaatacgctaaagtaaaaccacacaaagttatcggcgctatgaaagtcttttcagacccacgctttaacattgatgttttgaaagttgaagttcctgttaacattaaatatgttgaagcktcgctgaaggtgaagtagtttatacacgtgaagaagcagcagccttcttcaaagcgcaagatgaagcaacgaacttgccatacatctacttgagtgctggtgtatcagctaaactcttccaagatactcttgtatttgctcatgaatcaggtgcgaactttaacggagttctttgtggccgtgctacatgggcaggatcagttgaagcttacatcaaagatggtgaagcagcagctcgcgaatggtcgcacaactggatttgaaaacattgacgaactcaacaaagttcttcaaagaacagcaacttcatggaaagaacgcgtgtaagaaagtcctcctagtttaggaacatgaatctaaaaaaatttaaaaaaagttgtatgtaaaggcttacaaaataacttacttgtgctatacttaaatcacaagttaatatgaattagaaagtaactatatgaagtataataaaaataggatatagtttattttacgagctaggaaggaaaaatacggaaacaatattgccagaataaactatatttagatgcacatttcattcattgttttataaaaggagaagataaacggctactaaaaagagttttaaagcgttagttgtaggactaggtattgtttcaatattcttatcagccttacctatggttagtggttctgtatttgcagatagtgccctaactacagtagataaagcaaatgatattgttttgaatgttgatgggaataaattttataatgtttcggtttcagaagatattgtaaatgctggtcaaattttggaagattatttttatgtagataaatttggaaatataaatttaaaaggcactcctgaagagttagcaaaaaatattggtatttctgtacaagaagcaagtttgatgtatggagctgtaaaagagttacccaacgtttacgaaagaggtcctgtaggttttcgtttcaatcttggtcctcaagtgagggggatgggtggctgggctgctggagctttcgctactggatatgctggatggcatttgaaacaatttgcggttaatcctgttacatctggatttgttgctgtaataagtggtgcgattggctgggctgtaaaaactgctgtagaaaattattggacagttgctgtagctacagtagaagtgccgtttgtgaaccttgtttacaccatagatttaccttagaggttatttctttatgaatcattcttttaaaaaaataactgtattttgttttatagtttcttgtgttctttgtttattagacttaatgaattttaaaaatgtagctacttttttatttttctgtcttcctgtttttgttttgatttacaaaaataaataaaaacagagcctctgtttgatgaattttagaacatagttaagttttaaaaaaagttgtatgtaaaggtttacaaaataacttacttgtgctatacttaaatcacaagttaatacaaggtgagtgttactaagtaatattaggcatgatcacaggtgaattagaaatcagctgattttctagttcatttgtggtcattttttgtacttatatacctttaagatataaaaggaggttgacatgtatcgaattctaaatccaatgaatcacaatgtctcgcttgtcagaaatgataagggagaagaggtgattgtaattggtaagggaattgcattcggaaagaagaagggggatttgattgctgaaaatcaggttgagaaaatctttcggatgaagaccgaagagtccagagaaaactttatggctcttctcaaagatgttccgcttgattttatcacagtgacctatgaaatcattgataagctatcaaagaaatatcattatccgattcaagagtatctctatgtaaccttgacagatcatatttactgttcttatcaagctctaactcaaggaaggtacaaggatagtaatctgccagatatttccgctaagtatcctgtcgcttttcaaatcgcaaatgaagcttttgaaatttaccgtcagaagctagcagatcattttcctgaggacgaaattattcggattgcttatcatttcattaatgctgaaggtgaaaatgaagtggaacttgtggagtcgattgataagaggaaagaaattctcaggaatgttgaagaagttttaacggactatgcaattcaacgaactaaaaagaataaccatttctatgatcgctttatgatccatttgaattatttcttggattatttagacagatctagagatgataaccaatcacttctggatatggaagatcatattaaacaatcctatccaaaagccttcgagattggttccaagatctatgatgtgattacgcaacatacgggtcttgatttgtataaaagtgaacgagtttatctagttctacatatccaacgtttattgtcataaaaatttatttaaaactatataaggagaattctatcatgaatagagaagaagtaacattgttaggttttgaaatcgtagcctatgctggcgatgctcgttcaaaactattggaagccttgaaggctgctgaagctggtgattttgaaaaagcggacgctctggtagaggaagctggtagctgtattgcagaggctcaccacgcgcaaacaagtctattgactaaggaagcttcaggtgaggacttggcttatagtgtaaccatgatgcatggccaagaccacttaatgacaactatcttgttaaaagatttgatgcatcatttaattgaactctacaagagaggagttcaataatgaataaactaattgcatttatcgagaaaggaaagcctttctttgaaaaactatctcgtaatatctatcttcgtgctattcgtgatggtttcattgcaggtatgcctgttattctcttctcaagtatctttatcttgattgcctttgtaccaaactcatggggctttaaatggtctgatgaagttgtagcctttctgatgaaaccttatagctattctatgggtattctggctctcttggtagctggtacaacagctaagtcattgactgactcagtaaaccggagcatggaaaaaaccaatcaaatcaagtatatgtcaacattgttggcagcaattgttggtttgttgatgttggcagctgatcctatcgaaagtggtctagctactggattcttggggacaaaaggtttgctttcagccttccttgctgcctttgttactgtagccatctataaggtttgtgttaagaacaacgtcactattcgtatgcctgacgaagttccaccaaatatctcacaagtctttaaagatgtgattccattcactctatctgttgtttctctttatgctcttgacttattagcacgttattttgttggttctagtgtggcagaatcaatcggtaaattcttcgcaccactcttctcagcagcagacggataccttggtattaccattatctttggtgcctttgccttcttctggtttgttgggattcatggtccatctatcgttgaaccagctatcgcagctattacctatgccaatgccgaagttaacttgaaccttctccaacaagggatgcatgcagacaagattcttacttctggtacacaaatgtttatcgttaccatgggtggtacaggtgcgacattggtcgttccatttatgttcatgtggttgacaaaatcgaaacgtaaccgtgcaatcggacgtgcttcagtagttcctaccttcttcggtgtaaatgaaccaatcttgtttggtgcacctcttgttttgaatccaatcttcttcattccatttatctttgctccaattgcaaacgtatggattttcaaattctttattgaaactcttggaatgaactcattcactgctaatctaccatggacaactccagctccactaggtctagttcttggaactaacttccaagtgctatcattcattcttgctgcccttctaatcgtggttgacgttgtcatttactatccattccttaaggtctatgatgaacaaattcttgaagaagaacgttcaggtaagtctaatgatgaattgaaagaaaaagttgctgcaaacttcaacactgcaaaagcggatgctattcttgaaaaagcgggtgtcgatgcagcacaaaataccatcactgaagaaacaaatgtcctcgttctctgtgcaggtggaggaacaagtggtctccttgcaaatgctttgaataaggcagcagcagaatacaatgtccctgtgaaagcagcagcaggcggctatggtgctcaccgtgaaatgttaccagagtttgatcttgttatccttgcccctcaagttgcttcaaactttgaagatatgaaagcagaaacagataagctcggtattaaactagcgaaaacagaaggcgctcaatacatcaaattaactcgtgatggaaaaggtgctcttgcattcgtacaagcgcaattcgattaaggctagagactctgaaatagtctcccatcgttacggaaatcgctatggcgaatttcctattattaattcgtcggtaaaaagatatcgtttttacctcctcatgtcacaattcggtgacttggtacaagaagtgagatggagaaggatggctcactgactcctctcctctcacttttactttatttaaatcaagaaataggtgaaaaaaatgacaaaaacacttccaaaagactttatttttggtggcgcaacagctgcttatcaagcagaaggtgctacacatactgatggaaaaggaccagttgcttgggataaatatcttgaggataactactggtacactgccgaaccagctagtgatttttacaatcgatatccagttgacctcaagctagcagaagagtatggtgtcaatggtattcgaatttctattgcttggtcacgtattttcccgactggttacggccaagtaaatgctaaaggtgttgagttttatcataatttatttgcagagtgtcacaaacgtcatgttgagccttttgtaactcttcatcactttgacacgccagaagctctccactcaaatggagacttcttaaaccgtgaaaatatcgaacattttgtagactacgctgccttctgttttgaagaatttccagaagtaaactattggacaacctttaatgaaattggaccaatcggtgatggtcaatatttggttgggaaattccctccaggtatccagtacgaccttgccaaagtctttcaatcacaccacaatatgatggtgtctcatgcacgcgcggtaaaattgtacaaagagaaaggctataaaggggaaattggtgttgttcacgccctgccaactaaatatcctctagatcctgaaaatccagcagatgttcgtgcagctgagttggaagatatcatccacaataaattcatcttagacgcaacttatctaggtcgctattcagctgaaaccatggaaggtgtcaaccatatcttattagtcaatggtggtagtttggatcttcgtgaagaagattttacagcattagaagctgcaaaagacttgaatgatttcctaggaatcaactactatatgagtgactggatggaagcctttgatggagaaactgaaattatccataatggtaaaggtgaaaaaggaagctctaagtatcaaatcaaaggtgttggtcgtcgtgtagctcctgactatgtaccacgcacggattgggattggattatctaccctcaaggtttgtatgaccaaatcatgcgtgtgaagaaagattatcctaactacaagaagatttacatcactgaaaatggtctcggctataaagatgagttcgttgataacactgtttacgatgatggtcgtattgattacgtgaagcaacacttggaggttttatctgatgcgattgcagatggagctaatgtaaaaggttacttcatttggtcattaatggatgtcttctcatggtcaaacggttatgagaaacgttatggtctcttctacgtagattttgaaactcaagaacgttatcctaagaaatcagctcactggtacaagaaagtagcggaaactcagattatagactagtagaattagtcattagatatagaattttagtgagtcaaaaagatgttcaaagattttatccaatctatttatgaaaaaaagtttatattataaatttcgaaaaatgctctcaaataccgtgtttgacgagtgaagaattgaaaagtcttggaaaatggtatgtctcgactggtaaagaatggatttgtcattcagatgatgagctggaagaatttaaaaatctatttttaaattttatcaatcctgaagaatgggatactatctcctttgattcagattttatgccgtttcaacaatcgtaaccaatttctcaaaaaagttaaatcttatatttagtactctgtaaaactcttatctaatcacgttgcttatactcaatgaaaatcaaagagcaactttaaactaggaagcgagtcgcagatttctcaatgcatagctttgaggaattgggcaaaaagtctttgatatagaaaaacgcatagtatcaggtgtttcaacacctgatactatgcgttttattgtgggaagatttactttttttcttctgaaattgagttgttacccaggctctttcagtttattaaggcttgatgactttaatgtgtttagatagcttaaaaaggattgaatcacttagtttagaatctgaaacaatagtatcaagatttgatacattataaaaagtataaaaatcaaacttattgaacttgctatgatctgcgagtaaatattttttattagaattatttaaagcgatgcgttgagcctctccctcttcctcgctaaaagtagctagagctccgttttgaataccattacagctaacgaaagctttagaaaattggagattagagagattttgtagggtcaatgtaccaacaaaagcacctgtaatatcgcgataatttccacctattaaaatcaaatctgttaattttcgttcgcttaaaatcagaaaaacaggtagactgttggttacgacgcggatattgtcaataggcaactcacgcgcaaaaaactctaatgttgttcctggtccaatgaaaatagtttctctttcttctactagactgcctgcaaaatgggctatttcttgtttttctgccgtttggagggcttgtttttcaatatttgatcgctcattagtcaaaagggagttggttcgaagtttttcagctccaccatgcacacgaatcagcaaatctttatcagctaattcctgtaaatagcgccttgcagtcatatctgaaacggctatttcgtccataatctgtttaactgttat

SEQ ID NO: 182 - DNA, 3786 bp; double-stranded, linear
aatctccaatcagtgccacttcagctacaaagaagaggaggataataactccgttcacaaggacagacaagaataattgatagaaggagtcggtttcacttgcttgacttggtcttgtaatgatwtggagactggcaagcagaatgattccaatgctaatcacacacaagagggctgtaaatcgtaggctatcaaagaaagcaaagaaactagcaatagcagtgaggamgattggaattgccaagagttgactatattgttggagaaccttgtctagcgtccagtccttttcctggtggataaatcgtctcacaacgaaactacccaagaggaatgaaaagaagaagagtgttgtcgctactaggatagagatgatagaaaaaagagttaaaggagctagctgctcagggaagcgactgttaatgcttgctatatgtccatagtaagcatgtttgatgtgatagatactaaagaaaaaggaagatgcagaaaacagaatgagcaagagaaaggctgtgtaactgtgtgtgatacttgtttccaacttacttgtaggagatttgatcgcttccactagccaagaccaaaaatcaagcacttgctctttccatttatccctagattttggagcttggtcggggatataaggactttctaaagatttactgataagaagtggctctttcgtggttgctttttgctgaggaagagcttcttggctctcttcagctatagtgactttttctgtttctttagaaaggtctggctcttcttcagtagaattagatgccttcttttcttctatttctgttctcgcttcactgtcttcaggagcttcaattttctcttcttgctggctttccaattcgacttcagcttgagggacttcctcctctaactgagtatttttttcaattggtgtatcgagatcggctatcgtttcttcagccttgtctgcaacctcttgagcttgctcttcaggcttgttcttgcttgttgtttttacaaaatcattactttcaaaccattcttgtttcatggtagaacctcctttttagttagataaatatgtttccatagtagcaaatgtaagcgtttttgtcaacgtctgcttggtgtggatattagatcaatattatcatcagatctcgcaatgagttgatccttgacatcggttttttcagttttgtaagggttgcttaattccgtacctcttgattcaggcttttctcttgtgaattggaagatagaaccatagttgcttgagatgtcccagttaattcgttggctttctttctggtctaggatgattctgagataatctttggcagtcagttcaaccttgccatggacttggatattttcagcgtggaagtgattctctgttgactctagctgactatctgtaagaactgtatcaaagatattaacgatattgggcgttgtgagtttactgtttttgatacgacttccttcaattcggaggatatagctgtttgtattgagggtcgcattttcaaggctagcatttatgatggtggtttgtccgcgattggctgagatgttgatcccttttagagttctcccttttggtagtcggagaataacttcttcaaaacgactagagtagctacttgcgatatgaagaatcccaccaattccagaagagagaaacggagtttcagacagtttcttatcagtgagactcagagttctatcgttctgattggtgataagatcatggtgagcagaaagagatggatggtaagaaatgtggatttgatcatcgaaagagtctgtgatggtgagcgtgtgttggtggagagtaatttctaggttttcgacttccttgccaaaggttagcttttccgtacggctatcatagacaggttctttggacatggaaagtaggctcttaatcccgtcagattggatacctacaaaaagcaggataaagccgataacggtagtcaccacaccaaagatgagaaatccttttgtccatttacgcatgctgattacctctctttccttttttaagaacaaattgtaccagacgaacaatgagtagaccgaagaagcgagttgcataggaaatgccaagtaaaactagcgaagaagcaccgatagccagtaaaccagaaccaaaaatcaagataaaggctgatttggcttgggcgaggacagtgaaactttcaactaaaaataggaatccgccgatgatacccagtatggaaactgcaaagaaagccagaatgacagtcaaagcggctacaagaattgcgaacagggtcacgaggatggcgattcccagaggaatgccgataggtgctgcaaggagggctaacaaggcgatatgtaaaatttgtcggttatttttttgagcgggtgcttcattgatttttttatcgagaagattggatagaacttcgtgggccgcttctttgggagttcccaaactagcgatgagttcttcttctccttcgactccagcatcgtcaaagagctctctgaaatagtccatggcttcgatacggtcagcttcaggtagtttcttgagatagagttctagctgagtcaggtattcagttcttgtcatggcggatactcccttctatgatgccattgatggtgtctgtatagagtgcccattcatcttttagggtcaagagctgctctataccaccgtttgtcaaggagtagtatttgcgcatgcgaccttggaactctctagaataggttgtcagaaagctattgccttccaattttttgagaatgggatagagtgtggattctttgatattagcgatcagcttaatggtttggctaatctcataaccataagaatcaccctgctccagtacagccaagatgagaaattcaatcaaggcagaggatgttggaaagtacatgggaaacctccttttctaatgtgtaagatttttatatataatttttctacacatacattgtacatctaaaagaaagccctgtcaagagaaatgtgtaaaatttttatatataaaaaacttctagctaaaactagaagtttaaaggatcttatccgctctgtccactgtaaagagggccacagtcatcaggatatcgatgagcaagagggcagctacagatggtacccaagagtggaacaggtcaaaactgtaaccaaagagggttggcccaaaggctgctaggatatagcctcctgtttgagataggccggacaattgggctgtcttttcaggggcgcttgtcttgagtgaaaagttgaccatgagataagggaagagggcactggttgcggttccgatgaggagatggatggcaagccagtaaatgaaattattgattgggaaaaagagcatggaaatgccgaccacaccagctagtgaaaccagagtgagcatgagctgacggttgcgagtagataaactggttgtcaggcttgggatggtcattgaaaaaggaatgctaatcagagataagatagaagtcagcaagccagcttcgtgactggatagacctgcatggatagacatggtaggtaaccaggtcatgacggtgtaaaagatcaaggattgaaaacctgaaaagataataattgcccaaacctgtttattacgcatgacctttatttgacttttttgtttggtttgtggagctagtctatgattatagcggtgatttgggagccagaccaaaaaagttgctagacagagtaacgtgaggagaaggataagtcctttccaagaactggcttgtgtaatgggcacagctagataggaa

SEQ ID NO: 183 - DNA, 3054 bp; double-stranded, linear
tcagctaaaaaacattgctaaattgattgaagctggtgctacacattccgattcaacttctcacacggcgaccaccaagaacaaggtgagcgtatggcaactgttaaacttgcggaaaaaattgcaggtaaaaaagttggtttccttcttgatacaaaaggacctgaaatccgtacagaattgttcgaaggtgaagctaaagaatattcatacaaaactggtgaaaaaattcgtgttgcaactaaacaaggaatcaaatcaactcgtgaagtgattgcgttgaacgttgctggtgctcttgatatctatgatgatgttgaagttggtcgtcaagttttggttgacgatggtaaacttggtcttcgtgtggttgctaaagatgatgcaactcgtgaatttgaagttgaagttgaaaacgatggtatcatcgctaaacaaaaaggtgtgaacatccctaacactaaaattcctttcccagctcttgctgaacgcgataacgacgatatccgtttcggtcttgaacaaggtatcaacttcatcgcaatttcattcgtacgtactgcaaaagatgtgaacgaagttcgtgcaatctgtgaagaaactggaaacggacatgttcaattgttcgctaaaatcgaaaaccaacaaggtatcgataacttagatgaaatcatcgaagcagctgatggtattatgattgctcgtggtgatatgggtatcgaagtaccgttcgaaatggttccagtttatcaaaaaatgattatcaagaaagtcaatgctgcaggtaaagttgttatcactgcaacaaacatgcttgaaacaatgactgaaaaaccacgtgcaactcgttcagaagtatcagatgtattcaacgctgttatcgacggaactgacgctacaatgttgtcaggcgagtctgcaaacggtaaatacccactcgagtcagtaactacaatggctacaatcgacaagaacgctcaagctcttcttaatgaatacggacgtcttgattcagattcatttgagcgtaactctaagacagaagtaatggcttctgctgttaaagatgctactagctcaatggatatcaaattggttgtaactcttactaagacaggtcatactgcacgtttgatttctaaataccgtccaaatgctgacatcttagcattgacatttgacgaattgacagaacgtggcttgatgttgaactggggtgttatcccaatgttgacagatgctccatcttcaactgacgatatgttcgaaatcgctgaacgtaaagcggtagaagcaggtctcgttgagtcaggcgatgatatcgttatcgttgctggtgtgccagtaggagaagctgttcgcacaaacacaatgcgtatccgcacagtacgttaagaaaaatataaaaacctatcatatccagctttagagcttgtgtgataggctttttgtatagagggtaagaaataggcaaaactttcataatggattgatactcttcgaaaatctcttcaaaccacgtcagcgtcgccttaccgtatatatgttactgacttcgtcagttctatctacaacctcaaagcagtgctttgagcaactgcggctagcttcctagtttgctctttgattttcattgagtatgaaataagatatgcacaaattgattagaaagtcaaatgaatttctacaaatgttttagcaatcgtaatgtacttgtctagattcgatctgatatattttcgatttaatgatatggtatttaaaacctccaaagtagcttactccattcttttacttacgtgagtgtagatgttatttactgttttagcgtttttgtgttccactctaaccattatagcattcttctcagctagtgtactaaggagtgtgtgcctgaaaatatgggaactaaggggctggtttatcggtttctctagtttagtatttgccttttgcaaagtgatcttaaatgcctttctctaaatttacatatcactattgtttaacaaaatctaatctattttaggtcacttattctttttttgaaatgtagaatgaactttttcaaagtttttcgaatcttttaaaatctgtttgctttatatcgccattctccccccttttttaattctccctatatagcctgacagctttcccgatggtacgaatatggttgctttcgtctaggtggatgtcggggtattcgggattgagtttttttgaggcagccttggcggagtttcttgacatagttagtgccgtctacttggaagatgccgatggtattatagtcaatctgtggggtattcttgataaataggtagtcgctgtttcttatctttggctccatggacttgctgacgacataagcgattgggtcgtagtcgtctgggataatggaaactccatatctaaatcgttgtcctgcatcgagcggctacctgcagagataaactacctaacacgagagtaagtagtctgtctgtagtcgtccagtctgatgatttttacgatacttcgtttttctgatcatacagttgcctctcggcataggtcagaactttaccttgtctgggtggttcccgttggtcgtagatagattggatatcgctaggagaatccttttgaactggaggaaagagggcatcgatcaagctactgaatactttaactaagtcaaatatagtatttttcttagtagacctaacccttttttcataatttctaatggtgtttttacttatacctatcttagtacccaattcttattgagtccaaccattactagtctatattgttttatagttgattgagtttggaatagtacgctgtagctgctaaaacatttctagaaattaatttgactttcctaatagagttgttcatatcttatttcaatctattatgtttttcacctctaacaatcgcaatctcttctttatccatgaatgaaatcgctttctatttttgtaagtaaagcataacacgaaatccacgaaaatgaaaacctttgttgtgttttcgtaaaaaatttgttgacagagcacgaaacgc

SEQ ID NO: 184 - DNA, 1590 bp; double-stranded, linear
tgtgattttcygaaaatttggtaaaatatatcttaatcattttcaggaggacaaaaatttgacaagatatcagaatttagtaaatggaaaatggaaatcatctgaacaagaaattacgatttattcaccaatcaatcaagaagaattgggtacagttccagccatgactcagactgaagctgatgaggctatgcaagctgcgcgtgcagccctgccagcatggcgagctttatcagcagttgaacgtgcggcttatttgcataaaacagcagctattttagaacgcgataaggaagaaattggtactatccttgccaaagaagtagcaaaagggattaaagcagcaattggagaagtagtgcgtacagcagacttgattcgttatgctgctgaggaaggtctccgtatcactggacaagcaatggaaggtggtggttttgaggcaacaagtaaaaacaaactggctgttgtccgtcgtgaaccagttggtatcgtgctagcgattgctccctttaattatccagttaatttatctgcttctaaaattgcacctgccttgattgcagggaatgtggtcatgtttaagccaccaacacaaggttccatttctggactcttgttggctaaagcatttgaagaagcagggattccggcaggtgttttcaacaccattacaggtcgtggttcagaaattggggattatatcattgagcacaaagaagtcaacttcatcaactttacaggttcaactcctattggagaacgtattggtcgtttagctggtatgcgtcctatcatgttggaacttggtgggaaagatgcagctcttgtactagaagatgcagatttggaacatgctgccaagcaaattgttgcgggagcctttagctactcaggacaacgttgcacggccattaaacgtgtcattgttctcgaaagtgtagcagataaattagctactttgcttcaggaagaagtttctaaattaacagttggtgatccatttgacaatgctgatattacacctgttattgacaatgcttcagccgacttcatttggggcttgattgaggatgcacaagaaaaagaagctcaggctcttacaccaatcaaacgtgagggcaatcttctctggccagtgctttttgaccaagttacaaaagatatgaaagtggcatgggaagagccatttggtcctgttttaccaatcattcgtgtggctagtgtagaggaagctattgcctttgccaacgaatctgaattcggccttcaatcatcagtctttacaaatgatttcaaaaaagcctttgaaattgctgaaaaacttgaagtaggtacagtccacattaataataaaacccagcgtggtccagataatttcccattccttggtgtcaaaggttctggagctggagtgcaaggaattaaatatagcattgaagcgatgacaaatgtcaaatccattgtttttgatgtgaaataacgtgtaaaaccaggaaattgttttcctggttttatttttttgctataaaataataataattatagaaaaaatacgaactttttggtattataatagattgaaaccgg

SEQ ID NO: 185 - DNA, 4848 bp; double-stranded, linear
cctgcagttgtcagacctgtaattttctttttatctgtaataagaatcgttccagcgcctagaaaacccacacctgatataacttgagctcctaatcgtgtaggatctcctgtcccaaatttataagatacgtattcattcgtcatcataatcaaacatgcagctagacaaacaatactataagttcggatgcctgcaggctgggatttgctccctctctctaaaccaattatactaccaatgactactgataaaacaatcctgacaactatttcaatatttgataacccaagactagtggctgtcatgattatttccttactttacgccccggtctttgtgtgaagtataataccgttccagaaataatcatcagaacaattgtataaacaaataccagagcttgtgcattagatgttgctgtttcatcacctgcagatcgaatcgtaatacctaatggttgagctaggggatggtaaaggaatacagataagtcgaagtcagttaataaagagttaaagtttaaagcaataacagagagaacaaccggtaaaataaatggaatgataaccttcatcatagtataaaaaggtgaagcacccatacttcttgctgcatcttccatctcatcatcaacactaaataaaatagcacgtaccattctataagaaaatgggatttttacaactatatatgcaataagtagaattaccaaactacctaccaaaatctgattcaagacaagaaattgtggctgattaaaagtaaataataaacttactgctaaaagtgtacttggtagtaaccaaggaagtagagcaccatattcaaataagaaatcaaaacgagatttatgttttctgacaacacgagcaaatacaactgcgagaattgttgctgttgtcgcagcaataatagaataaataaagctgaccaagaatggagagaatgccgcactattactaaagaataagcgataattttctaaagtaaagtttgataatgttaagttacctgtttgaattgcaactggatctgtaaatgagtataatactataaaaattagtggaagcatgaaaactgtgaacaatccatatgctacaatgtgagcaatgatattccaaggcttagacgcaattttttgttttttaagaggcgctttagtcttagagatagaaatataatttccacctttttctatcttattcatgatagtaagcaaaattgtagttgcaatacctaaaataattgcaagtagggcagctaaatcacgagaattccccatccctgcaaatgtaataatcattggatttatagtttgaaattctttaccaccaacaatcatgggtgctgctactgcagataaaccactaagaaaaaccataatagtaagtgcaaatagagttggaattaaggttggtaacactacttttcggaaaacagtaaatggttttgctcccatatttcgagcagcctcaatagtgtgatagtcaacgcttcgaattgtatttgttaaaaacaatgtatgattagcagttcctgaaaatgtcataatgaataagactgcaccatacccaataaaccagttagggtctaaagaagggataacattttgtaaaaattttgtaatcaatccataaggaccatagacaaatttatatccagtcgctaaaaccactcctccataaattaaagaggtcatataacctaattttaaaattttagcacctttaatatcaaagtactctgtaaatagaacacaaagaatacctacgacattaactgtaataatgagtgaaaatgctaacttaaaactgttcataatactctgaagtgccctctgagattttagaacacgatgtacagcatcaagggaaaattctcctccttttacaaatacattcactactagatcaaagtttggataaataataaatgttactaagaaccagattaaccctaaacgaataagccaatcttttaaatttaatttatgacgcatactgcacctccttaaaattgcagaacgtctgatggtgtgataaataattccacactttctccgacagatctaatagcagcctgactatcaatacttgttacattaagaatctgactttcagaaacttttattgtatagtgaattgtaactccagaaaactcaacatcaataattgtcccttttagaataaaatcttgttcagtttcacgattgaatcgaactttctctaatcgaatgtatccttttttatcctctaagaaaacgcttgtatttttcaataatacttcgtggactgtttcatcggtcaaaacattaatatctccaataaaatcacatacaaattcagtttgagaattatgataaatctctactggtgtaccgacctgttcgatgtatccattgttaaagactgcaattctatcagataaagtcaaggcttcctcttgatcatgagtaacatataaagtagtaatacctaactctttttgaagtcttttcaactcttttctcaaatctacacgtaattttgcgtcaaggtttgacaatggttcatctagacaaagaattttaggttcaagaaccagagcacgagccaatgctaccctttgttgttgacccccagataattctgatacattacgctgtaactgttgatcagagatcttaatttttgctgccactgctgatactttagctttaataacatctggagctaccttcttaacttttaaaccaaatgcaatattatcaaaaacagtcatagttggaaatagcgcataagattgaaatacaataccaattccacgcttttcaggttccaaatgagtgacatctgttccattaacttcaatacttcctgatgatggatctagaaaacctaccaatgctctcaaagtagttgatttaccacatcctgaaggcccaagaaatgtaaaaaattccccttcatgtatatctaaattcagattatcaattgcaacaaaatcaccatatttaatttgaatattatcaaatttaatcatctcactaactccctctattactaaaccaaaagcctctctttatttcttccataaatttagaaataatagagagacttggacataaaaattaactcttatttcttattgtacgtattctaattcagctttttctacccattcatccaaatgctttccaacagcttcccagtcaatattttgtggtttcacttgatcaacaaatttcttcgtatcttcaggtagatctttgagggcatctttatttgcaggaatagatccaaagttcttactatattctacttgaatttctgattgaccaaaccaatcaataaattctttagctaacgcttgttttttactagtgcttaaaaccatagtttgttcagttacaaatggtacaccaatctcaggagtcataactttgaaaacaacattttgttctttttgtccaactaatgcaccagaaccccacatcattccatattgtattggatcttctttgtctaacatcttaacaattgaactttctcccttttgaagagtgtatgcatttttcaaatattcttttgctacttcccaacctttttcggaaacacctaattcacctttatcatcaaggtatcgaactaagatacttgctagaattgcccgtcctgtacctccttgaagaccagaaattgaatatttacctttatacttactacctaattcagtccaatctttaggcatttcttttacatcaggcgccccaattaaaactaatggttgaacaatcacaggattataataattatctttatctgataaagattgatcaattttatctaaccatttaggcttgtactgtactagtaatttttgatctctaattttatttgaatcaacagcaccaattccaaataccatatctgcaactgcattattcttctcagcaataacacggtctgctaattgagcgccagcgatatcaaccatttttatattaaaaccagcttcttttgctttagcagttaaccaatcaccacgaccatttgagactgagttcgaatagataactaattcttgacttttatcagctttttcttcagatgaagaagcagtcgtagaatttgaacctccagagcaagcagcaagtgtagtaagagcaactcccgttgcaagtacagtagaccaaactttcatttttttcatgataagttctccttttttattattttatttaaatttttcgtgatatggaacaaattgtctcatatcttcaaatacagtatagtcaatacggtttacagtaatagttggaatcttctctaataaaatttcagttaattctgctctgactttagtaaactcttcttcctcctcttcggttagaggaatccgaagatacccaattgaaatatggaattgatatctatcatgattagggaaacaaacacctgctttttctgagacataagtacgaatttcttctaatctctttgcagaagcttcatctgcaggttcaactagtatgttttgttttcccatttcagttatacgcatatgaatttcttcatccaacaatggaaaaatttcaagttgtttagcaaagtaatcatgtatttcctgtaaaggtgtatctagaggaagattactgctccaaaactcgttcacgattttcatggcacaacaattcaattacagtcatgtgaatagaattccttggagttaaagtaaacttatcgataaatggtaattctctataacgtgattgaataatatcaacaacttccatcaaatcttgtttagtataaagatttgctacaactgtattcccagggaaatgattaaattccccattctcgg

SEQ ID NO: 186 - DNA, 3763 bp; double-stranded, linear
gttataagcaacaccttcttgcttgccataagttgtgaaatgggtagaatcgatatctacaatgagttggtttagctggtgaaactgtaaaaagaattcgaccaattcaaggttgaggcatcgcaaactatggactgtttcctcgtcagttctggaaagaaaacgggataaggttggctgtgaagcaagctgccctccttccaataattttggaaagtaggcatcagctgacaattctttacaagcatagtccgttccataacctgttaacagttgaaagaggaactggacaaggatatctgaatccgaataacgacagtagcggcgttggtcattcgttactaaatacttagaaatccgctcttttagtttcaactgggaaaaaagttcctgaaaaaagataagaccaccatactgggttaaatgacctccatcgaaagatagttggtaaaaagacttgttttggaagtgatgatttggtaaactgttcatgtgagtttcctttctttttgtgtttttttctacacttataccataaaggggaaactcttttttgtctagtaaaaaacacccattgggtgaaaaaagaaaccatccaggatctaagctaaggcaaggattctggatggtttttagatttggggtgaataattggggatttaggagaaatgatggtatcttccaaatcaaaatcaacttcactccatagtctcaactgattgattttcccatcttgataggtcacatccttgtcaaggataaactgagtcaacacctcatgttgaccttgacacctgatgtcatctaccaagagccagacatcctctaccaacatgaggatttttctcctgtgaagataaggcaaatcaggttctgctgaccaataagccccctcaatataatgcactccctccctttctttatggtgacaaaacagggagtgaggatagtattcatattcccaggatcccgtgattctttccggagctttcccatctacaatgcaggtcgaatgactccaagcactctttaagagataacgttcatatatctcccgataagaataacgcccagcatctatgaaaataggttggccttgatactgtaagcaaaaactattctcgtcactatgactatgggcacttcctagcggaccatttttgaaaaatagataacgatgttcatccttaatgcagacatgtccagagtcttcaaagatcatggacttaggctgccaagctctcttttcaaattcctgcagtcgcttgaccttttctcgccccaggaacaagaggctaagcaaatcaactttaacatccagaccgttaagaaggtcttcctggttcaaaaccacagcagacaggctcaaaatttctgtcgtttctgtagaatcgctatcaccaaaagccaaagtccgtccatctaagcctgtcatcatttgaatataggtcgccatcttttccagcaactcttggtaactatcttgcaagtctggaagcaagagacacaaatccagcaaggctttataaacctctacatgatagagaatcgactgttcaaactggcttccatctcctaaaatctgtgtctcaatttgctgtttcaactcctctgaagcaaaatggtaagcttcttctagatccatcttatctgaaaagaaatgatagatagcaagcatcggaattgtttgtaaaatcccccagttactaagggtgtacttggcgcgatagtagcttttcataaagtcaatctgcttttctagactgaccaaaattttctctagttctttctcctctagcaagtcaaatttcaagaggagcaagagtagtttcaaccaagtaaaggaacgaatacccgtatccaaggttctagtcatcaaggattgaggagaaaattctctcacctgctcaatccaatcaaatagaaagaacttgcacttttgaatatagtccttatctccttctaccagataccctatcataaactgcaagagatattcttgtcgattgagcatataagaccattctggatcatcttcaaatacttgatcccataccatcggctggatttgatggatttttgaacaaggctccatatcccaaggactatcaaacataaaacgattgtccatcaagcgttcaagggaactcttgactttctcatagtcttttgaacagtgcgacaagatataatcacgacattgatttccatcgactctttcaaaaaattgtcttctttcttctttcattatctattaccagaaaaagaactacttaaaaagcagttcttttgtctttcccattacactttccttttctacatggatgaccacaccttttgcaatctgcaaggagaccaagtcatcttggatagaaatgatttttccatgaattccagacaataacaacacttcatcaccaaatgttaaagaagctaaatactcttgtcgttgctccatctgtttgcgaagcaacttttgctgacgaatagaatgaaagcttgacagtaaaaggggactcactgccaagacaatcactattccataaaacaatgttgtatccattaagctataatcttaagccagcttccgataattccgatgataactgttaaaataacgagtttatatgttgtccatttcttttctttgatcaagtagtaaactaaaagtgtaaatagggctggtagaagagctggagcaaccttatcaagcattccctgaatacttacgatactttgtttagcgtctgctttaacttcccctgcagcaaaggtaatcggcaccataatcttaacagatgtcgctgccaaaccagcaattacgttacaccgataatattggcaatacgagaaatcgttgccatctgttcgcttagtttatcaatcacagttgttcctagtttgtatccatacagaccagttgacaatttaatcgctgttaaaatcgtattcatcgcaaggaagaacaagattggaccgacaaccaagccttcttgagcaaacgaagctgcgatggttgagaacaatggagctaaacagaattgagaaagagaatccccaatacctgccaatggtcccatcaaggccatcttgatgctacgtgtttcttttgccggacggccattttccaacattacaagatgcaagctggtaataaaaggcaggaagtgtgggttggtattatagaattcacagttttcttccaaggcttggtagaaaccttcctgatcctctccatagtgttttttcaaagcaggatacatcacattggcatatcccaacccttgatagttactatagttaaatccattttgacaaaagaatgcccgcaaagacgttttaagataatcacgttttgttaatttgttagatccagtcatcgtgtgcttcctcctctaccacatgatccgctgtttttggcttgttataaaattcaatcaaagcaaagatagtacctacaattgcaataccaattgttgggatgtttagataagctgcacaaacatatcccaacaagacaaagggaatcaactctttcttagccatcactgacaagatcatcgcaaaaccgatagctgggagcattttaccagcaactgtcaaacctgtaagtaataccggtggaatgtagtctacgagtttcaacaaggtatccattgaaagggcaccaagcaacccaaggtaaatccaataaaggcaaacaaccaaattgttgcatttagagtgaacttaaatttcttcaaattatggtttttcaagtgct

SEQ ID NO: 187 - DNA, 5053 bp; double-stranded, linear
caatctctgagtatgtgcggtcaatactawcaaagggaatycctgacgtcaagtaatgttcaattggmctataggtaatggcaaccactccatcaactttattatgacgcaacatctccagatagtcttgctctctatttgtaccattgatagaacataagagtaatttgttatttctcttatagacttcattttccacatgcatagcaaattctgaaaagaagggatgccagatacttggtacaatgattgcaatcgtttctgttcgattttttttcattcctctagcgtagtaatctggaatgtaattcaaagttttaatcgcttgttccacttttttcaaagttacttctttaatgcctttttctttattaattacacgtgaaacagttccaacactaactcctgcttctaaagcaacatctttcatggtaattgattttctttgttctaccatattatcacctcctttcaatatatagtatcatgcaaatgctttttaagcaactatttctcaatcatttttggccagatcatttatcccatcatgaataaaatcactccaattagcttttgaaaatacttcaattttcatgtgtaaacatctacataaaacaggaaaagccttggtttcatggcttttttcgtatcttctataaaaaaagcaagagttttagatggctataaatctagatgtacattttgcttaaatgattgaaggtcttttcttaacaaaaacacccccaaaattagactttttctgtctaacttttgaggtacagttcaaacgcgaaatagcgtttttttgttatttttggttactcatctaatcgaataaacatcatggcatttaacaagtatatgagtgagaccgtgtttatattatttgaatagatgagtctcttattttcaataggaggaataataaaattagaaataatgatatcataaggtgaatcttctaaagattcctttgataattctaattcagtccaaacttccagttcaaaattattgctacaataataagaaagtgtctctgcaacgaattttgcatgatactgatcaaaattactcataactaaaacctttagtttaggctgattttgtagcaaattaatcaccaaatgtttggtatgagtgatgaaggtataagatagatgatttaccatcattgaactagaacaaacctcaagagtctctaaatagtgagaaagctctttttttatatctgaaacaaattttggaaaaatattttgaaagttcctgattgtattccctttttgatcaaataaaataaactcagtaaacaactcttgacgatacagatgtgcggtattatgcagatgccaaatcagattatccttattctccatttcaatctgatacttgactgaaatctgatcaataaaatcactcaatagatggtaagatttttcaacataactatccttttttacgcatttcataaagagactttcatctatgaaaaacattttttgaaagtaagacacaaataattggcaaacaacttcttcatctaaagagatattgtattctgattcaaaactctgagcaacaccttctattccttctgcctgcattaaaaaatccaaactttggtcgttaaaagaatctttatctacttccataaaatgaccaaactttattctatataggttcgtaactaggagcaactttagcattctatgcgttgacaaattcattggaaagcttgtttccttataaaccaattctaacaattgagatagtggctctgatgaaaaattttcaaatggccattctaggaaataatatttttctgaaaaatattgtgcaaaaaagtaacgaatgtctctctcatttccaatgatttgaacaggggtcagactaacttcaaattgaaattgccttttaatcactttattgatttggctaataatacgatagagcgaagatgaactgatataaaattctttacaaatactctcagcttgacaaccttcattaaagaagatgaattctaaaatcgaaaaatgagttgaatgtttaaagaaatgatggtaaaccatttcaatatcactatcatcggtattaataatgcgtataccattagtagaagaatgaaaaatcaagtcaggaaaagcagatttaacatgggatagatcatctttgactgcacgttctgtacaatttaataactctgctagttcagaacgatgaaaccaacgtttatgttcaaataataattctaataattctaattgcctatgactttttttagataataaatctctcatgaatatctttctctctttataaattatcggattaaacctcttgcaattataccacaaagaataggtatagcatgatataacgacttttcctaaaatcttttatttcgtataataacactacggagacaatatataaacaattttcttattttaccgtctattgagggcgtgaatacagaatcaaattcaagtctaaagattatatttttaattttaaaaattatataatagcaacaattaaagaatttgattttttaaaattatataataataacaatcgaaataattgacttttctatattaaagttatataatagtaataatcaaagaaattgattttttgatattaaaataaaaaaggagggtaggcagtgttgtgatcaattattgctggaggtcttattggtctcttggcaggtaaaatcactaaaaaagtagttctatgggaatcatcgcaaatgtattcgctggtttagtcggggcatatgcaggacaatctcttttaggtagttggggtccagcaatcgctggaatggctttgctcccatctattgtaggtgcagcgattgtgattactgtagtgtcattctttacaggtagaaagtaaacttttcgccagtaaagttagcaaactatttttaaatcaatgacgggaaaaatagtttaaatgttaaatcgaaaggattgtatatgtcaaaagcaaagaaaatatgtttcattattttctgtattttaatcttgacaattttccttcctgttttgatagattatcatcaagttagtgatctaggtattcatctacttagctggagacagaactccgtagttgaattctatcttgctagatatgtcttttgggggacagtggttctatcaactttagttttattatccattttagttgtgatgttttatcctaaacgttacttggaaatccaacttgaaactaaaaacgatacattaaaattaaagaattcggcaatcgaaggttttgttagaagtttggtgagtgatcatagattgatcaagaacccaactgttcatgtaaatttacgaaaaaataaatgtttcgttcatgtagaaggtaaaattcttccttcagacaacatcgctgacagatgccaaataattcaaaatgaaataactaatggattgaagcagttttttggtattgagcgtcaagtaaaacttgaagttgcagtaaaaaattaccaaccaaaacctcaaaacaaaaagactgttagtcgtgtgaagtaaggaagtaaaaaatggaatggcttaaacaatatcgatatccaattatcgctggtctcataggcgtatttctggcttgtttgattgtctcctttggcttcttcaaaacaatatttgtattgattttaggagcactgggagttgcagctggattatatatcgaaaaaaactatatagataaataaaaaaataaaaattactaatttaattaaaggagtttcatatgtcaaacgaaaaaaacacaaacactaacgtagaaaagaaagatgctactgttgtagctcacgaaatcaaaggggaacttacttacgaagataaagttatccaaaaaatcattggtctttcactagaaaacgtttcaggtcttttgggaatcgatggtggtttcttctcaaatcttaaagaaaaaatcgttaacagcgatgacgtaacaagtggtgttaacgtagaagttggtaaaacacaagttgcagttgacttaaacgttattgttgagtaccaaaaaaatgttccagctttatattcagaaatcagagaaatcgtatcttcagaagttgctaaaatgactgacttggaaattgttgaaatcaacgtaaacgttgtcgacatcaaaactaaagaacagcatgaagcagactcagtaagccttcaagatcgcgtatctgacgttgctgaatcaacaggagaattcacttcagaacaattcgaaaaagctaaatctggtcttggatctggtttctcaactgttcaagaaaaagttagcgaaggtgtagaagctgttaaaggtgcagcaaatggtgtagtatctcacgaaaacactcgtgtaaactaagataaaataaatataacaggagaaattatcatgtcagtagaagaaaaattaaatcaagctaaaggttctattaaagaaggtgttgggaaagccatcggtgatgaaaaaatggaaaaagaaggtgcagctgaaaaagttgtttctaaagtaaaagaagttgccgaagacgctaaagacgctgtagaaggtgctgtagaaggtgttaaaaacatgttgagtggcgacgataaataaggttaaaagttactttatctttttagtaatattagtcaaaagagtctgagtcaagatgattctcagaaaacaaaaagctagagattcccaattgcggaactctagctttttaattttgcctctttctcttattatatttcagcaggttgttggccatgagtacgaatcccatgtcaattctcacttgacgcttacctctcagatgacatctcttataacccaaacaaacctttatctgcccaaagacagatttcatatcaatcttacgtttagcgaaaatttgtctacccttggaagataaaagtgcctgatattctttagtttttaaacactggtaacgttcattcatatacagtctcttttgaggggctgattcaggttcataatcgcagtcaacattgatttcaaggctgtttgctttctatctccccgg

SEQ ID NO: 188 - DNA, 6492 bp; double-stranded, linear
aattctcttttttccaacaaaatgtatgacctgcacttgaatacttctcattgtttgtacattcatctactttcatataatcttttacaaaatcataatatgacataacacactatcccttttagacaatattccaattagccttattaattcaaaactattgtattagtaattataacagatgtataatagaaaagcaatgatagatattatcaattaagcgaatttatatctaaaagggatattaaagaaaggagatatgcttatgaagatttacaaaaaactatttgcttatgtccaagataagaaatatcttggggttttggccataattttttctgctatatctgctgcacttacagtatatggatattatttaatctacaaatttctagataagttaataattaattcaaacttatccggtgcagagagtatagcattaaaatctgttattacactaacaagtggagcgatattttattttgtctcaggaatgttttcacatatcttgggattcaggcttgaaacaaatttaagaaaaagggaatcgatggtctggaaaaagcaagttttaggttctttgacttaaatccatctggtcaaataagaaagattatagatgacaatgctgcacaaactcatcaggtggtagcacacatgattcccgatagttctcaggcaataatcacacccgtacttgtacttgcacttggctttatagtaagtataagagttggcataattttgcttgctcttactataattggtggcttaattttaggggcaatgatgggcgagcaagaatttatgaagatataccaagaatccctatctaaactaagtgctgaaactgttgagtacgtgagaggaatgcaagttgtaaaaatatttaaagcaaatgtagagtcttttaaaagcttttataaggcgataaaagattactcaaagtatgcttatgattattccctatcttgtaaaaggccttatgttttgtatcaatggttattttttggactgattgcaattttaattattcctatagtttattttatgactagcttagctagcgcaaaggtgattttacttgagcttatcatgattttatttttatcaggagttctctttgtttcattcatgagaatgatgtgtactccatgtatatttctcaaggaaattatgcagtagatactttagaggcgctttacgaagatatgcaaaaagacaaattagtgcatggtaatgtcaataattttaaaaactataatatagaatttgagaatgttagctttgcttataatgataaagctgtcattgaaaatttatcctttaatttagaagaaggaaagtcctacgcacttgtcggttcatctggatcaggcaaatcaacagtagcaaaacttatatcaggtttttacaatgttaataaaggaagcataaagataggcgggatagcaataagtgaatattctgacgaagccttaattaaagccatttcctttgtttttcaagattcaaaattattcaagaagagcatttatgataatgtagcgttagctaataaagatgcgacgaaagatgacgttatgagagccttaaaattagcaggatgcgatttaatattagacaaattcccagaaagagaaaatacaatcataggctcaaaaggtgtttatttatccggtggagaaaaacaaagaattgcaattgctagagcaattttaaaggattccaaaattattattatggatgaagcatcagcatctattgacccagataacgagtttgaattgcaaaaagcttttaaaaatcttatgaaggataaaacagttatcatgattgcacacaggctatctacaattaaagaccttgatgaaattattgtcatggatagtggaaaaattatagaaagagggtctgacaaagaattaatgtcaaaagatacaaggtataagagcctgcaagagatgtttaacagtgcgaatgaatggagggtttcaaatgaaagagttttataaaaaaagatttgctcttacagatggaggagcaagaaatttaagtaaagcaacactggcttcatttttcgtttattgtataaacatgcttcctgccatattacttatgatttttgctcaggaagttttggaaaatatgggcaaaagcaatggcttttatatagtattctcagttttgattttgatagcaatgtatattttgctttctatcgaatacgataaattatataacacaacctatcaagaaagtgcagatttaagaataaggacagcggagaatttatcaaaattacctctatcttacttttctaaacatgacatttccgacatttcacaaacaatcatggctgatattgaaggcatagagcatgcaatgagccactcaataccaaaggtgggcggcatggtactgtttttcccattaatatctgtaatgatgctagcgggcaatgtcaagatgggtttagctgtaattattccatctattttaagctttatatttatacctttatctaaaaaatatcaggttaatggacagaatagatattatgatgtcttaagaaaaaactcagaaagctttcaagaaaatatcgaaatgcaaatggagattaaagcatataatttatcgaaggatattaaagatgacttatataaaaaaatggaagatagtgagaaagtacacttaaaggcggaagtaactacaattttaactttgtctatatcttcaatatttagctttatatctcttgctgttgtgatatttgtcggcgtaaatctaattattaataaagagataaattctctctaccttataggatatttactagctgctatgaagataacagactctttagatgcatctaaagagggcttgatggaaatattttatttatcgcccaaaatagaaagattaaaagaaattcaaaatcaagatttacaagaaggcgatgactatagcttaaaaaaatttgatattgatctaaaagatgttgagtttgcctacaataaagacgcaaaagttttaaatggtgtaagttttaaagctaagcagggagaggtcactgctttggtaggtgcaagtggctgcggtaaaacaactatcttgaaacttatatcaagactttatgattatgacaagggacaaatcttaatcgatggcaaagatataaaggaaatatcaacagaatccctttttgataaggtgtctattgttttccaagatgtggttctctttaatcaaagcgttatggaaaatattagaatcggtaagcaagatgcaagtgacgaagaggttaaaagagcagcaaaacttgcaaattgcacagattttatagaaaaaatggataaaggtttcgatacagttattggtgaaaacggagctgagctatcaggaggagaaagacaaagattatcaatagccagagccttcttaaaagatgcgccgatattgatcttagatgagataacagcaagccttgatgttaacaacgagaaaaagattcaagagtctttaaataatttagttaaagataaaactgttgtaatcatttcacatagaatgaaatccatagaaaatgcagacaagatagtagttcttcaaaacggaagagtagaaagcgaaggtaagcatgaagagcttttacaaaaatcaaaaatttacaaaaatttaatagaaaagacaaaaatggcagaagaatttatttattaggaggactacaatggataataaaaaattaaaagtaaaagatttagtaagcatcggtgtttttggcgtaatttattttgccttcatgtttggagttggtatgatgggcttgattccaatattgttcttaatatacccgacagtattagccatagttgcaggaactgttgttatgttatttatggctaaggttcaaaagccatgggcactatttatatttggtatgatatcaccacttgtgatgtttgcagctggtcatacctacgtagttgtggttttatcacttatagtaatgataatagcagaattaattagaaagattggtaattataattcatttaaatacaatatgctttcttatgcaatcttcagcacatggatatgtagctctttaatgcaaatgcttttagcaaaagaaaaatatatggagtggtctttgatgactatgggaaaagattatgttgatgtattagaaaagttaataacttatcctcacatggctttagtagccttaggtgctttcttaggaggaattcttggagcatatataggcaaggctctattgaaaaaacacttttcaaatggattatattgtgtgggatactttactccttgcctaattttatggtgctatctgaattaaaccctatagttaagatgtttttgagtatacctattgttattagaatgtttattttaccatttatggcagcaagctttatgataaagacctcggatgtaggcgcaataatttcatcgatggataagcttaagatttcaaagaatgtatccatacctattgcggttatgtttagattcttcccatcttttaaggaggagaagaaaaacatcaaaatggctatgagagtaagagggataaattttaaaaacccagtcaaatatcttgaatatgtttctgtgccactactcattatatcatctaatatatcagatgacattgcaaaagcggcagaaacaaaggcaatagaaaatccaattgccaagaccagatacattcgcgtaaagatacagctaattgattttgtttatgttttagcggttgctggacttattgtgggaggcttaatatggttgaaataaaaaatttaagtcttgattatggtgaagagcatatattagatgatatatcactatccatagccgagggagagtgcgtgctatttacaggaaaaagtggaaatggtaagtcatctttaataaattcaatcaatggactagctgtaaggtatgataacgcaaagacaaagggcgaaataattattgatggtaagaatataaaaaatttggaactttatcaaatctcaatgcttgtttcaactgtttttcaaaatcctaagacatatttttttaatgtcaatacgacattagaattattattttatttggaaaatatcggtcttgcaagagaagagatggacaggcgtttgaaggatatacttgagatattcccgataaaaaatcttttgaacagaaatatatttaatctatccggcggtgaaaaacaaattctttgcattgcagcttcttatatagcaggtacaaagattatagttatggatgagccttcatcgaatttagatattaaaagcataagtgttttggcaaagatgctaaagatattaaaagagaaaggcataagcataattgttgcagagcatagaatttattatttgatggacatagttgaccgtgtatttttaatagataaaggaaagcttaaaaaaacttatactagaagtgaatttttaaagctagataaaaatgaattaaatgctttaagtttaagagataaagaattaagtaaattaaaagttccttatttaaaagaaggtggagagtatcagataaaaaatcttagttacaaatttactgatgatgagtgtttaagcttaaaagatatttcgttcaagcttgggaaaatttatggcataataggatccaacggacgaggaaaatcaacgcttttaagatgtttaataggtcttgagaaaaaatcaaaagaagaaatttattttaagggagagaagctatctaaaaaagaaagactcaaaaactcttcacttgttatgcaagatgtaaatcatcaattattcacagatgaagtattcaacgagcttagattaggagtaaagaattttgatgaagaaaaggcgaaaatcattttaaaccccaattattcaccccaaatctaaaaaccatccagaatccttgccttagcttagatcctggatggtttcttttttcacccaatgggtgttttttactagacaaaaaagagtttcccctttatggtataagtgtagaaaaaaacacaaaaagaaaggaaactcacatgaacagtttaccaaatcatcacttccaaaacaagtctttttaccaactatctttcgatggaggtcatttaacccagtatggtggtcttatcttttttcaggaacttttttcccagttgaaactaaaagagcggatttctaagtatttagtaacgaatgaccaacgccgctactgtcgttattcggattcagatatccttgtccagttcctctttcaactgttaacaggttatggaacggactatgcttgtaaagaattgtcagctgatgcctactttccaaaattgttggaaggagggcagcttgttcacagccaaccttatcccgttttctttccagaactgacgaggaaacagtccatagtttgcgatgcctcaaccttgaattggtcgaattctttttacatgttcaccagctg

SEQ ID NO: 189 - DNA, 7174 bp; double-stranded, linear
aactgaaggtaaaggcttcgacgcagaacgtgacgctgcccaagctgcccttgatgaccttaagaaagctcaagaagacaacaacttggacgacatgaaaacaaaacttgaagcattgaacgaaaaagctcaaggacttgctgttaaactctacgaacaagccgcagcagcgcaacaagctcaagaaggagcagaaggcgcacaagcaacagggaacgcaggcgatgacgtcgtagacggagagtttacggaaaagtaagatgagtgtattggatgaagagtatctaaaaaatacacgaaaagtttataatgatttttgtaatcaagctgataactatagaacatcaaaagattttattgataatattccaatagaatatttagctagatatagagaattatattagctgaacatgatagttgtatcaaaaatgatgaagcggtaaggaattttgttacctcagtattgttgtctgcatttgtatcggcgatggtaccagctatgatatcattagaaatacaaacatataaatttgtaataccgttcataattggtatgatttggacagtagttgtatttcttatgatcaattggaattatataggcaaatactaagaagagacaaaaatatataaatatttctgtacttataggatatttaaaatcaaaataaagttaatttacttatttgcagaggttgcaacccagcctctgtttttcgataaaaagggacggaatctcatttgtttgggttttgtctcatcaatagaaaggaacaaagagtgttcgtaactgaacacgggtttcagaatttcttactaaatataaaagaaaggaattgaacccgacctaaatggtggttcgattcagaacatcaatagaaaggaataagggtgttcgtaactgaacacgggctatggactgtgccaaaaagatagttttttctaggacgtaagcgtccgtcgtcaaaactcctagatggctgtgtccgtttgacgccctttgtatcttgaattatgaacaatactgaattttatgatcgtctgggggtatccaaaaacgcttcggcagacgaaatcaaaaaggcttatcgtaagctttccaaaaaatatcacccagatatcaacaaggagcctggtgctgaggacaagtacaaggaagttcaagaagcctatgagactttgagtgacgaccaaaaacgtgctgcctatgaccagtatggtgctgcaggcgccaatggtggttttggtggagctggtggtttcggcggtttcaatggggcaggtggcttcggtggttttgaggatattttctcaagtttcttcggcggaggcggttcttcgcgcaatccaaacgctcctcgccaaggagatgatctccagtatcgtgtcaatttgacctttgaagaagctatcttcggaactgagaaggaagttaagtatcatcgtgaagctggctgtcgtacatgtaatggatctggtgctaagccagggacaagtccagtcacttgtggacgctgtcatggcgctggtgtcattaacgtcgatacgcagactcctcttggtatgatgcgtcgccaagtaacctgtgatgtctgtcacggtcgaggaaaagaaatcaaatatccatgtacaacctgtcatggaacaggtcatgagaaacaagctcatagcgtacatgtgaaaatccctgctggtgtggaaacaggtcaacaaattcgcctcgctggtcaaggtgaagcaggctttaacggtggaccttatggtgacttgtatgtagtagtttctgtggaagctagcgacaagtttgaacgtgaaggaacgactatcttctacaatctcaacctcaactttgtccaagcggctcttggtgatacagtagatattccaactgttcacggtgatgttgaattggttattccagagggaactcagactggtaagaagttccgcctacgtagtaagggggcaccgagccttcgtggcggtgcagttggtgaccaatacgttactgttaatgtcgtaacaccgacaggcttgaacgaccgccaaaaagtagccttgaaagaattcgcggctgctggtgacttgaaagtaaatccaaagaaaaaaggcttctttgaccatattaaagatgcctttgatggagaataatactcttcgaaaatctcttcaaaccacgtcagcgttgccttgccgtatatatgtgactgacttcgtcagtcgtatctacaacctcaaaacagtgttttgagcagcccgtggctagtttcctagtttgctttttactttatagattttttaagactttcctaagtaatgacggacggtagtgacctccttcgaagttccatacctaaactttgaacctaagttttaaagtttccggacagctgaaaccaagctgtttcaggtgttttcattacggcagaaagtcttcgatttagttgtgaaatggtgaatgatactcttcaaaaatttcttcaaaccacgtcagcgtcggcttgtcatgggtatggttactgacttcgtcagttctatccacaacctcaaaacagtgtttgagctgacttcgtcagttctatccacaaccttaaaacggtgttttgagcagtctgtgcctagctttctagtttgctttttgatttttattgagtatgaattacctaaattatgatgcatagttgatgggatatatataatagattgaaatagaatatgaacaaattgataagaggattttaaagtaatctctaacaatgctttagaaactatggtgtgctattctaaattcaattcactataacttgtttacgttttaaaaaagagccgtcgggctctttttacttatcttcagttccctgcatttcttttatcacagctagtctagtctggatatccttttccaagaccttaaacttgtaagtcaagtcttcttggtattccttgataagttctttttgctggttaatgatttgcaggctgttttggataatatccacatcgtccttgatagcttgaacgcggtcagtggtattcaagacttcatctgtgatggtttggcgattttttgtaaccagataacttccggctgcagctcctgcaaatagcagtaggttggataatttcatagcaactccttaagcgtttttgatggtttcagcgacttgagcaagtttgtcaaagtctggttcgtgggcgataaaatcaatcttgaggtcatcgtcagcactgtagcgaggcacaaggtgaacgtgagtatgaaaaactgtttgaccagcgacttcttcacagttggaaatgatattcataccagcagccttagtgactttcatgactttttgagctacttttggtacttgggcaaagagttggctggcgctcgtagcatccatctccaaaagattgcgatagtgttcttttggcacgaccaaggtgtgtcctagtgttacttgagagatatcaagaaaggcaaggacctgctcatcttcatatacttttgaagcaggaatttcccctgcgatgattttacaaaaaatgcaatctgacataaaatctacctctactgtactgaattttgatataatatagctacattataccagatttggagaaaatatgttagaaattaaaaacctgacaggtggctatgttcatgttcctgttttgaaagatgtgtcctttactgttgaaagtgggcagttggtcggtttgattggtctcaatggtgctgggaaatcaacgacgatcaatgagattatcggtctgttggcaccttatagtggctccatcaatatcaatggcctgactctgcaaggagatgcgactagctaccgcaagcagattggctacattcctgagacgcctagtctgtatgaggaattgaccctcagagagcatatcgaaacggttgctatggcttacggtattgagcaaaaagtggctttcgaacgagtagagcccttgttaaaaatgttccgtttggaacagaaattagactggttccctgttcatttttcaaaagggatgaagcagaaggtcatgattatctgtgcttttgtggtggatccaagtcttttcatcgtggatgagcctttccttggtcttgatccgctggctatttctgatttgattcagcttttggaagtggagaagcaaaagggcaagtctattctcatgagtacccacgtgctggattcggcggagaagatgtgtgatgcctttgtcattcttcacaagggagaggtgcgttccaaaggcaatctcctgcaactacgtgaagcctttgatatgcctgaggctagtttgaatgatatttacttggctctgaccaaagaggaggatctatgaaagacttgtttttaaagagaaagcaggcctttcgtaaggagtgtcttggttatctgcgctatgtgctcaatgaccactttgtcttgttcctgcttgtcctgttgggctttctagcctaccagtacagtcaactcttacaacattttcctgaaaatcattggcctatccttttgtttgtaggaattacgtctgttttacttttactttggggaggaactgccacctatatggaggctccagacaagctctttctcttagttggagaagaggaaattaagctccatctcaagcgtcaaactggcatttccctagtcttttggctctttgtacagacccttttcttgctgttatttgcgcctttatttttagcaatgggttatggcttgccagtttttctgctctatgtgcttttattgggggtaggaaaatatttccacttttgtcaaaaggccagcaaatttttcactgaaactggactggactgggactatgttatttctcaagaaagcaagcgtaagcaagtcttgcttcgtttctttgccctctttacgcaggtcaagggaatttcaaacagcgttaagcgtcgtgcctatctggactttattttaaaggctgttcagaaggtgcctgggaagatttggcaaaatctctatctgcgttcttatctgcgaaatggcgacctctttgctctcagtcttcgtcttctcttgctttccttgctggcgcaggtttttatcgagcaagcttggattgcgacagcagtggtagttctctttaactacctcttgctcttccagttgctggccctctatcatgcctttgactaccagtatttgacccaactctttccgctggacaaggggcaaaaggaaaaaggcttacaggaggtagttcgaggattgaccagttttgttttacttgtggaattagttgttgggttgattaccttccaagaaaaactagcccttctagccttactaggagctggtttggttttactagtcttgtatttgccttatcaggtaaaacgtcagatgcaggactaacattgctgatacgacactaaaaaagaagttgagttcagtctgtctcaacttcttttttgttactacaggataatggttggtccgtagagacttatactcttcgaaaatctcttcaaaccacgtcagcgtcgtcttaccgtactcaagtacagcttgcggctagcttcctagtttgctctttgattttcattgagtattaacttggtcttgacttggtcaaagtggaagcggtcataggcccgccaagcggcgcgagttggagcatctggatcaagagcgctgagtcccatgagaagactggaagtctggtaaaatttttctagttcaatcaagaatcgattatccactgtttcagccttggctagaaaaccaagaatagagtttaattgctcctgaaagcggacgtcgtcagcgcttgcctgtttgcatgcttggtaggctttgtttaagtcagtaatcaaagtatgagctcttttgatggggtctgtatctgtcatgggaatgcctcctttaatctgggtgccagtcttacttctggcaactgtgttttgatactgttagtttatcacttttaattctttttttttattcaaatctttaattgtcattgaaatgtcttgaattgcgctgagtgaattttatgataaaatagttgtaagctcatcatgatgttgtagaaaataatccttttaggagttttcaaagactgtttaggattgggtgtgcttgggctagaccttttctgttattcttttcttaggaggagaatccaatgaaatatatgattattcagacgcagaaaacagtctataaagtaaacatcgacgatatctactatatccaaacacatccaactaaagcccataccgtacagattgttacagaagaagctagttttaatatgcttcaaaatttaagtaatcttgagaaccaatgtggggaaaccttgatgagatgtcatcgaaattgtttggttaatcttgataaattaaaatcgattgattttcaagaaagaatcctttttctcggagaagaaggtcaatacgctgtcaagtatgccagacgtcgctatagagaaattcgtcaaaaatggttgaaagagggagagtaagaagatgagaatatttgttttagaggatgatttttcccaacagactagaattgaaacgacgattgagaaacttttgaaagcacatcatatcattcctagctcttttgaggtatttggcaagccggaccaactgctggctgaagtgcatgagaagggggcccatcagctattctttttggatattgagattcgaaatgaagagatgaagggactggaagtggctagaaagattcgggatcgggatccttatgccctgattgtctttgtgacgactcactcggagtttatgcccctgtcttttcgctaccaagtgtctgctttggactacattgataaggccttgtcagcagaggagtttgaatctcggatcgagacagccctcctctatgccaatagtcaagatagtaaaagtctggcggaagattgcttttactttaaatcaaaatttgcccaatttcagtatccttttaaagaggtttactatctcgaaacgtcgcccagagcccatcgtgttattctctataccaagacagacaggctggaatttacagcgagtttagaggaggttttcaagcaggagccccgtctcttgcagtgccaccgctcttttctcatcaatcctgcaaatgtggtgcatttggataagaaagaaaaactgcttttcttt

SEQ ID NO: 190 - DNA, 3207 bp; double-stranded, linear
ccaccagggaaaatcattgaagttggtagtcaccaagagttaatgcaggcgcaaagtttctaccatcatctattcaataaataaggagaatgtcatgaatcctaatctttttagaagcgtcgagttttatcagagacgttaccataactatgcgacagtgttaattatacctctttcattactatttactttcatcttgattttctcccttgttgccacaaaagaaattactgttacttcccaaggagaaatcgcccctacagtgtcattgcctccattcagtcaaccagtgataatcctatcctagctaatcatttagtggcaaatcaagtagttgaaaaaggggacttactcatcaaatactctgaaacaatggaagaaagtcagaaaactgccttagcaactcaattacaaagacttgagaagcaaaaagaaggacttggaattttgaaacaaagcttagaaaaagcgactgatcttttttctggcgaggatgaatttggctaccataatacctttatgaattttactaaacaatcccatgatattgaactgggtatcacaaagactaacaccgaagtttcaaatcaagctaatctttccaatagcagttcatcagctattgaacaagaaattacaaaagttcaacaacaaattggagaatatcaagagttgagagatgctatcataaataacagagcacgcttaccaactggcaatccgcaccagtcaattttgaatcgttatcttgtagcctcacaaggacaaacacaaggaactgcagaggagccatttttatctcaaattaatcaaagtattgcaggtcttgaatcatctatcgcaagcctcaaaattcagcaagctggtatcggaagtgtagcaacttatgataacagtttagcaaccaaaattgaagtactccgcactcagtttttacagacagcctcacagcaacaactaactgtggagaatcaattaacagaattaaaagtacaactagatcaagccacacagcgtttggaaaacaataccttaacctccccaagtaaaggtatcgttcatctgaacagcgaatttgaaggtaaaaatagaattccaactggtacagaaattgctcaaatattccctgtcatcacagatacaagagaagtactaatcacttactacgtatcttctgactatctacctctactagataaaggacaaactgtaagattaaaactggagaagattggaaatcacggcaccaccatcatcggccaacttcagacaattgatcaaactcctaccagaacagagcaaggaaatctctttaaattaaccgctcttgcaaaactatctaacgaggatagtaaactcatccaatatggcttacaaggtcgcgtcactagtgtaactacaaagaaaacatattttgattatttcaaagataaaattttaacacattctgattaattttcagataacactctataactatttattatcttatcaaaaaggagaatcataacatggataagaaacaaaacctaacttcatttcaagaactaacaactaccgaactcaatcaaattacaggtggaggattgtgggaagatttattatataacattaatagatatgctcattacatcacataagaacttcatcatccaatacaactataaaaaaataagaccgagaaacaagtactctcggtcttatttttcatcattctgtatgtatcacagtaagtacctgacgaaagacttgattttgacaggtggtatttagactggtattaggatggctttccacaatcttcatgacggtatagagaccaactcctctctcctcccctttagaactggctccaaaggagaagatttcagaaatatcgatgccctcttctttgatggagttttcgatgataaaggtctcctgtgctccattttttaaaaaggcgattgaaacatgaggttgactagcttccacactggcttcaatagcattgtcacaaaggatagacacaatggttagaaaatcaagtagactcatcccctcgacctgaatctcctcaggaacttcgacattaaagacaatgttcttatctctggcttttaaaaatttccctgctagaagacttttgagggctttatcacgaatatttaccaatctgcccaggtcatatttattgttctgcaatttctgactggaatcctttaagacggagccatagacctcttttatctgctccatatcctcctcttcaatgcccagacgtaagctagtcaagaggttggtataatcatgacgaaagctccgtacttccttgtaaagctcctctatatgccgactatagcgttccatatctctatagcgcagggcctgctcttgttccaatctctcatagagtttttccttcaaataggtatccaatttcttgataacccccataaaaaagagtaggtaaaagactaggatgagatggcgaacagtctttgattgaatactttgttcatattcaaaaaaagacagactttccatgactagatagtagccacccattatccagttaatctgagtcagggacttttgaaaggctttatcgagaatctcctttctcaagctagtaaaatcgtagtccaaccatttcaaaaaagctagagaaatgaagaaattgaaaattattatacataacccagtaaatgagtagccatcatatacttgcccttgtcccaaaaatggaagcacaaaataggagactcctctataaaagagattcaccaatatcattggaaagagaccataaaagaaaaggagttttttaggaagccctctcaataataagaaagataagcctatgccgtacaagggttccataaaataagataggtaaacatttcctactatatagctaatcatcacaaaaacaaaggccaacagtatcttcaaaagaaaggccttaaaaatcctctcgaaagtaagatcaattccatccaccttaaagaagatgacaatttctagtccattagtaacaagtgtatacaacaatatccaagcaatgttcataaattctcctagctcagtgtaatttattgatggcctcagacacttccctgaccttataacgggcgattagacaacttccaccattgggagagaagagcagtttttctttcttatccaaatgcaccacatttgcaggattgatgagaaaagagcggt

SEQ ID NO: 191 - DNA, 10357 bp; double-stranded, linear
ctgaatcaagtgtactgcaccagttcgtgcatcaggcataacaacatctacagatataatattgttttctgagtccgcctcataagttaaaatcataaatttttcgatattcgaatttttagtagcttgttcaatttcttgaatcatttcatcagaaactaactccatctgaattggaaaggaatgactattttcatcatttttgtaggaagaatgttgattaagataaagtgtattcatctgagcatattcaaataagtagccactcttatttttttgtaccaaaggaaattggtttgtaagtcgcttcttaccctttataattaacaatactttcccatatttttctgtatttgtttcaaattctaaatatccccaagtctgtcctgctaattgtaatttatactcaaacaaatctgctgatgcaaatgcagtatcaatatgattaggtcgcgtccatgcataaccattcgacactatcattgtctctcttttttctagacgttcatctacataatctttttgccctttcatcaaagtatctacaattttttgtgcctcaagcgaatcaaagagatcctgattcaacataattcttcctcctccaaatactttttaatgaattataccattttcttaaagaaattactacaataattatctttttcttaaagttctgtgtcagagtaatttagaaaattatatcttctatagtaaaatcaattaaaaactgaacaaatttattgggaaattcaaatcgctttctgaaaatattttaggaaccgtagtgtaatattccagattcaattcactataaaactgacctttctcctgcaaaagaaaaaggaaagacttcctttcgtgcctttcctcttacttgctacttgtttgattatttttggtaagctactgcttgtctgataaaatcctgaatcggctctccttggtggagagcttttactattttcgaaccgacgataacaccatctgacaccgcattgaagcgttccagatcggcttgactagatacaccaaaacctgtcaagactgggatgtcggccacttgatgaagttgcgccaagtgcttgtccaaatctgcacggtaattgcctgatttccctgtcactccattgatggcaacggcatagatgaatccctccgccccttcaatcaactctttctggcgctcaattcctgtggtcaagcttactaaaggaatcaaggcgatatctgtatttgccaaaaatggttctacaaagttggcatgttcatgaggcaggtctgggataatcaagcccttcacagctgtatcagccagatctttgacaaagttctccacaccgtactgaaagagggggttgaagtaggtcatgatgaccagtggaatctctgtttcaatggttttcaaggtttcaactaaagcctgggtagaggtcccgtgggctaaactgcgcaagccagcttcttcgataacaggtccatctgcaacagggtctgaaaagggaatacccacttcaattgcagagacacccaaatcttctaaaaagtgaattgtttcagcaagaccgtccaaacctttctcgtggtcaccagccatgatatagggaacaaaaattccttttccagctgctttaatagcatttaatttttctgttagtgtcttaggcatgagcttctcccttctttgctgcatctgcttccaagcggtccttgacttgaaccacatccttgtccccacgacctgataggcagacaatcatagacttttctggtccaagttctttggccaatttcaccgcaaaggcgatagcatggctagattccaaggctgggataatcccttccacacgagacaagagttggaatccttccaaggcttcttcgtctgtcacagggacatagctggcacgtttaatatcgtggtagtgagaatgctctggaccgataccaggatagtccaaacctgctgagatagagaaggcttcaagaatttgaccatgggcatcttggagcacatccatgagggaaccgtgaaggacacctggacgacccttggtcaaggtagctgcgtggtgctctgtatccacaccaagccctgctgcttcagttccatacatagctactgactcatcttctacaaagggatggaagagcccgatagcattcgacccaccaccaacacaggctactagggcatctggcagatctcgacctgtcaagtcacggtactgttgtttagcctctcgaccgatgacactttggaagtcacgaacgatttctggaaatggatgaggccccaaggcagaaccaaggatatagtgggtatcgtcgatattagccacccatgaacgaagggctgcattgaccgcatccttgagcacgcgcgaaccatctgttacagcctcgaccttggctcccaaaagctccatgcggaagacattgagggcttggcgtttgacatcttcctcacccatgtagatggtacattccatgttaaagagggctgcagcagttgcagttgccacaccgtgctgaccagcacccgtttctgcgataattttctttttacccatgcgtttggcaagccaaacttgtcctaaggcattgttaatcttgtgggctcctgtatggttaaggtcttcccgtttgagataaatcttggctccgccaatatgctgggtcaagttttttgcgtaataaagaggagtttcacgtcctacgtactggcgcaaaagctggtttaattcctcttggaaacttgggtctgcctgactttcacggtaggccttctccaactccaaaactgctgtcatcaatgtttctgggacaaaacgtccgccgaattttccgtaaaatccatctttatttggttcctgatatgccatgctttaccctctctataaatcttctaatcttttcatgatctttttgtccatctgtctccactccgctcgatacatctactgcatagggagtaaagtgttgaattgcttttactacattatcttcattaaggccacctgcgataaagaagggctgtgctagtccagtcgtatccagttgaccccaatcaaagggctggccacttcctgccacaggggcatcaaagagtagataatctgcctgagaattggggacatgcccatttccatctacctgcacagcctgaatactggcacaaggcaaattctcaaataaatcatctgccacctgaccgtgaacttgaaccaagtccaagccaactttgtcaatcgcttccagcagttctacccgacttggtgaaacaaatactccaacctttttcacatctgcaggaataagctttgccaactcagctgcctcttctaaagtcacctgtcttttactaggtgcaaagacaaaaccgatatagtcggctcctgctgaaacggctgtttccaccgcttctttggtcgatagtccacaaattttaacctttgtcaatctgcaactccttgattctctgggccacattttctgcctgcataagagctgtccctaccaaaattccgttaaagtatggggctagtcgttccgcatcctgccctgtgaaaatggcagattcagaaatgtaatagcgaccttcctcaaagtaaggggctaaatctacactggtctgcaagtcgacctcaaaggtagtcaagttgcggttgttgaccccgataatctcagcaccaagtctgtgggctacctctagttcagctagattgtgagtctccactaagacttccagaccaagctctgtcgcgtagtcatacagttccttgaggcgttcttcggacaaggctgccacaatgagcaagataactgtcgcacctgcattgcgagcgcggatgatttgcttttcatcgatgataaagtctttgttgagcgtcggaatctctacctgactggaaatttcccgtagataatccaaatgccctttaaagaaaacctcatctgtcaacaccgaaatcatcactgctccgttttcttcataagtctgggcctgttgcacaatatccacatcgagattgatatctcccaaactagggctagctttcttgacctcagcgattacctgcaagcggtcctgatgattcttcaaaaattctgccaagcgataggtctggcgcagaggctggatttgctccagcttcatctgctccacctcacgcgccttctgctctaagattcgtgctaaaaattcctgactcatttttggtactcctgtaacagtctgagtttttcaagggccttgcctctagcaatcacttgacgggccaaggcaaccccttccttgatgctatcaatcttaccattagcatagaaaccaagaccagcattcaagactgtcgtttccaagaatggacttgcttcgtttttcagaacgctaagcaaaatttctgcattttcctgagcattcccaccacgaatatcttccatagcatagccttccattcccaaatcctctggagtaaagcttgacaagctgatttcgccattttcaagaagtgcaatcttggttgttccgttcaagccagcttcatccaacccttctggtccagcaaccacgatggcacgtttgcgacccatatttttcaaaacctgagctgtactttctaggagttctggacgactaattccaagaagctgtgtttctaaagccattggatgaatcagtggaccagtcaagttcataatcgttggaattcccaattccaaacgagctggcatgatgtatttcatagctgggtgcatatttttagcgaagagaaagacgattccagttttatcaaagaccttacctagttcagctggtttgaggtcaagattgattcccaaggcttcgaggacatctgcggaaccagatttagaagatatcgagcggttaccgtgtttggccatgtgaataccgccaccagccaagacaaaggctgcagttgtggaaatattaaaactgaaagacttgtccccacctgtaccacagttgtccatggcatcatgaatctcagttggaatatgctgggcatgtcctctcatgacttgggcaatggctgtgcgttcttcaggtgtttcccccttcatcttaagagctaagaggagagaagcaatctgcgcttcagttacacgcccagttacgatacgctcaatgacatccgtcatttccacacctgataaattttcaaattttgctagtttttcaataatctctttcatcctagtttcctcactttacaacctcctcgataaaattccgaatagaagacaagccgtctggcgttccaatgctctctggatggtactggaagccataaatcggtaggtttttatgttgaatccccatgatggcttggtcatcagtcgaacgagctgtcacttcaaagtcttctggcatttcctcaatcaaaatactgtgataacgcatgaccgcacggccatcctcaataccttgatacaaaacagatggcgcttcaaagttgatattgctctgtttcccatgcatgacttttggagccaaacctagcttaccaccaaagacttctgcaatggcttggtggcccaaacaaatcccaagaatcggcttcttgcctgcaaaatcacgaatcatgtcttccatctttccagcatcaactggccaaccaggaccaggagaaaagaccagaccatctgctttttcagcttcttcatacagcttggaatcatcatttctcagaacctgaacttctgcaaaattcccaatgtattgggccaagttataggtaaaagaatcatagttgtcaatcaataaaatcatggtcttagttctccaattctagtcatagattttgctttgttaatggtttcttggtattcgttttgggcgatagagtcgtagacaatccctgccccagcctgcacataggctctttgatttttgagaatcatggttcggatggcgatggccaaatccatatcacccgtcgcagacaagtagccgattgccccagcgtatactccccgtttttccgtttccagttcatagatacgtctcatcgctcgaatctttggtgctccagaaacggttccagcaggaagcgttgctttcaaggcatccatggcagtgagttctggaagcaaacgccccttgactacgctggtcaaatgcatgacgtagcggaagagctccacttccatatacttagtgacttggacactggtcgtttcagagatgcggccaatatcgttacgccccaagtctaccaacattcgatgttctgctgtttccttctcatcagagaggaggtcagtcgccaaggccttgtcttcttcatccgtagcccctcttggtcgcgtccctgcaatcggattggttgtcacgatgccatttttgacagaaaccaaactttctggactagctccgatgatttgataatccccaaaatcatagaaataaaggtaattagaaggattagtcacgcggagatttctgtagaagtcaaatggatttccagtaacttctgctgaaaaacgctggctgagtacacattggaacatatctccgttacgaatcaagtcacgagctgtttctaccattccctcaaacttatgtggagcgatatgcggtttgaagtctaacggagatagatccaaatcttcaaattcatttggagcaggaatgcgtaattcctcaagcacttggttcaaggatttttccaaggcctcttgactgcgctcactataaagtgcatcctctatgacatgtatcttctccttcttgtggtcaaagaccatatagctctcatagacaaagaaatgcatgtctggcgtcccaattgtatcctcagggatttgaccaatttcttcataaagcgaaatcatatcgtaacccacaaaaccaatggctccaccaccaaaaggtagctctgagtggtgctgactcttatgaatcacttcataaaggaaatccaagggatcccgatcaatcacttgaccattttgatagagaaccccattttcaaacttaatctcaaaaactggattataggctaggatagaaaaacgagctgtttccttgtctctcggaatactctctaaaataaccttatgttgcccctttaagcgcatataagccaagattggtgataagacatctccatgaatgattcgttccattgtaatttccctttcagttctacttctagtccgtggtgactgtatgaaaaatccccacgcaaaataacttgcgtgaggacgaaattcgcggtgccacctcaattataggatttctcctatctctcattcctgtctcagatatctcctgtaacaggctgtgcgataaagggcactcccttgagaatgatgttttcttctctcgtttcagatgaacccaactttacagctttctctgcttgttttcagcaaccacaagctctctgtgagagaaagaactgtaatttttccatctattattttttagcttctagtagtctgcaatcgcagctaggtccttgcctccacgaccagagacattgatgaagagatgttcatctcggtacacctttatactcttcgaaaatctcttcaaaccgcgtcaacgtcgccttgccgtaggtatggttactgacttcgtcagttctatctgcaacctcaaaacagtgttttgagctgacttcgtcagttctatccacaacctcaaaacagtgttttgagctgacttcgtcagttctatccacaacctcaaaacagtgttttgagctgacttcgtcagttctatccacaacctcaaaacagtgttttgagcagcctgcggctagtttcctagtttgctctttgattttcattgagtattactagcttttttcgtattagtccagcctttttgtttgcttttagtagtaggcatggagctgtagatagaactcaagttcatcaaagcgacttaaggccctaataaaagataaaccaaacgacggatagaaaaaagcccacacacagaatatacttccgtgtgagggcgttggtaacgcggtgccacctcaattataaagggactatccctttacatctctgccttgtttaacaacaagctgcactgtaaggtgtgcgcaccgaattttcattgtttcaaattcattttcaaaatcagcccactttcactacttccaaccacctattcacaatcaccacaggctccctgaagatcaaaaatagttacttttctgatttgttgaacttattttaatactttgttttttctttgtcaagacttttttacgatttttttgaaaatatcattcgaatatgaccatgtcttccttagatcgaacatgaacatgtcccacttcttagaaattggatccaactcaatagaaactgaatggaggctaaacagaacttattttagaacactccatcttttccactaggattttcaagaattaaacaatactagaaactctgtctcctaacaaatttaggagaaacttcaacagatgtgacactttcccctttaataattgctaaaacaccttctatcatttctttagccaatttaacataattgggagcaattgtagacaaagctggagtataatactgagaaataggaatattatcaaatccaatgatagaaatatcatctggaataagaattcctttctcatagcacgcacgaatcaagccctgaaccttttcatctcctgaaacaaaaataatgtccggataattttgggtagtcaagtgctgcattgcataagaataaactgaatcaattgtagataagccataaatgacttttaaatccataaagtaatttttatcattcagaaaagaacgcacacctctttcacgatccttattaacatgggattctcctcccataagcaaccacatatttttaaatttttcttcagttacagctttcatcatatcataagtagcttgaaaattattattagatacatagactactccagacgtttgagattcaccgaaaacaagaaaaggcatatggttcttctttaaatactgaattctgatatcatctacactttcataaaaaacaataacaccatctactaggctacctgtgcttgatataattgaattactaattgtatcctcctctccaaagtactcaactatagcattaacaccaaattctttacacgtccgtaacactttatctaacagcgtatgaaaccaaattaaaggaaaagagtcgattttttttacagaaatcaatatatttatagcttcttttttagttaaattttttgcatacgcatttggaatatacgacaattcctctataactttttgaatcgcttgataagtttcttctttaacatttactccaccattaataactcgtgaaactgtttttggagaaaaacctgataaacgtgcaatatcataaatagttacctttttcccatttatatttttcatttcagtcctccattacgaacattctaatattactatacaatatttaattttttttaacaagagaatttagtaaattatttaagatccacaaattcacaaaattaattttacaaatattcttccccttcaaaaaagtttaaattgcatttcacacctttatttttaagaatgtttccaacttcacgacaaataaattcatatgagaaaaaactgccataaaattgtagattaactttttcagtaaaatgtgtaggatttataaaaacatataatagcctgtcaatgtaacattttaacatagagttaattttttctttaaagataacatttgttatcaactcatcaggaggtaaatgaaaggcaaacaccatttcacaaatatcataaaaagaaataaatttgtatacttgtatcaaacaattattatcaaaatattctattttacctaaatcaaaattgattttataatctttcataaaaacctctgagcaaaaatctactcaaaaattagatgattaaaacatctaaaaagcaaaaggacaaaaacatctgtccctttgtttactaaatttcagctaatttcttcgacataaataacacctacaatattagcaatttcttccatcagtcgaagatgttcaaatctacctgataattccagagtaataaatgacgctatttttttgtccggaacatcaaagtattcaattctgtcagaattaacatctccaaacgctgttcttgaatcggtcattctgataccattttctgcacaataaaccaatacacgattataggcttctgtagatttaaccactatatacaattcaatcattttagaacgattttgcagatatttttttagtggttggaacatggatatcacaccccaaacagaaatggctactaaaagagctccctcataagg

SEQ ID NO: 192 - DNA, 6867 bp; double-stranded, linear
cgggacattctcaatcttctgtcttttgtttttctcttctttctatgatacaatggaaaaaataaattcaaaaggagtttttttatgacttatccaaatctcttggaccgcttcttaacctatgttaaggtcaacacgcgctctgatgaacactctactactactccaagtacacagagtcaggttgacttcgcaacaaatgtcctaattcctgaaatgaaacgtgttggactgcaaaatgtttactatctaccgaatggttttgctattggaaccttgccagccaacgatccgtctttaacacgtaagattggttttatatcgcacatggatactgctgattttaatgctgaaggagtcaatccacaggtaattgaaaactacgatggtggtgtgattgaactagggaattctggtttcaaactcgatccagctgacttcaagagtcttgaaaaatatccaggacaaacgctcatcacaacagatggaacaaccttgctaggtgctgatgacaagtcaggaattgctgaaattatgacagccattgaatatctaactgctcatcctgaaattaagcactgtgagattcgtgttggttttggtccagatgaagaaatcggtgttggtgccaataaatttgatgcagaagattttgatgtggattttgcctacactgttgatggtggtccactaggtgaacttcagtacgagactttctcagccgctggtgctgaattgcatttccaaggtcgtaatgtccaccctggtactgccaaagggcagatggtcaatgcccttcagctagcaattgattttcataatcaacttccagaaaatgaccgacctgagttaactgaaggttaccaaggtttttaccatctaatggatgtgacaggtagtgttgaggaggcgcgtgcaagctacatcattcgtgattttgaaaaagatgcctttgaagcgcgtaaagcatccatgcaatctatcgctgataagatgaatgaagaacttgggagcgaccgtgtcactctcaacttgacagaccagtactacaatatgaaagaagtcattgaaaaagatatgactccaattaccattgctaaagccgttatggaagatctaggtatcacgcctattatcgaaccaatccggggtggaacagacggctctaagatttcctttatgggaatcccaactccgaatatctttgcaggtggcgaaaatatgcacggacgttttgaatacgttagccttcagactatggaacgtgcagttgataccatcattggcatcgtagcttataaaggctaaaaagacgaggtagctcagctacttcgcctttctttttattctactggtttttcttgatttccagtagttgtagaagattctgttgtttcattttctgaagttgattcagcaggtttagaatctcttgtattgcttggtttgttttcgtcgctagcagtttcaatgttagattctgcagttgcgtttggttggttctcagcactggtgttatcaccatttgcttcagcatttcttgctggacttgtttcttcacttgcgctagcttttgactggatttgatgattcaaaactagaatagcttttgtcgattcaagtaaagctgttttgtctttactcttagcagaaagttgatctaataatgcatccaccttatcaaagtccgcatcagatccattattactttctaaataagagtgaagcgacatgagaatatcgtagagtttttgatagagtacaagtgtctgaggatcttgctcagcattttccttttcttgttgaagggcgctagcgatacgagtcaagacatcttttacctgactgtttacttcatccaagtctgcatcagccttgtttgtggcagcttttagattttctacttcttctgccaaggattgtctgattccttcttcatggatttgttccaagagttgatttgccttgctcaaaagactttctacttcttccttgctatctgtcgcagattattggttgctatctaccatgtactcctaaaacaggagagttataatccaagattacaaggccttacagaaataagaaatccagataagacaatgttcgtccaagacgctattcgcttcgcacagcagcacggattcaatatgctttaattttaaagtttaggtgtcaagacctctttttagtgtgcccaaaatttagagaagtaatcaatcaactaacttttatttttttcaaactttcagtaaactgacctaaagctaactcaatctgtctttgtagatgcttctgctatcagctagaagttgatctacttttgccaagactgccttctcatcaaaagttccaggttgatagttggattgcagggatggaatcttgtttttcaaagccgcttcatatcccttagtttgaaccttgatgtagtgattgtggtcgccatgaggaatcacaaaaccttctgaatcttcacttataattcgattggcatcaaaaccatgaccatcttcttcctcatgatggacatgtagtgacggattacttaatacagaactagaagaacttcctacctcttccgtgttagagtgtgatgggggattgttaagagatgacttaggaatatagtgatagtgatccccatgtcttactatataagcatcacctgtatctctgacaatatcattagggttaaagacatatgtggctgctaattcacctgccgacaagtcactctcaggaatgaaatgatagtgaccaccatgtggtactatagtagattgaaatagaatatgagcaaattgataaggggattttaaagtaatttctaacaatgatttagaaactatgatgtgctattctaaattcaactcactatatataaccatcatcggtagtataacgtccctgtaattttgctacagatacttctgcactagctcctttatcgtctttaccatgttcttgtttttggcgattgatttcatcttttgttcgtacattttctgcatgagcttgatctttaaggtaaacataatactttccatctaccttaataatatatcctcccttaacctaactgacgatatcttgatctttcggctgatagttgggggctttcattaatagctcttcactaaagagcgcatcaaaaggaactttaccattatagtagtgataatgatcgccatgagaagttacataaccttgatctgtaatcttaataacaatttgttttgcttgaattccttctttttgactaacctagtctggagtcaaattttcagtcttcttagtgtctttattactgtttacatatgaaacacgatttttatctgtattggcctgttagctatgttggttcagagcataaacacacagacttaaggaaaggataacaacagatccagctgctatatatttctttttaaatttcataattacctcatttctataattatttatatgatgtcttcattattaaatgattaaataaattaattaaccaattaattaactagtaaatattccacctctttttaagttgtatgtcaagaaattttatatattaataataaaatgaaattctcccaaagtcagagttttatttctaacttttgagagaacttcatttttgattcagactttttctactgctattccttacgctatgagatcagataaattcttttttatcacttctccacttggcaatcttaattcaatcgttccatccatattgaatataacactatctaagcctaatccgtaactagctgtaaatttttctaatttttcttgtacaggatctactgctggagcttcctctaatgctggatctaacatagggtcactccccacattcccttctggattcaacattccattatccgttgagttttctggttttacaggtttttcgtttggtgcctctggtaaagaatctgctggtttattttctgttggttggttctcaactgttccagtagatacttttccattttcagatggtttattttcaccatttccttgaggtgcttctcctgtaaaatctgccatattctttttaatgacttctcccgatggtaaatataattcaattgttccgtccatattaaacaagacattttctagcttcatcccataactttcagcaaattttgctactttttcttgtacaggatccactgtaggaacttcttctaacgttgaattactagtactattcccagtttcagaaagtttttctttttctaccttctcactagtctttggttcttctaccttttcatcaagttttaagttttcttgtgctttattccttttaaattgtggtagaatacttggtttatcagtttgattttctttttccaagataggtacttccacaatataagtcgattgattgtccaaataagcatttgccatgaaggttacaggaattttatttccggccgttctggttgttccttggtttaatttcggaatcggtaatttgatttcaccaactttatagttattttctaaataagcatttccatgaaattcatcaaacactctgactaaagcatcagttcctttaggcactgcaaattgagggttcactcttaaataagtatcccctgcatggaaaggatagaaaatcgtttgactggccattttgtaagctaaagaggttggaactgtaaatgtaccatcataacttacttctggataatcttttgaagcgatagtatacttaaatgtttgtcctggtaaataaggttgatctaattcaaagtttgcaatattccctactccttctccaaatactttaccagatactttctccaatacttttccatctggtgttattaattttactagcatattgatacctaattttttctccaattcaggcggaaaactaaaagaaacgcgtttttgaccattggctagagtaaagttttgattattaaacgtactattttttaacaaattaacaacattcgttaattcttctccagtataaactttattcccttcttttttagcaactccttcttcgggtttaaacagttcatagttactgtgagaatgaccaattccaaccggtttatgttcatcaatcggatctgcatgatggtgatctccatgcggataaataatcgcatttttttctttattcacgacaatactttcacgtttgacaccatattgtttcataatgccagcaattttttcttcgatttttttatctaaatctttcatttctttggcattacttggataatcctgttcatgagatgacaaagaatctaatccattatgactagttttaacttcctctaaatgtttttgcgcascttaatttgctcttctgtcaagtccttcttgaagaaataatgattgtggtctccgtgactcatgacaaaacctgattcatcttcagcgataatacgattagcatcaaatccgtatccatcttcttcatgtttctcatgtgaagttcctggattgattggaagagatggagaaggtgttgctagactattgtttggaagagtcggttgcccaatttgatttgattttggaatgtaatggaaatgatcaccatgtcttacaatataagctgtagccgtttcttcaacgatatcttttggattaaaaatataaccatcagatgctgaagagagctccttacttgtcgttaaagaagaaggattgcttgaaagactgcctagactagacactacttcattaggttttgcatttgtagaaactgtagaaccagttccactgataggcaccattctggcaatcttttcttctaaggcagaaagcttgctgtaaggaataaagtggtaatggtcgccatgcggaatcgcaactccatttggtgtacgactgataatcttagcagggtcaaagaccaggccatctgattcactgtaacgttgggcgctaggtgaatcatagagttccttcaaaagactctggagattttcagatttatttgctggcttgctagttgatccttttgctacagattgcgtgttattgtcactagctgttgaagaatagcttaactgactcggttgcatattttttccagccagatgtgctttagctgctgctaattcactagcagataaatcgcttttgggaatgtagtgatagtgacctccatgaggaacgatataagcattacccgtatcttcgataatatcagctggattaaagacataaccatcatttgtcgtatatcgtccctgagaccttgctacagcaacattagagttaaccttctcattatctttgacatgttcttgtttttgacgattgatttcatctttagttcgaacattatcagcatgagctgcatctttcaggtagacataatattttccatcgaccttgatgatataaccacccttgacttcattgacaatatcagcgtctttaagttgatagtttggatccttcatcaagagttcttcactaaagagggcatcataaggaactttcccattatagtaatgatagtggtcaccgtgtgacgttacatagccctgatctgtaattttgattacaatttgctcagcctgaattccttctttctggctaacctggtctggtgtcaagttttcacttttctgacttgactggctgccatccacataagagacacgattattgtccttattttcctgcgaacgatgctggtttagtgcataggcacatagactcaaggatacgataacagctgatccagctgctatatattttttactaaatttcataaatccctcatttcaataaatgatgaagttttttctcaacttcttttactttattaaatagttttctaaacccgggggtacc

SEQ ID NO: 193 - DNA, 999 bp; double-stranded, linear
cgttctaaaaatgcagtacgtttgattgagaaatcagttaaaggtatgcttccacacaatacacttggacgcgctcaaggtatgaagttgaaagtatttgttggagctgagcacactcacgctgcacaacaaccagaagttcttgacatttcaggacttatctaaggaaaggaacaataaagtatgtcacaagcacaatatgcaggtactggacgtcgtaaaaacgctgttgcacgcgttcgccttgttccaggaactggtaaaatcactgttaacaaaaaagatgttgaagagtacatcccacacgctgaccttcgtcttgtcatcaaccaaccattcgcagttacttcaactgtaggttcatacgacgttttcgttaacgttataggtggtggatacgctggtcaatcaggagctatccgtcacggtatcgctcgtgcccttcttcaagtagacccagacttccgcgattcattgaaacgcgcaggacttcttacacgtgactcacgtaaagttgaacgtaagaaaccaggtcttaagaaagctcgtaaagcatcacaatttagtaaacgttaattcgaaagaattactatacttatacagagcacctttcggggtgttctttttttatactttcttactaaattggtgcaattgacacagttgttgcgactttagtcgcttacaaatgtggctgcaacctgacatggtcagttgcctcaaaacgttaatcaatacgattatatcaacgtttcaaagcactcaagggtttaccctatgggtgcttttttctatactttctaaaaaagtttaccctaaaatttgccctaaaattaccctacttatttttaagatgttggtaggcaacttgtccagcagataatggaactatgtttgaagtattaacataagtcttagttgtaacggtatcgctatgagttaatgcttcagaaatggcttctaagctcattcctgcttttttagcaagtgtcgctcctg

SEQ ID NO: 194 - DNA, 2315 bp; double-stranded, linear
aatattatcactgttcttgaaggcagaacacaagctgtcatccgaaatcactttcttcgctacgatagagccgttcgttgtcaagtgaaaatcattacgatggatatgtttagtccttactatgacttggctaaacagctttttccgtgtgctaaaatcgttctagatcgtttccatattatccaacatctcagccgtgccatgagtcgttttcgtgttcaaattatgaatcagtttgaacgaaaatctcatgaatacaaggctatcaagcgttactggaaactcatccaacaggatagtcgtaaactcagcgataaacgtttttatcgccctacttttcgcatgcacttaacaaataaagaaattcttgacaagattttaagctattcagaagacttgaaacaccactatcagatctatcaactcttactttttcactttcagaacaaagaccctgagaaatttttcggactcattgaggacaatctgaagcaggttcatcctctttttcagactgtctttaaaacctttctaaagaacaaagagaaaatcgtcaacgcccttcaactaccctattcaaacgccaaattggaagcgaccaataatctcatcaaacttatcaaacgcaatgcctttggttttcgaaactttgaaaacttcaaaaaacggatttttatcgctctgaacatcaaaaaagaaaggacgaaatttgtcctttctcaagcttagcttttcttcaacccactacagttgacaaagagcctattttcgctgattctccactacatttgactggattctaattttttagagaaatacaaaagagctagctttagctagctcttttcctatgcggagagagggacttgaaccctcacgacctaaagcggtcacaggatccttagtcctgcgcgtctgccaattccgccatccccgcgtcgattactttactagtatatcaacttttgggatgcttgtcaacactttttttcaaattttttcattttcaccaaccaggttactcaaaaagttcatttagattttcatctactaacttagctccgagtgtatttttgaaatgacctagggcaaattgatgattttcaggccagatggaagcaacagctggtttaacaatctcgatgtcatatcctagattataggcatctatagctgtatgtaggacacagatatccgtcaagacacctgttaagataacggtagacactctacgctctctcaaacgaatatctaggtcagtccctgaaaaagctgagtaatggcgtttatccatccaaaagacacgactgtctgaaccatgctcttgataaaagatccccaaatctccatataaattccgtccactcgtcccaatcagattatgaggaggaaataacttactttccggatggaaacaatcgttttcttcatgagcatcaatagtaaagaagatataatctcctcgttcaaaagctaatcgagttaccttgctgatggcatccgaaatcgcctgagctggagcacctgctgttagtttcccactatcagcaacaaaatcttctgtataatcaatcgaaattaaagcctttgtcattagtaatctcttttcttcacttcttcaaaaatatctgaaatcaagaccttaagataggttcccttcattccaagtgagcgactttcaataatccccgcagactcaagtttacgaagagcattgacaatcacagagcgagtgattccgatacgatctgcaatcactgacgcagtcaacttcccttcatttccatttaattcccctaaaattgctgaaacagcacggagttcggagtaagaaagggtattgaccgccatggtgacagcagtacgacgacgaatatttttctcatcttcttcacgttggaagttaagaagctgaatcccaacaacggtactggcaatctcaacaagaaccaagtcctcatcttcgaattttttatcattacgccaaataatcaaagaaccaaggcgaatccccgatacatgaatcggtgcaatagtcgtcaagccatctggaaaatcatctctactctcaatagggaaaatactcatatcatgctcaacaggcaagtttgcttctgtttcgtaaatcatattagccccttgaacgtagtcatctgggaaaatcttagtttggaagaattgcttacgcgatctgtatttgttttataacgcataaaatagccaagcagacgtcccttactattgataatgcaggcattgcaatgaataatatccgctaactgacgcgtaatagcgttgtaagggagctcatctcg

SEQ ID NO: 195 - DNA, 6693 bp; double-stranded, linear
cgatttcttccatttcttcaaataagaatacttcatctgacatatgtgttaccttcttcatcaaaaattattttgtaatcgattacattgcagatcgtaacataaagaaaaacagatgtcaaatattaaacgtaaaaacatggtcactaaagaactataagagaaaaggtaaacctagcgacgcgatgaacgctgggtcgtttggtttcgattgctctcttcctcttgttttttctgttcttcttcttgttttttctcagcttccttggcctcttgtttggctttttcctcagcttccataattaatttatccgccacagtgtagctgtagattccagcttccatgtcgaccacactcggttctgacaattgaggcttaatcttactgtaatatggcagtttcttactcatttcagatagaggaaccaagacttcgtccgaatcattcatggtcaatcgaattaaatcggatgtcaccttgcttggggctaattccaccttttggatagccgccttgagttctgggctaatttgagcaagttctgagacaaaaactttgatttgttcactatcattaaagagaactgataaataagtttctggtaaactgttcagactcacagaactagtctcaagctgaccactggaaagaataggataatgattttcaccagaaatatagtaggccacaatatcatattccttgaccttaatagtgaacttagttggaaattgatagacaagttgagctgattcaacccaatagttagacttaatctgcttttcatattttgccttgtctagcagaaggttaatcgtataatccgaatcctgaatgcctgaagcctgtcgaatatcatcagctgtagtttgcaccgttccctcaacacgaatatctttcatggtcgcataaggactgagcaagtaggcagagacaaacaatagaagcagacttggaaataaaatcgtgaaggctcgcaagatatggataccaggaatctttgctttggctggtttttcctttgtagcctttttagcaagctttttatcctgttcctccttctctttagactctggttcttctttctcttctttctctttgtcagcctctgaggatgctactttttcttcagactcttccttagctgattctgaatcttcctggtctgtttcactctcctggtcctgtttatcctctgacttctcagattcttctcccattcgagcttgtctttccttttccttctcctcagctagagccgcctcttcttcagccttcttttttagatattcttggtttcgtttctgccattctgataactctttcaattcttcgagggtttctttgtcctcatttttcttatcttttgacatttactttccttatgataaatcttttttcaacaattgataaaaatctgctagagatttcaattccttagaagctttcatcttagcttggtaatcttccttgtgacttagtaagtgagaaagcttctcttccaaactatccaaggtcaaatcgctttcttgaaggtcttctgcatagcctttcttaacaaagtaagctgcattttcaatctggtcaccacgactagcttcacgaccaagcggcacaatgacatgcaattttgctatcgccaagagctcaaaaatcgtattggcaccacctcgtgtcacaacaatatcagccaattccatcaagggttgatagagatcggtcacatagtcaacacgaaaaagattttgcctcaactcattcagactagaatctccagttagattgataatattgtagcgctctgttagttctttcttatggtctgtcaccaattggttaaagacacgagcgcctgcagaaccgccaacaaacaatacagttggcaatttgggattaaagtgggtttgaatatccaccaattcatctggttctggagtgtttttgtccgaaaccttggtcaccgctcccacatgctcaaccttagccaaactcgaagcttgttcaaaggttgaatacatcttagtcgcaaatttataggcgattttattggccaagcccatagacaggtcagattcgtgaataaagacaggcactcctgacacacgcgcagcgataacaggcggtactgagacaaagcccccctttgaaaaaagggtctgtggacgcagtcgcaacatgataaagagcgattggacaattccccaaccaactttgaagacgtccagcatattttgccaagagaaatagcgacgcaattttccagtcgcaatagaatggaaggtgacatccaaacctgacttaaggatttcttggtgttcgataccacacttgtccccgatatagtggacttcccaaccatcttcgatgaacttgggcattaacaaaagattgagggtaacgtgtccaaccgtccccccacctgtaaagacaatttttttcatattattcttttaactccgctactgtgtcgataaagaggtcgccacgtacttcaaagttagcatacatatcccagctagcattggcaggactaagaagaaccacatctccttgagtcgcaagctcataggccttgcgggtcgcatctgcaatatctgtcgcctccacataagcgacaccagccttgtctgctgcccgtttgacacgttctgcagattgacccaggatgaccatcttcttgagtccagtaatgtctggcaccaattcgtcaaactcattgccacggtccaaaccacctgcaatcaagacgaccttgctgttgtcaaatcctgacaaggctttttgagtagccaagatattagttgatttactgtcgttatagaatttaacacccttgatgtcatccacaaactggagacggtgtttgacaccaccgaaggctgaaagagtttccttgatggtttgattgtccacatcacgaagcttggctacagcaatagtcgcaagggcattttccacattgtggctacctggaacaccgatttcattcgctgccatgactacttcaccacggaagtagagttgaccatcttccagataagctccatcaaccttttcaagtgttgaaaatggtacaacagtggcttctgtcttggaagtcaagtcttttgccaagtcttgattaaagttcaagacaaggaaatcagctgctgtcatcttgttctggatattccacttggctgctacatattccgaaaatgacccatggtagtcgatatgagttggcatgaggttggtaataaccgcaatctctggatggaattcttgaacacccatgagttggaaagaagaaagttccataacaagcgtgtccttatctgatgctatttgagcaacctgactagctggatagccgatattccctgataaaagaccatgttggccagcagcagtcaaaacttccccaatcatagtcgttgtggttgtcttaccgttcgatcctgtgataccaataatcggtgcttctgaaatcaaataagccaattccacctcagtcaagactggaattcccttggccaaagccttttcaatcatgggattgttgtaggggatacctggatttttcaccataagggcaaactcttcatccaagagttccaaaggatggccacctgtaatgaccttgatcccttcttccagcaaactttgggcagctggattgtcctcgaaaggtttcccatcatttactgtcacaatggcacctagcttgtccaacaaacgagctgcagattcaccagacttggccaaacctaaaacaaggactttcttatttttaaattgatctattactttcatgtctcgaactccatttctactcctactattttaccatttttatggaaataaaaaagccacaaagtgtgtttgtgactctttcttctaactgaatcttaccatatcatctatgtgataaatcggtaactcgaatgacctgatccacttgctcccaaatcagaggattatgggtcgcaataataatggtccgattcggattttttaaagattctaggatggaaagtaattcctcagagtttttggggtctaaggaagcggttggttcatctgcgaggatcaaaggtggatcctttaaaattatcttcgctagtgcaacacgttgtgcttctcctcctgataactcaaatataggttgcttcaaatccaaataagagaggtttacacggtttagagcttgtttcatcaaagagattttctctttttccttcaactttttaccaactaaacccagattgagattctctttgacggtttggctttcaattaagccaaaatcttgaaataagtatcctaagtaatctctaaagaaaacagaaggcttgatgtccttaagagaagtgccatcatagatgatttgccctttgtcatatggctccaatcgtccaatcatattcaagagtgttgtcttaccacagccacttgtaccgattaaggcataaattttcccaccttcaaaatgaagattcatatctgaaaatagctgacggcttccaaattttttagatatattctttagttcaatcatcctattttcctttcataattgtcatagaaacacgagattctttctgcgcttgacggtaaagcgtcaaaactgcactagctagaaagaccaataaagtgagcaagccaatcaccaagtctcgactgcttaaaataaagagactagcaccaaatacaaaactagcaaattggctaaccatatactgagcatgtgtttcaaaaaatcgtaaacctgaaattcgtttaatcaagatatctcggcggaattgctcgaaatatagaagattgacagaataaaagagtaacaaggaactggctattccaacaatagctcctaagattaaagttgctgtttcagtttgaacttcattataacgagttagataaacacttcttccttctttaagataggatacttgctcataaattccagctttcttcaagagttctagcccactctcatatcctttgataaagagttgttttccagcattgatagaccaactagataaggatataaaactatcacctgtagaagtcggcgtgaataccactaaaatcggatcagtcaaatactgagtagatacgggattctcaccgttattataaacaaaccgcttttctcccattgaaagataactaacgtgcgctttcatctcataatccaaaggagcacttgcctcctcaccagattttccataataactcaatctttcttcaaaaactttcttaagttctgcttctcgagagcgcaaatgttctgggagcaagaggataaactcacctttttggagatgggctaacttctgtttggtctcagcatctaccacgaccttttccttgtccaaataactgggactaacatagagcgtattagcatctgaactataggtatccagtgtctctccctgttcattttttccttgtggattggcaaaatggagcagattatcctttacataaagagcttgttcttcttcgattgcttccttggcaaaggcataccacttgctctgattttctgtatcttttcctctatcacctaagccaaaggaaatctggtaatagtctgctctgtcctgccatgcttgttttgaaatttcaagttctttcaatcgttggtaagacgtcaaacctgtcttaacagcgtagcctactgtaaaaacagctactaactgacacaatagggttaaagccatcaagcgtttaaggggtaatcttcccttaataacgggaactaatgctttgtaactcaaactcattaggtaaaggagcattagtaaaattgaaatcgccaataaaaacaacagatagaaactaatcccaaaaccataggtggctaacaagataggataaaacaaaccttgactaaaaagaacgactcccccacctaggaaggaaaggagggctgatagaaggagccatttgatatcagtagataaagaatgccccatgatggataagagagtctgaccagaaaagagttttatacctgctgctctcatttccttaatccgagtgataatcactaaagcaaagaaagataagccaaatattgctaaactaattaaaataaggggatttagtaatattcgaaaagcaagaaaatagggcggtatctttcggtcagcacttgctttataacccaaatctcctaatttatcggcaagcttttctttcgtcaaggagcctgacaaaaggagataactatttagcggantatacgttcacgactttcttggctagcttcttggaattcttttggtaaagttccctgaccataagttgcataagtaaagtgagtcgtcccatccttactcggctctacaattcttctagctattaaactctgttctgagtttgcaaaattctccaattcctgttcaaatacctcacgcgtcggttcctgagtatcttttttgacacgaagtaaagaaacggaatcatagcttgcatataaatattgtggcgcacgtaagacaataatccaagcaaggaagaagctgagaaaaaaagttgataataatatgaatagtttcttcatagtagactccttgtaaacaaaattccccctgtaatttcttacaaggggaacgatttaaatcaatgaacgattagtcataatcacagtaaaatgctacttgttctccccatttagtccaaatccatgcagg

SEQ ID NO: 196 - DNA, 1847 bp; double-stranded, linear
ccggtctatgtacccactactttgggacaatatggggatcagctacccaaaactaatcgagcgtttggttgaccttgccaaggaaagttttgacaagcgcgacgatttgatataaaatgaaagagagggtagaagccagaaccatcactgcacggtgactagagttctcggacttcagccctttttaaaggagtagaaatgaaattaacaatccatgaaattgcccaagttgttggagccaaaaatgatatcagtatctttgaggacacccagttagaaaaagctgagtttgatagtcgtttgattggaactggagatttatttgtgccacttaaaggtgcgcgtgatggccatgactttattgaaacagcctttgaaaatggtgcagcagtaaccttgtctgagaaagaggtctcaaatcatccttacattctagtagatgatgttttgacagcctttcaatccttagcatcctactatcttgaaaaaacgactgttgatgtctttgctgttacaggttcaaatggcaagacaacgactaaggatatgttggcgcatttactgtcaacaagatacaagacctacaaaacacaaggcaattacaataatgagattggccttccttacacagttcttcatatgcctgaaggaacagaaaagttggttttggagatgggacaggatcacttgggcgatattcatctcttgtctgaattggctcgtccaaaaacagccatcgtgaccttggttggagaagcccatttggcctttttcaaagaccgttcagagattgctaagggaaaaatgcaaattgcagacggaatggcttcaggttccttgcttttagcgccggctgaccctatcgtagaggactatttgccaactgataaaaaggtggttcgttttgggcaaggggcagagctggaaattactgacttggttgagcgcaaagatagtctgaccttcaaggccaatttcttagagcaagcccttgatttgccagtaactggcaagtacaatgcgacaaatgctatgattgcatcctatgttgccttgcaagaaggagtttcagaggagcaaattcgtttggccttccaagatcttgaattgacgcgtaaccgtaccgagtggaagaaagcagccaatggagcagatatcctgtcagatgtttacaatgccaatccaactgctatgaaactgattttagagactttctctgccattccagccaatgaaggtggcaagaaaattgcagtgttggcggatatgaaggagcttggtgaccagtctgttcaacttcataatcagatgattttgagcctttctccagatgtgcttgataccgtgattttctatggagaaaatattgctgaattagcccaattggccagtcaaatgttcccaatcggccacgtttactacttcaagaaaacagaagaccaggatcaatttgaagacctagtcaagcaggtcaaggaaagccttggagcccatgaccaaatcctgctcaaaggctctaactctatgaatctagccaagttggtagaaagtttagaaaatgaagacaagtgattttgtcaagtatttgcaaagaatgattgccattacagatactggcttaacctttacaaaagatccgtttgaccgtgagcgctacgaagacttgcgaagtctgttatctgaaatgttgaatcaagcatcagaccttgattccgaagaagtggcagaagtcttgaagccaacttctgcttatgcgactccgttaatggacgtccgtgcttggattgttgaggatgagaagatttgtctggttaggggacaaggagaggatagttgggctttgccgg

SEQ ID NO: 197 - DNA, 1062 bp; double-stranded, linear
caagcgaaaacattttttattccaaataaacagagcattttaggagaacaagagattttgaatgccaagtcgatcttggccttgctagacggtttggagtcacatagctatgatgtagtctatctccgtcagcctcttaatcgtctcgaatatatcgagtgtgcgatagtggggcaatcacaatttctctttaaggtcagttatgctgatggtcaaaaggcttaccgtgtcgatcttcctgacctactaacaaagacagactggcagattatcaagtcatttttagatgctttgcttgcttatacagggactgatattgaagggctagatggttttgattttgaagcttatttccaagcaagtattcaagcctatctagcagaccctgtagctcgttttacgatttgccaaggaatttttaatcctattttctttagtcgtgagaacttgaaaagctttttagaggcagatggcttggctcagtttgaagcgcgtgtgcgtgcggttcaagagacagatgcctactttgcgagagtttccttctatcaggatggagaaggaaaagtgcatggcgtttaccatctagctcaaggagtcaagacagttttaccgagagaaccgtttgttcctgcagcctatattgagcaattggtggataaggaagtccagtgggagattgacttggttcaaatcacaggagatggctctaaaccagaagactatgaagccattgctcgcttggactatgcaaaattcttagaggtattacccccatctttttaccaccaactagacgccaatcaaatagaagtgcaacccatattagacaaagattttaaaacattagcacaagaaaagtaaagcagaagcaggtcaatcgacttgcttttttgacatagaaaaaatcctgccaagatgacaggattgctactcaatgaaaatcaaagagcaaactaggaagctagccgcagctgtacttgagtacggtaaggcgaagctgacgtggtttgaatttgatttttgaagagtatgaagtttaaagaaaagccaagatacgaagat

SEQ ID NO: 198 - DNA, 6846 bp; double-stranded, linear
tatctacaacctcaaaaacatgttttgawggctcgtcagtctatctacaacctcaaaaacatgttttgaakgctcgtcagttctatctacaacctcaaaaacatgttttgacagcctcgtcagttctatctacaacctcaaaaacatgttttgagctgacttcgttagtttcatctacaacctcaaaaacatgttttgagctgacttcgttagtttcatctacaacctcaaaaacatgttttgangncntcgtcagttctatctgcaacctcaaagcagtgctttgagcgcttcgtcagttctatctacaacctcaaaacagtgtgttgcgcagcctttaatcagccgcctagtccgctctatggtattcattaagtcaacatctcttgtttaagagcaccaaatcaggaaatcttctcgattccctgattttttctatttacgttttcgtgttgagctacgttctgtcaaaccatgaggtaagagaacttcacgttcttccaactcttccttatgcataatcttggtcaacatacgcatactaatggcaccaaggtcataaagaggttgggcaatcgttgtcaagtttggacgggtaaagcgtgagatttgtgaatcatcactagtaataatttcaaaatcttctggcacagaaacacccttatcagccaaaccgttcaagactcctgctgccaactcatcacctgtcacaactgctgcagttgcatttgatgaaatcaaacgctctgctaaggcgtaaccatcatcatagctatatttagattcaaataccaaaccctcactataagtgattcctgcttttttcaaggtttccttgtagccaactaaacgaaccttaccattgatgtcatccactagcggaccgctaacgaaagcaatacgctcattttctttagcaaggtaactcactgcatcaattgttgcttgcttatagtcaatattgacacttggcaactggtgctcaacatcgacagttcctgcgagaacaatcggagtacgtgaacgcgaaaattctgagcgaattttatctgtcaagtgataccccatatagataatgccatctacctgctttgaaaagagggtattgacaacagaaacttctttctcgttatcttcatcgctattagctaggacaatattgtacttgtacatttctgcaatatcatcaatccccttagccaaactcgaaaaataaccattggtaatatttggaatcacgacaccgacagtggttgtctttttacttgcaagaccacgcgcaactgcatttggacgataatccaaacgatcaattacctctagcacttttttacgggtattctcttttacatttttattgccattgaccacacggctgaccgtcgccatggaaacacctgcttcacgagcgacatcataaatggttactgtatcatctgcattcattccttttcctgtcctttctatctcacacattcttttacaagtagaggtactgattgaagctctatatctacttacaaaagtgaagatgtgaaaatttcgttttcatatttctacttattccattctatcactaattgtaaacactttcaagtgttttttgaagattgattgaaaaaatttcatagaaaacctaggtttagctccttgctaccaccttagactaaacaaaaaggaggaaactaagccctcctaaagttatagtaaaatgaaataagaacaggataaatcgatcaggacagtcaaatcgatttctaacaatgttttagaagtagaggtgtactattctagtttcaatctactataggtattgttccattcactaccgtcaattttagcacatagtcttcatgaaaatattatatcatcataaccaaccagattctttcgcgatattagctgcctctgttcgattacctgcatctagtttcgaaagaatattggtgacatagtttcggactgttccgttggatagataaagtttgtctgcaatttcttggttagagaagccctgagcaattccctttaaaactgcgatttcttgctccgttaatggattgggatgcatcatcaccacttccatcaattcaggcgaatactccttgcgtccttcgaggacggtgtgcaaggtttgcatgaggtctgcaatgtttctttcttttaatacataagcatctactccagccttgaccgcacgttcaaaatacccaggacgcttgaaggtcgtcaccacaaccacctttgtttcaagcttttctgctcgtatccactccaagacttcaagacctgtcttaacaggcatttctacgtcaaggatggcgatatctacagactccttttctaatagttggattgcttcttgcccattcttggcttgaaagacagactctacatccggttgaagcatgagcaactggcacatggcatctcgcaacatactttgatcttctgcgactaatactttcatctactttctctccttataaagtagtcgaacctgcacttcagttggatgtttctgactgattacacttacttctcctgaaaatggaaaaacacgatttcggactgtatggagctcatccccgcttatagaggcaaagccacagccatcatctctcactgttagaatgagttctttctctgtccgttctaatttcaagtagactttagacgctttagcatgtttgatgatattggtcactaattcaagcaaaatcatggaagccgttgactccaattcctgagttaagctagacttgtccaagtgattctcaacttgaacctcaattccagcaatttctaacatctttttcacagtctctagttcggatgtcaaagttctagacttaagattttccacaatggttcgcacttcattcatggatccttgctgatctggtgaatttcttttaattccttttccacctgtggataagcctccatctgaaataactgcaaggctaaatctgtcttgacactcagcatagcaaaggtatgtcccagactatcatgcaaatcctgaccgatacgactacgttcattttcagcaagcaatagatttatctgagcattttgcttgacctgagcttctttcaaatcctcgacaatacgaatccgaaccaatccaaaagtcattaaatcgacaaaagtaagaattacaagtagatagaatagaaactcaacttcgattctctgaaaaatcaacagttgccccacaacaaggacttgagcaagaagaaaagtccagacatgtaaagactttaaactacgtacgctgaaatgataacttaagagattggataggaaaaagaaaaaccagatataattaacagcaacaaaggcagtattcccaactacataagtcagcatgaggccccaatatagccaagataggcgctggctcttagttgttaaaacacccaaatatgccactacaaatagaatatcaatcaataaatgccaggcagaaagccacccagtcactacagacaggatggggaaaatcataaaaattaaactgatccaaaacatataatgtattcttttcagtctttcaagcattaagcattctccttatgaccttgaaggtaaatggtcaaaccaaacaaaactactgaaaaaacaagtaaataaactgtggctgatagattgatgccaccctcatttaagaaggtcttgagcaactccatcaactgataggtcgggagacacttacctactacttgcatccagtctggaaataaagagataggcatccagagtccacctaaaacagccaaccctagataaagaagattgcccacgacagacatcaactgactagttggtaagagagtcaaggtcaaaccaagcgctacgaaggcaatacttcctactatcagcaaaagtgcagccccaatccaatttccaagagacatgtccacacctcttacaaaatgcccaactgagaaaaccaccaagattgaaaccaaataatcaaccagcatacttgttatctttgatagataatattctaccatatttacagggctatgacgcaatgttttctgccagttgttgatcttgtcggtatgtaaaacaactgggaatgagaagatagctgttgacatcatggaaaatgcagtcatggagataagataatcacgcataaaattcgcgagttcacctggtgtgtcctgatagataccagaaaaaaataaatagaaagccgtcggcatccctactgacaatagataatagatcaattgtcgtttggtcaataaaaattctatcttactaagtgctagccatcgtttcatcttagttatctcccttctgcgtttcttcaaagattgtatccaacaaactacgattattaacttcaatttcttgtatgccacatcctgcttgaactaacagttcccaaaaagcatctgcttcgcgtgtgactacttgtagagcatcctgtttttgtgaccagttttcaaccaagttagactgctcaatgacttccttgtatgccagaggaaggataaaatgcttttcaattccctcactacgcatagctagaggcgtcgtatcacgaatcaactctcccttatttaaaaccaaaatccggtcagccgtatgctctacctcttcaatataatgagacgaatagagaatcgtgactccttgcgcttttaggtcccgaacgatttcccaaaagcgttgacgagttgaagtatccatggcagcagttggttcatctaaaaagacaagctttggtcgcccaatcaaggtcaagacaaaagagaagagacgcttttgcccgcctgacaatttttctgcgaattgctctttttgttgctggtcaaactgcaatagttgatcgatttcctgatcgctcaaggaatttggatagatacgttgaaagaaagcaatcaactctttgacctttaatttctgaacgatgacattttcttgaggcagataacctctaatatagtctaactgagaactcgtcactgacaagccttggatggatacttgaccgcttgtgaccagtttatctccaagcagacagtccaagagtgtggtcttcccagcaccattgggcccaatcaaggcgacgcattcaccttcagctacctcaaaggaaatacccttcaaaatagccttgcccttgatgtttttatttaggctttctaccttaatcatattcatgatattctcctttcaaccactccattctcataaggaaaacgacgaaaatcataaatccaaaccccaaagcaccacgaatgaattggcgaagcaaggtttggtcaaaccaacctgtaaacatttccactaaccataccaagagtgacaggccgataaagaaatagatgatccctctcttcattcctcaagctcctttttcacatctccgactaatttcaaaccttctctaacaagccaagacatcattccaaagccagcaaagagctcccaaggaaaatgatagaaactctcatccaatcccgaaaacatgagttaggtcataactcctgctactactaaactcactgcgataatcattttatttctcatctcttcttcctccatttcatactacaattatagtcttttgaaatcagaggagacagaagcttctgtcactagaaaatatgacaaatgtcataaaaaattctgttcaaaacaagcaagatacactatacaataaaacacaattagaaaaatctaaggcaacttcctcaaaagagatatcaaacccaattcacaccataatgtaaactaatacttatttaaaatcaaaaagagtagaaatttttatcagacaaacacatatatagtgtattgaatctataacagtaggccttaaatactaaaatatttctataaattaatttaactttcctgatagagctgttcatatcttatttcaattctctaaattatacgttgaacaaaacccttctatttctttcttaaagatttataagagttataaaatctgttaaatttcaatgtgtatacctaaactacggtatttattgaaaagactggagacaaaaagtatacgctgccaaaatgaattactgaaaatcaaaaaagagagaaccaaactgattccctcttaatgtatataatatctagttttaaaaatacacactcacatatctctgtaatgaatcgggaagacaggattcgaacctgcgacaccttggtcccaaaccaagcactctaccaagctgagctacttcccgagttaaatagaaaaatgcaccctagaggagtcgaacctctaaccgcctgattcgtagtcaggtactctatccagttgagctaagggtgctccatattatgccgaggaccggaatcgaaccggtacgatcgttaccaatcgcaggattttaagtcctgtgcgtctgccagttccgccaccccggcctctctaagcgaacgacgggattcgaacccgcgacccccaccttggcaaggtggtgttctaccactgaactacgttcgcactgttttcttctatctaaaaatgccggctacatgacttgaacacgcgaccctctgattacaaatcagatgctctaccaactgagctaagccggctcatttgttatatcttaatgcgggttaagggacttgaacccccacgccgttaagcgccagatcctaaatctggtgcgtctgccaattccgccaaacccgcatatatgacccgtactgggctcgaaccagtgacccattgattaaaagtcaattgctctaccaactgagctaacgagtctaaaataacttgcgttaccttaaacggtcccgacgggaatcgaacccgcgatctcgccgtgacaaggcgacgtg

SEQ ID NO: 199 - DNA, 2911 bp; double-stranded, linear
gaattcattttaaataaagatacgggagaggtaagtgaattaaaacctcatagggtaactgtgaccattcaaaatggaaaagaaatgagttcaacgatagtgtcggaagaagattttattttacctgtttataagggtgaattagaaaaaggataccaatttgatggttgggaaatttctggtttcgaaggtaaaaaagacgctggctatgttattaatctatcaaaagatacctttataaaacctgtattcaagaaaatagaggagaaaaaggaggaagaaaataaacctacttttgatgtatcgaaaaagaaagataacccacaagtaaaccatagtcaattaaatgaaagtcacagaaaagaggatttacaaagagaagagcattcacaaaaatctgattcaactaaggatgttacagctacagttcttgataaaaacaatatcagtagtaaatcaactactaacaatcctaataagttgccaaaaactggaacagcaagcggagcccagacactattagctgccggaataatgtttatagtaggaatttttcttggattgaagaaaaaaaatcaagattaagataaaagctatagaaaaaaatggtttatgtactgagattagatagtgaggtgatgacatagttttgtgaaaatagccatttataactcaattatttagtttactttactttactagtgatactatttggagttattaatggacttagtttatataactaatgaattgattgaaagggttagtattgacaatattggtcatattgactagaaaatagagtctatcaaaatttaaaggctaatagaggtgatgagacaatttcggctctttgtcaactgtagtgggttgaagtcagctaagctcgagaaaggacaaattttgtcctttcttttttgatattcagagcgataaaaatccgttttttgaagttttcaaagtttcgaaaaccaaaggcattgcgcttgataagtttgatgagattattggtcgcttccagtttggcattagaatagtgtagttgaagggcattgacaatcttctctttatctttgaggaaggttttagaggatgaacttgattcagattgtcctcaatgagtccgaaaaatttgtcaggctccttattctgaaagtgaaaaagcaagagttgatagagattatagtggtgtttcaagtcttctgaatagctcaaaagtttatctatagtagattgaaactagaatagtacacctctgcttctaaaacattgttagaaatcgatttgactgtcctgaatgatttgtcctgttattatttcattttactataaatccacgtttacgaatctctttccacacttgttcaatggggttcatctctggtgtgtatggaggaataaatgcaaaaccaatattagtcggaatctttaaggtacttgatttatgccatatagcattgtccataacgagtaaaagataatcatctggataagcttgtgaaagctcctattcctaaagcccctttataacctcttgcgagagagactattgactcagcccttacttcatgcggatgaaacttcttatcgggttctagagagtcatagccatctgacctactattggacctttttgtctgggaaagttgagaatcaagcaatcacgctgtaccatcatgatcagagtcggagtggttcggtagtacaagaattcctaggagattattctggctatgttcattgtgatatgttgcggcagtaacttaggactttagtcctctagttctgcctatgcgatagcagtccaaggtttaggagcaaggcgacgctaagcttggtaaactgcgaaccgctagaagcttatcgtcaactggaagaagctgaacttgttggatgttgggcgcatgtgagaaggaaattttttgaagcgacccccaagcaagcagataaatcatccttaggagctaaaggtttagcttattgtgatcagttattttccttggaaakagactgggaggctttgccagctgatgaacgactacagaaacgtcaagaacatctccagcccctaatggaagacttctttgcttggtgccgccgtcagtcagttttagcaggttcaaaactaggaagggcaattgaatacagcctcaagtatgaagaaacctttaagactattttgaaagacggacatctggtcctttccaataatctagctgaacgcgccattaaatcattggttatgggacggagtaaaagagtccagtggactcttttagcctgagctcagtttaaaaaagcgagggtggttattttctcaaagttttgaaggagctaaagcaagagctattgttatgagcttgttggaaacagctaaacgtcatcaattatagtgcgttgaatctataacagtacgcatcgactgctaaaacatttctataaatcaattttcctttcctaatcgatttgttcatatcttatttcaatccattataaatagcgagaaatatctatcctatcttctagaatgtcttccaaacgaggaaactctcgtaaacaaagaggttttagaggtttatttaccatggactaaagttgtacaagaaaagtgcaaataagaaatctccagattaggaactatccgtgagttcactaatctggagatttttcaatagattcgttattgggcggttacgatatgatcactacttcgtcagtcttatctacaacctcaaaacagtgttttgagcaacctgcgactagcttcctagtttactctttgattttcattgaatattagaacagaaaaaatgcttggagtatttgtttgtgtgtttatttttatataacaaactataaacaaaataaaaatataaaaaaagagacaaaaaagaacagaaagtaattgaca

SEQ ID NO: 200 - DNA, 6854 bp; double-stranded, linear
gaaaataagtcttgacagaaagcgctatcaatgatagaatgaattcagataaaaagatttatttttaaaacaaaaatgaaacgtttcaaaaaaagaaataaagagacagcgccaagcgctatcttttctagaaaaaaatgaaacgtttcaaaaaaggaggttgctatgaatagcaaagcgaagcaagtttctctttgggaaagaatcaagaaacaaaaactcttgttattgatgactgtccccggtttagttttaacctttatctttaaatacatccctatgtatggggttttaatcgcatttaaagattacaatcctttaaaaggaattttagggagtgattggattggtttttctgagtttacaaaattcatatcctctcccaactttggtatcttgttagccaacacattaaaattaagtatctatggtttattgcttggctttttaccaccaatcattctcgcgattatgctcaatcaactcttgagtgaaaaagtcaaaaaacgaattcagctcattttatacgcaccaaactttatctcagtcgttgttattgtcggtatgattttcctcttcttttcagtgggaggaccaatcaacaattttctttctatgtttggaatgaaggctgacttcttgacaaatccagacttctttagacctttatacatctttagtggtatctggcaaggaatgggctgggcttcaacgctctacacggcaacattggtaaatgtagatccagccttagtagaagcagcccgactggatggagccaatatcttccaacgaatctggcacattgatattccagctcttaagcctattatggttatccaatttgttttagctgcaggtggaattatgaatgtcggatatgaaaaagcattcttgatgcagacatcgttaaatttgccaacttctgaaattatctcgacatatgtctataaagttggtcttgtatcaggagactattcttactcaacagcggttggtttgtttaatgcagtgattaacgtagtattgcttgttgcagttaaccaaatcgttaaacgcatgaataatggtgaaggaatttaaggaggaaagtatgaaaaattcgattatggatacaaaatttgatagacgtatcttactcttaaataaaatcattattgtctttatcgttttgatgactttgcttcctttactttatatcgtcgtagcatcctttatggatcctaaggttctggttagtagagggattagctttaatccagccgattggactgtagaaggttaccagcgtgtattcagtgaccaatctattctaagaggttttatcaattctctactatactcttttggatttgcagctttaacagtcttgctatctgtgtttacagcttatcctctttctaagaaagacttggttggacgtcgttggattaactacttcttgattgtaactatgttctttggtggtggtttagtcccaacttacttgctcgtaaaagaattgggaatgctcaatactccatgggctatcattgttccaggtgctgttaacgtttggaatattattcttgctagggcctatttccaaggattgcctgaagaattagttgaagctgctgtcattgatggtgcaaatgatttacagattttcttcaaaatcatgcttcctcttgcaaaaccaattatgtttgttctcttcctttatgcttttgtaggacagtggaactcatactttgatgcaatgatttatatcaaggatccaaacttggaaccattgcaacttgtacttcgtaaaattctcattcagagccaaccaggtcaagacatgattggagcacaagcggctatgaatgaaatgaaacgtttagctgaattgattaaatacgcaactattgtcatttccagcttgccattgattgttatgtatccattcttccaaaaatactttgataaaggaattatggctggttcacttaaaggataaaaaaagaaaaaataaaaggagttttctcatgaaattcaaaacattctcaaaatcagcagttttgttgacagctagtttagcagtacttgcagcctgtggctcaaaaaatacagcttcaagtccagattataagttggaaggtgtaacattcccgcttcaagaaaagaaaacattgaagtttatgacagccagttcaccgttatctcctaaagacccaaatgaaaagttaattttgcaacgtttggagaaggaaactggcgttcatattgactggaccaactaccaatccgactttgcagaaaaacgtaacttggatatttctagtggtgatttaccagatgctatccacaacgacggagcttcagatgtggacttgatgaactgggctaaaaaaggtgttattattccagttgaagatttgattgataaatacatgccaaatcttaagaaaattttggatgagaaaccagagtacaaggccttgatgacagcacctgatgggcacatttactcatttccatggattgaagagcttggagatggtaaagagtctattcacagtgtcaacgatatggcttggattaacaaagattggcttaagaaacttggtcttgaaatgccaaaaactactgatgatttgattaaagtcctagaagctttcaaaaacggggatccaaatggaaatggagaggctgatgaaattccattttcatttattagtggtaacggaaacgaagattttaaattcctatttgctgcatttggtataggggataacgatgatcatttagtagtaggaaatgatggcaaagttgacttcacagcagataacgataactataaagaaggtgtcaaatttatccgtcaattgcaagaaaaaggcctgattgataaagaagctttcgaacatgattggaatagttacattgctaaaggtcatgatcagaaatttggtgtttactttacatgggataagaataatgttactggaagtaacgaaagttatgatgttttaccagtacttgctggaccaagtggtcaaaaacacgtagctcgtacaaacggtatgggatttgcacgtgacaagatggttattaccagtgtaaacaaaaacctagaattgacagctaaatggattgatgcacaatacgctccactccaatctgtgcaaaataactggggaacttacggagatgacaaacaacaaaacatctttgaattggatcaagcgtcaaatagtctaaaacacttaccactaaacggaactgcaccagcagaacttcgtcaaaagactgaagtaggaggaccactagctatcctagattcatactatggtaaagtaacaaccatgcctgatgatgccaaatggcgtttggatcttatcaaagaatattatgttccttacatgagcaatgtcaataactatccaagagtctttatgacacaggaagatttggacaagattgcccatatcgaagcagatatgaatgactatatctaccgtaaacgtgctgaatggattgtaaatggcaatattgatactgagtgggatgattacaagaaagaacttgaaaaatacggactttctgattacctcgctattaaacaaaaatactacgaccaataccaagcaaacaaaaactagaggttgattatgggagataagaaatacacagtagaaaaagccaatcgttttatagcagaaaataaacatctcgttaatactcaatataagcctgaagaacatttttcagctgagattggttggatcaatgatccaaatggatttgtctattttcgtggagaataccatctcttttatcaattctatccatatgatagtgtttgggggcctatgcactggggacatgctaaaagtaaggacttggtgacttgggagcacttgccagtggcacttgctcctgaccaagattatgaccgaaatggttgtttctcaggctctgccattgtcaaggatgatcgcctctggctcatgtacactggacatatcgaagaagaaaccggtgtccgccaagtgcaaaatatggtattttcagatgacgggattcactttgaaaagatttcccaaaatccagttgcaactggatcagacttaccagatgagttgattgctgctgatttccgtgatccaaaactctttgaaaaagatggacgctattactccgtagtagctgccaaacacaaggataatgtgggctgtatcgttctactagggtccgataacctagtagaatggcagttcgaatccatctttttaaaagggggagaacaccaaggttttatgtgggaatgcccagattacttcgagttagatgggaaagattgccttattatgtcacccatgcgttatcagcgtgagggagactcatatcataacatcaactcatcgcttttgttcacgggtaaggtagattggagagaaaaacgttttatcccagaatcagttcaagaaattgatcatggccaagacttctatgcgcctcaaacattgttggacgatcaaaatcgtcgtatcctgattgcttggatgcagacatgggggcgtacccttccaacccatgaccaagaacacaagtgggcatgtgccatgactctacctagaattctaagattggaagatggcaaactaagacaattccctgttaaaaaaggccaatatcaaatccaaatagataaagattgtcattaccacttaggaaatgatatagattatcttgaatttggttatgacagtaatgcgcagcaagtttacattgatcgtagccatcttattcaaaaaattctaggtgaagaagaacaggacactagtcgacggtatgtagatattgaagctaaagaattggaagttgttctagataaaaattccatcgagatttttgtcaatcaaggtgaagcaagcttgactgcaacttattacttaacggtgccagctgagctatcacgaattgattaaaaattaagttatttctcctaaagaaaaagttctctttctaaaatagtggaaagaggactttttgtgttttgggtatataagcttagtttatggtatttgtaaaattggtgttggattatgatttaagctagttttctaaagaatttgaaaaaaattttatttaagcaaaaaaaccttggttccaaggcttttcctgttgtatttagatgccccctacagggattgtaggagatatgttgcttagatgttcttgattttctggtgttttgtaacgtttaaatgagttttttgagtttgttggtggggcgttgcccggcaattgcccgacttattgcttgaaaaagaatttaaaatatagtatagttaattatagattaacacttgcttggaggaactgatgaagaacaatgaaagattaggtattaaattaagtagagatagcgttttaggattgagggaagttagaaggctttatttaggcagttcagatatcccagtttctgatggctatgtgattgaagttgcttataaccagatatcacatgagattgatattattgattgggtagagttgaacaagtcaaaaattaagataagtgaaattagtgaaagcgtggatatagatgccactagcttgagaacaactttgactttagacacattagtatatgaaggtatgagagatatacagttaaagttgagagagcttacaaaggggagagtattcttttcatttgtagtgaagttagttttgtttgcttctattttaaagaaaaaagatttactagaaaaatttcaagaaaagtgttaatcaagtattgacactttatctggatttcggtataatatgcttagaaaggaatctttctaaatttttttcgtccttatgtgttaatcaaagacgaatacaaaaacatatttttttactctaaaaagtgttaatcaatgatgtatttgttagagaggtagataaatggaattgagagcaccaccagttataatagtataaaacgtataataaaaatattttaacttgaattatagaaaaggagaaacaaatcatgaaacaaaaacaaccgattgtttctagaacgaaacaacatacatttgaagagcttattcaagaccaaaagttagaaagattggctaagttgtcgcccgatttggttggaaggtatggttttactgctagctgtgcgtcttcatttgcgaacttgattaaagaagcgtatgggggtaaaaatctaaacgtagtttatgcgagtcggatgttggctctctggaatattgcttgcagttgttatcataaggctgatgggtattctttagcagatgcgctttttagtgataaaaaaatttgtctagattcttactattaccacaagaatacctctaataccataactagtgatgtgataaaagatgtttacgataattataataattatatggttttaactcgagaagcgacacctgaatacatttatgttgtacaaactgaaatgccaaaagattcagatttatatttttatattagagaagttctgggattatcgtttagtaccatgcattatgcatttttagtcaaggttcttgcaggagcgcttgctagaaaatataagccatatcgaaattgaattatttaaatttatactcttcgaaaatcaaattcaaaccaagtcagcttcgccttgctgtactcaagtgctgtctgtggctagcttcttagtttgctttttgattttcattgagtattactcttatggtagttatttatggcataataatattgatttgggagttatagcgaaaattttaggttctataatatttgtagtgggtaaaccactatagatattatggagcctatttattgtagaaaaaagtcccatatga

SEQ ID NO: 201 - DNA, 3895 bp; double-stranded, linear
tccttgctaagtttatactcaatgaaaatcaaagaacaaactaggaagctagccacaggttgctcaaagcaccgctttgaggttgcagataaaactgacacggtttgaagagattttcgaagagtattaatttacataaatagccagtgtttgatagggtttgagtagaattttctcagacacttctgcatcttcatagtttgatatcaaaatctgtccattttggtagactgctggcaagtcgatttcacttctttagcataaaagttattgagcactagtaacttttgatcctcaaactggcgttcaaaagcgtagacttgtttgctatcttcaaaggctggtttgtaacttccttctgaaatgattggcatttccttacgcatcgaatcaagtcttgatagaaggtaaaaatcggaccctggatttcattttctacattgatgtatttataggatttaccagctttcaaccaaggagtgcctgttgaaaatcctgcattttccgaagcatcccactgcatgggaatgcgtgaattatcacgcgacttagcttgaataatctggaaggcttcttgctgactctttccttcttctaagagcatctgataggcattaagcgattcgacatccacataatcagccatagaatcatagtctgggtcaatcatcccgatttcctcacccatgtagatataaggtgtcccacgtgacaggtgaatgctggctgctagcatggtggctccttccttgcggaagttttgaatatcgacaaaacggttcaaggcacgtggttgatcgtgattattccaaaagagggcactccaaccgtctttatcactcatttccttaccccaactatggtaaagactcttcaactcttcaaaatcaaagggagccaaggtccacttttgtccatccttatagtccaccttgaggtgatgaaaattaaaggtcatggataattcctgacgatcaggcgacgaatagaggacacagttttccatggtggtagaagacatttccccaactgtcataaagctatcgtcggatccaaaagtggcttggttcatcatacgcaaatagttatgaacgatgggtttgtctgtataagctggcttcccttcattttcaggacagtccactgaaacctcgtccttaccgatcaaattgatcacatcaaatcggaaacctttgacacccttgtcgcgccagaaattaacaaccttgaaaagctccttacggacattggaattgcgccagttaaggtcagcctgggtctcatcaaataggtgaagatagtatttcccagtatccccgaaaggcgtccatgcagaaccaccaaacttagactgccaatctgttggttggtcttggatgaagaaaaagtcttgataatacttatcaccagctagggctttctgaaaccattcatgctctgtcgaacaatgattaagtaccatgtccagcataaagtcaatcttgtgctctttaccgacacacaccattttctcaaaatcagccatatcaccaaaaagaggatccactgccatataatctgaaatatcgtaaccattatcccgttgagggcttggatagaatggattgagccagaccatatccacacctagtttggctaaatagggaattttttcgataatcccacggaaatccccaataccgttttcagtggtgtctttgtaagattttggatagatttgatagactacttttcctttatcaagtgtcatctgtttctccttttctgataaaagggaggaagcagtcttccgtccctatttgtgctatttcaattatactcaatgaaaatcaaagaacaaactaggaagctagccacaggttgctcaaaacactattttgaggttgcagatagagctgacgtggtttgaagagattttcgaagagtattagattcgtgtagcgaccatgagagatgctccagcttggatcgttgtcggataagttccgggaatagtcgctgtataagcatcttggttggtgatgataacaggagtttctgtcaccagacctgcagccttaatgacatccatatcaaaacgaatcagttgctgaccaactgtaacgtgatctccttggactacaagactttcaaaacctttgccatcaagacctactgtatccataccgatgtggatgagcaattcaactccctcgtcagagacaatgccgatggcatgcttggtagggaaaagaaccgtcactgtcccattaactggagaggtcaactcaccttggcttggttcaatgactagaccttgccccatgacacctgatgcaaaaataggatccgtcgcttgactcaattctttcacttggccagttagtgggctgataatttctaccgaagtaagttctactggttcatggttcacaaattctgcttcttcttgagcaacgaattctgcctgcaagttcgtatcgccctctgtttttgtaaagagaccagccttgcggaagaagaaagtcaagagcattggaacaacaatcgcaactagcatagttcctgcaaatggcagcatgtattgaggttgaatagagagaatacctggcaaaccaccgataccaatagaagccgcagttacattaaaagtaacggataacatgcctgcaagggctgaaccagtcatcccagcaacaaatggataaatatattttacgttaaccccaaaaagagctggttctgtaacaccgagataggctgaaatggttgcaggaagtgaaacctgagcctcacgctcatcatggcgatgcatgaaataataggcaaacacggctgagccttgagcaatattagaaagagcaatcattggccatagggcagtgccaccagcatccgcaatcaattgtgtatcaatggcattggtcatatggtgcagacctgtgatgacaaatggagcgtagagggcgccaaaaattgcaccgaagagccatttaactggaccagttaaacctgccaagacaactgatgaaagtccttgtccaattgtccaaccgattggtcccaaaacagtatgagccaaaatcaaggctggaatcaatgacaagaaaggtacaaaaatcatagaaatgacttctgggatatgcttgtgccagaagatttcaagataagacagactcaaacctgcaagcaaggctgggataacttgggcttggtaaccgatacgattaacagtaaaatagccaaaattccaaacccagtttgccgcgatatcagctgctggcgttgaagcaaccgcataggcattgagcaactgaggcgataccaaacagattccgagaacaattcccaaaatttggctggttcccatcttacgagaaacagaccaagtaatccctactggtaagaactggaagatagcttcaccaggcaaccagaggaagtgattgacacctgcccaaaactgagaggattctgtgatggtcttgccatccaacatcgaccaatggacaccttccaagacattacggaaaccgaggatcaatcctccgactatcaaggctggaataatcggagtaaaaatctccgccagagtggtcataacaccttggaccacgttttgattactcttagctgcagacttggctgcttctttggaaacaccctcaatacctgaaacggctgtaaaatcattataaaagatgggcacgtcatttccaatgattacctgaaattgacctgcatttgtaaaggttcctttaacagctggaattgactcgatagctttaacattagccttcttatcatctcctaaaacaaaccgcatccgtgtcgcacagtgagttacggcagtcacattttctttgcctccgattgcctgaagcagatctttggcttcttgttcaaattttcccgg

SEQ ID NO: 202 - DNA, 3936 bp; double-stranded, linear
aggatcgccgctccagctactaagtctcgtgcagtgccgatttatcaaacaacattttttgtttttgatgacacgtaggaaggtgccgatctgtttgccttgaggaaaccagggaacatttatactcgtatcaccaatcctacaacagctgcccttgaaggtggtgttgaagcgctagcaacagcatcaggtatgactgcagtgacttatacgattttggcgattgcccatgctggtgaccatgtagtggctgcttcgactatttacggtggaaccttcaatcttttgaaagaaccccttcctcgttatggtatcacaacaacctttttcgatattgataatttggaggaagtagaagcagctatcaaagacaataccaagcttgtcttgattgaaaccttgggtaaccccttgattaatattccagacctggaaaaactggcagagattgctcataaacatcaaatcccacttgtgtcagacaatacttttgcaacaccttatttgattaacgtcttctctcatggcgttgacattgccattcactctgtgactaagtttatcggtgggcatggtacaactattggaggaataattgtcgatagtggtcgttttgactggacggcttcagggaaattccctcaatttgttgacgagggtccaagctgccacaatttgagctatactcgtgatgtgggtgcagcagcctttattatagctgttcgagttcaattgcttcgtgatacaggtgcagccttgtcaccattcaatgctttcctcttgctacaaagacttgaaacctcttcacttcgtgtggaacgccatgtacaaaatgctgagacaattgttgattttcttgtcaaccatcctaaggtagaaaaggtaaattatccaaaacttgcagatagtccttatcatgccttggctgagaaatacttgccaaaaggtgtcggttcaatctttaccttccacgtcaaaggtggcgaggaagaagcacgcaaggtcattgataatttagaaatcttttctgaccttgcaaacgcggcagatgctaaatcgcttgttgtccatccagcaacaaccactcacggtcaattgtcagaaaaagacctagaagcagcaggtgtcacaccaaactaaattcgtttgtcaatcggtcttgaaaatgtagaagatttgattgaagacttgcgcttggccttggaaaaaatttaaagtaaaagaagataaacagtgggcttcgactcactgtttttgattttccctcaggcatgatataatggttacagaagtctagaaagaggaacgatatgaacgaaatcaaatgtcccaactgtggggaagtctttacagtaaatgagagtcagtatgccgaactcttgtcccaagtgagaacggcagagtttgataaggaactacacgataggatgaagcaggaactggccttggctgagcaaaaggccatgaatgagcaacagactaaactggctcagaaggatcaagaaattgcgcaattacagagtcagatccaaaactttgatacagaaaaagaattggccaagaaagaggttgaacagacaagccatgaggctctcttggctaaggacaaggaagtacagctcttagaaaatcagttggctaccttgcgtttggagcatgaaaatcaactacaaaagaccctttctgacctagaaaaagaacgggatcaggttaaaaaccaactacttttgcaggaaaaggaaaatgaattatctttggcttctgttaagcaaaactacgaagcccagctcaaggcagctagtgaacaagtcgagttttataagaattttaaggctcaacaatctacaaaagcgattggggaaagcctagaacagtatgcagagagtgagtttaacaaggttcgtagtttcgcctttccaaatgcttactttgagaaggataacaaggtctcttcgcgtgggtctaaaggggactttatcttccgtgagtgtgatgaaaatggagttgaaatcatttctatcatgtttgagatgaaaaacgaagcggacggaacagagaagaagcacaagaatgcagatttttacaaggaattggacaaggaccgtcgggagaagaactgtgagtatgccgttttggtgaccatgcttgaggctgataatgactactttaacacagggattgttgacgtcagtcacgagtatgaaaaaatgtatgttgttcgtcctcaattctttatccaattgattggtctcttacgtaatgcggcgctaaattccctaaaatacaagcaggagttggccttggttcgcgagcaaaatattgacattacgcattttgaggaagatttggatgcctttaagctagcttttgctaagaactataattcagcttcgactaactttggaaaagctattgatgaaatcgacaaggccatcaaacgcatggaagaggttaagaaattcctgaccacatctgaaaaccaactccgtttagctaacaacaaattggaagatgtctctgttaaaaaattgacccggaaaaatccaacaatgaaagcgaagttcgaagcactgaagggggagtagaaagcaaaaatgaacggtattattaacttaaaaaaggaagcaggaatgacctcgcatgatgcggtttttaaactgcgtaagattttgggaaccaagaaaattggtcatggtggaaccttggatccggatgtggtgggtgttttgccgattgcggttggcaaggcgacacgcatggtcgagtttatgcaggacgagggtaagatctatgagggggaaatcactctgggctattccacgaagactgaggatgctagtggggaagtggtcgcagaaacccctgttttgtctctcttggatgaaaagcttgttgatgaagcgattgctagcttgactgggcctattactcagattccccctatgtattcggcagttaaggttaatggtcgcaagctctatgagtatgcgcgtgctggtcaggaagtggagcgtccagaacgtcaggtgaccatttatcaatttgagcgaacaagtccgatttcttatgatggccaacttgcccgattcacttttcgtgtaaaatgcagtaaagggacgtacatccgtactttgtcagttgatttgggtgaaaagcttggttatgcggctcatatgtcccatttgactcgtactagtgctgctggcttacaattagaagacgctcttgccttggaggaaattgctgaaaaagtagaggctgggcaattagattttctccatcctttagagattgggacaggtgaccttgtcaaagttttcctaagtccagaagaggctacagaagttcgctttggtcgttttattgagctagaccaaacggacaaagaactggctgcctttgaagatgataaattgttagccattctagaaaaacggggcaatctctataagccaaggaaggtttttagctagatcgtttaggaataaaaatcgggtgatagataacaattgcttgataaaaccccatactaatagtagaatggttttgggaattataatattccaattgttgcgagttgtaggtactcaaataatctatatagaaatttagaggtgtgaaatgaagcaatttaaaattctttcagataaatatttagagtccattacaggttctgatgggaacttaggcccaggatttggtgtgataattccatgatgcgaaatgagtttcgagaaagggtggagcaacttcttcaacaaaaagaaataaatgaaaatagtgagttgagtcacctgtttcgtcttgctatacaaaatttagacagaaatgaaaaataccaatcggtcatggccaatttgagtcaagggttgtcactttacctcatgacgcatcattaccaggcacctaagtctgtcattgattttggtttatgga

SEQ ID NO: 203 - DNA, 3230 bp; double-stranded, linear
catccagcaactgctcctctgagcgtttcaaaattgatgtaatttttctagttttttctaataaatgtgccatttttcacctcgaatttaatcgctatcattataacataaaaacgtctctttttcaataattatctgaaaattccttattgacttgcattgacttacaatttaattaaaaaccagaatatttttaattaaattgttccttttctattgacaagttgcctatttttgtgtatcataatattataaaagataatataataattttatttgtcttttcacattcggtctccttatataaaaaagcgattcattttgaaccgctttttcttatttatcgcctttgttacgaataacaaagcctgtttgcttttcgcttaaagtattgcgtggttttttattatccttacggtaacgtttttccttatcaaaacgatcgttgccacgacttccttttttgaactcatcacggcgaccattgccacggcgatcacgctctcgacggtcgtccccacgacggcctccacgacctcccttagctttaccaccgaaaccattacctgatggtttaaacggtagtggtttttcacgtgcaatctccacttctggaaggctatctgggtcttggactgtcagactcaagatatacattgccaattcttctggagtaaactcagcagccaatttgcgagcatccttaccaaatttctcaaagttggcacgaatggtttcatctgcaaaatcacgttcgattttcttgagagctacctgtttttttgattggaaggattcttctacacttgcaggtttgagacctttcatgcgtttcttagtcaagttttcaatgatttgaaggtaacccatttcgtttggagcaacaaaagtaatagattgacctgacttaccagcacgacctgtacgaccgatacggtgaacataactctcaggatcttgtggaatatcgtagttgtagacatgggtcacacctgaaatatccaaaccacgcgctgcaacgtctgtcgcaaccaaaacatcaagattgccatttttaaagtcacgaaggacacgaagacgtttgttttggtctaggtcgccatgaattccttctgcacggaagccacgaattttcaaaccacgagtcaattcatccacacggcgtttggtacgaccaaatacaatagcgagttctggttgtgccacatccatgagacgagtcatggtgtcaaatttttcttgttccttaacacggatatagtactggtcaaccaattctgttgtcaattccttagccgcaatcttgacatgttcaggggctttcataaactgaacaccgatacgtttgatggcatctggcatagttgctgagaaaagcaaagtttgacggttctcaggtacacgggaaataatggcttcgatgtcttcaaggaagcccatgttaagcatttcatccgcttcgtcaaggataagggtttcaatgtcttgtaatttcaaggccttgcgtttaatcaagtccaagaggcgacctggagttcccaccacaatatgggcaccagatttaagagccttaatttgtttttcaatgcttgatccgccatatactgaacggactttgactcccttactacgaccaaagcggaagagttcttcttgactttggacagctagttcacgagttggagcgatgaccaaggcttggatagtcgcttcttctgtacggattttttcaagggtaggcaagccaaaggctgcagtttttcctgtaccagtctgagcttgaccgataacatccttgccttcaagggccaaaggaatagtttgttcttggataggactagcttctacaaaaccagctttttcaatttctgctagcaaatcagcagacaagtttaattcattaaatttcacgttattcttctttctaaaggtggtgcgaagccaccctatagggcttagtttatacttttctttttatgacgtattttcatataactagatataaaatcgtgttgcttcttttccacaaaagaaaagtactgttttctttgcaacctatctagtataacacaagaccagagcaaaagatagccccatttctacagaaaatcatgtaagcgctttttgactttcttttttgattgaacgacctagataataagacaaagccaaggcgatactgtataaaatgagaaaaacgaacaaggtttgtgtgtacgaatgagccattttataagtctctgctaataaaataggtcccgctaaaccagccattgcccaagctgttaaaatataaccatgcagagcggccaattccttggttccaaaaatatcactgagataagctggaatcaaagaaaaaccagctccatagcaagtcatcaaaatagacatagcaactacaaataaaacggaatctgtaaagagccaaagtgagagagaaaagaaaagattgacaagcagtaatatactaaaggttagagggcgaccgatatagtcagacaaactcgcccagagcaagcgaccaaatccattgaaaatccccaaaacacccaccattactgctgcatgacttgtagacaagccagccatctcctgtgccattggcgatgccgctgaaattaagcctaaaccacaagctatgttgataaagaaaataatccaaagcatataaaaccgattgctttttagagcctgatttgcagccattccttgcgtcaaagaggctgttttttctttccctgaagaagataaaattgcaagctcttgctcatttggacgcttaatgaattgtgaagctaggagcatgataataaagtaacttgctcctaaaatataaaaagtttctacaagccctacccctgcgatgaggtgttgcgctatgggactagtcaataaagaagcaaaaccaaaccccataatcgctaaacctgttgcgagaccacgtttatcaggaaaccattttataatcgtcgacacaggggtaatatagcctgctcccaaaccaagcccacctaaaatgccataagcgagatacaacaaccacagctctgacggtctattgcaaatcctgttaagatatttccacctgcgtatagaaaagcagatagacttcccatgactttcggaccaaatttttctaccaaacgccccataaatgcagccgataagcccaaacaaaagattgctagactaaaggcgaaggcaacagaagcctgatcccatcccgt

SEQ ID NO: 204 - DNA, 5096 bp; double-stranded, linear
cctatgaagactgtcccaactgggtgtccttctaggctatctggtcctgccactccagtcaaactaattccaaaatcagactgggtcttgcttcgtgcctgctcagccatcttctgagctgtaaattcagacaccacaccatgttcttccaaattcttggcaggaatatccaacatccttgatttttcctccaagctataggtcacaaaaccacccttaaatatacttgaaactccagaaaaattcgccacggtagcttggaaaagacctgccgtcaaactctctgcagccgcgatggttttcccttgccttttcagttcttctaccacaatgctggctaaactagtttcttccccataaccatagcaaaagtctcgtaaagaaattccttcgaaagtctggcagtccaagatttgattttccaagatatccagcgcttgattcgcctcttcttgactgctagcctttgttgacagacgtagagtgacttctcctgtcttggcataaggggccaaggtaggatcgatctgattatcaattaaatcagccaaaatcgtaaccaactggctctcgccaatcccaaagaaacgaagaactcgggaatacagcttgctccctgtcatcaacttgggtagaagttggtttaagaccatgggtttcaattcacttggcggacctggaaggacgacataggtcactccgtctacttctaattttcctccaacagccagtcctgtttcgtttggcagtggaatcgctccttctacaatttgagcttgtctttcgttattcggtgttcgggcatagtctggtcgcagggtaaaaaagatatccaacttctcctgagcctgaggatcaaagactaatgctttccctaaaaatttagctagggtttgtttggttaggtcgtcctcagttggccccaaaccgcctgtcaaaatcaccagactgctacgttgactggcaatctcaagcaaagacaagagacgaacttcattgtctcctacagccgtctgaaaatatacatctaccccaatctcagctagtttttccgacaaaaactgggcattggtgttgacaatctgccctgtcaaaatctctgttccaacagcaatgatttctgctttcatgtttcctcctacctatctattcgtatttttttgaaaaaatcgcaggaattttcctacgattgatttttttatttgtatcaaaagttaattatcttcatcaccaacaggtgctctgccaaataaatcttcaaataaaaccgcattggtttcaagctgagtaacttcttcttgtcccaaagaacgtcggagtagattttgcatttccaacatatgtgctctcgaaacaatctggtaagaaacaccttgaagtatctctccttcaccctgcaactgctgagtttcaatggttttaaatgaatctttatagcctagcaagttagggatactttttgcagacaaatcaatattggtctgcatattgtcactcaaagcttttagaatctcttgataatgaccaatgctatttaaactgagagctttttccatgactttttgaataacttcacgttgacgtttttgacgaccataatccccctcaggatcttggtaacgcattcgtgcatagactagggcttcttctcccccaatatgttgctccccaacaccgatagaaatagtattaaattcttcttggtcactgatagaaattgggaaacctaggatattattgactgtaatacctcctactgcatccactagtttttgcaatcctctcatattgaccatcacatagcgatcaatatggatattcatcattttttgaatggtttctatagcaagctctgctccaccatctgcatatgctgagttcagtttcgcttcatgagcctgaccattccctgattcaatgcgcgtcagaatatcccgctctaaactcatcattgttgtttttttcgttttaggattcactgtcatcaagatcatgctatcacttctaccgacccaagtttcagttcgttcaacatttccggtgtccactcccattaacagaatggttagaggttcagtcgcttcaataaccttggtttcttcaccgatttttttataggttttagctaaggtttctgtcccttgttgataaatagtataagcaaaaacacctactcctactacagttacagaaagtaaagctagcaccattccaataatttttttaaccatatttctactaacctatcagtttacccatcaagtaaacatcgataaatttcccttcttctatatatgccccacgctcttggctaccttcaatgacaaagccatgcttttgataaagatggactgctgcttgattacgagtttggacagtcagttggagacgacgcagaatgccacttgcttgtgcccactctatcgcttcttctagcaacaaacttcccaagccattattccaatatctttttccaatcacaatgaagagatctccaatatgacggactctcttacgctgatcagctgtaatatttacaataccagcaattttgccatttaagaatgcaagtaaggttatctgattgtccgaactagcttgcttgttgaggaatatttccatctcctcactagtcaagagaataccatctccgtctaggctggtaaagtctgtctccaaactcacacgatttaaaaaggccactaattcagctgcatctttgggctctgcttccctaatgagcaattcatactccatattgaagctcctctaacaatttctcagcacgcaaaccctttgcctgaaaatttaaacggcgtccatctgcttcttttagaatttccaattctaaataagcatctggcaaggcatctcctaagagatttccccactcaataacagtcacgccgccaccaaagataaactcatccaagtcgatagaatcagcatctccttcaatacgataaacatctaggtgataaagtggaagtcgaccttcatactctctcacgatagtataggtgggacttttaatcatttgagaaatctgtaatccttttgcaagtcctttagtaaaggtcgttttacctgcacccagttctccagttaagattaaaacatcattctttgctaatagatggcccaaacgctcccctaaggcttgcaactcttcttcattttttgtgtacatactcttattataccaaaaacttttcttttgtgtctattttcctactaaacttatcatcataacatccataaaaaacaggctttctctaaaagaaaatgagcgtaacaatgaccaatacaagatctcggaaaatatgaccataaaaggaaacttccttcttaaccgaatttgggacaagataggctgcaaaaaacaagcccagtccaatataaatcagaagtgagacaatggtcattggatttcttaagaaaagaagtgttgctaaaatagtcaccaacactgtcttttttctgtccagcatagcaagaaaatcgcgcacgtattttttcaagggtaaaaaaatcagcaaatctagcccaaataggaaaaagaaggatggcaataaaaagtcaactaattcttgctgcagcgtatttttgatgaacaagttatctgacaaaacaagaacagctcctaacaaattaattaagagtaacatactgtaaaaaagcttcaccgacttcttactggctaggacactatggacttcttgcttacgggtataaagataatttactccagcacagattcctgaaacgaaaaccatgcttccgatgaaaaaagctgtactttgtttaaaggacaagatgcattccttccataggaaacagctactcaaactgatttgaattaaagctaacaaaaataagattctcattgatttcatcttctctctcccttcctaccaatcattatactaggagaaaagagagaactgtttctaatcttctcaaatgtctctttaagacgctaaacaaacactagagactaatactcaatgaaaatcaaagatcaaactaggtagctagccacaggttgctcaaaacagtgttttgagattgcagatagagctgacgtgatttgaagagattttcgaagaatataaatttgaaatcatgaaaatccgtcaaacgggtggttgttttgtctcgcacctcacggagcgagacggactcagagtcacataattataaggctgatagtattaatctaactatcagcttmcaggttatttaacgtttcagaaaaactataatgtcaagattaactaaacagtatctagttccttcaaataattttctatcttcatcaacattaaaggattgttataaatcttacataactctcttgcttctatataataatttttgacttgttctctgtctagaaatttggctccagcatttcctacaagaataagtagaggagccaattggtagcttgtctgtctttgtttacagagttcaatcgtttcaagagcttcttggatggcttcattatatttttcctttgatactaggtagtgagcgtagttgtaacgaactctgatgtagccaaataaaaactcttgatggtccaaattttttgtctgatacaactctattaaatgagagtagtttgcctcatattcttgttcacgacccactaaggaatagaaattagatagagtattcaacgcctttaaataaatcagagtatttgaagagacttttaataatatattttccaatgacgaaattgcctcacacttactgtcatattgatagaagtcaattatagatttaatccattcaaggtaagttcggtcttctaatgttagaaaagtgcttcgttctacttctattttataaagatattctaaatcgtcataatttctgtcatctaataggcgagcagatagatgtttgaaattagagaggttagacttaacttcgatttgttcattgaaaaagtaatccaaagggacttcaagtcgttgagagagtttgaataacaagtctgcggagggaataaaatgacctctttcaattttactaatctggctttgttcacaaattccttctgcaagagtttgttgggagagtct

SEQ ID NO: 205 - DNA, 2395 bp; double-stranded, linear
acaagataaaaataaaggattacaatggggaatataaagtaaaccggtaaacctaaaaagaaaggagaaaagatgaaaattgtacttgtagggcatggacattttgctacagggatttatagttctttacaattgattgcaggtaatcaagaaaatgtggaggcgattgactttgtggaaggaatgtcagcagatgaactcaagcaaaaaatcttacttgcaatttcaaatgaagaagaagttttaatcctaagtgatctcttgggaggatcgccattcaaggtttcttctaccataatgggagaaaatccagccaagacaatgaatgttctctcgggtttgaacttagccatgttaatggaagcagtctttgctagaatggctcatagctttgatgaggttgttaataaatcagtagtggcggcccagggcggagtcgtaaatggtaaagaattgttttcaacggatgcagaggaagaggaagaagatttcgaatcgggtatttaaagggtaaaagaatgataaaaaaggttacgattgaaaaaataaaatcgcctgagcgcttcttagaagtaccacttctgacgaaagaagaagtcggccaggcaatcgataaggttattcggcagttagaactcaaccttgactatttcaaggaagatttcccgacgccagctacctttgataatgtctatccaatcatggataacacggaatggaccaatggtttctggacaggagaactgtggttggcttatgaatacagtcaacaggatgcatttaaaaacatcgctcataaaaatgttctttctttcctggatcgtgtcaataagagagtagaattggatcaccatgatctcggcttcttgtacacaccgtcttgtatggctgaatataagataaatggagatggagaggctagagaagcaaccttgaaagctgcagataagttgattgaacgctatcaagaaaaaggtggttttattcaagcttggggagacttgggcaagaaagagcattaccgtttgattatcgactgcttgctcaatatccaactcttattctttgcttatcaagaaacaggcgatcaaaaatactacgatattgcagaaagccatttctatgcttcagctaataatgtaatccgtgatgacgcttcgtccttccacaccttctattttgatcctgagacaggtcaaccctttaaaggtgtaacgagacaagggtatagtgatgattcatgctgggcacgtggtcaatcatggggagtctatggtattcctttgacttatcgtcacttaaaagacgagtcctgctttgacttgtttaagggtgtgaccaattatttcttgaatcgtctgccaaaagatcatgtgtcctattgggatttgatttttaatgatggtagtgatcaatcacgagattcttcagcaacagctatcgccgtctgtgggattcatgaaatgctaaaacatctcccagaggtggatgctgacaaagatatttataaacatgctatgcatgccatgcttcgttccttgatcgaacattatgcaaatgatcaatttacccctggtgggacaagtctcctccacggtgtgtactcatggcattcaggtaaaggagtggatgaaggcaatatctggggtgactactattacctagaagcccttatccgtttctacaaagactggaacctatattggtaggaggagaaatatgacaatgccaaatattattatgacccgtatcgatgaacggttgattcatggacaaggacaactttgggtaaaatacctaggttgtaatacggtcattgttgccaatgacgaagtaagcacggacaagatgcaacaaactctgatgaaaacagttgtgccagactcagttgccatgcgtttcttccctttgcaaaaggtgattgatatcattcacaaggctaatcctgctcaaacgatctttatcgttgtaaaggatgtgaaggacgctttaaccttggtagaaggtggtgtcactatcaaagaaatcaatattgggaacattcacaatgcccctggtaaagagcaagtgacacgctccatcttcctgggtgaagaggacaaggcggccctcaaggaattgagccaaactcatcaagtaacatttaatacgaaaacaactccaacaggaaatgatggagctgttcaagtcaacattatggactatatttaacagaggagatcgttatgtcgattaatgtatttcaagcgattttaattggattatggacagctttctgttttagtggaatgctgttaggaatttacaccaatagatgtattgttctgtcatttggtgtcggaattattctaggtgatctgtcatgctcttgcaatgggagccaatggtgaattgg

SEQ ID NO: 206 - DNA, 3342 bp; double-stranded, linear
ccttctttagaggttaattttgcaaaatcgtcgattgttatataaggattattatagagactgttcgcaaagaatctctgatatgtttttgaatcttttgaatacaaaactatctctctaatagcattgccatctgttccatcaattggtaaacataccgtaactagaaaaagaattatattcaaaataaaaaattctgatgcgtacggcacaaatcccaaaagtgctaatattgcgacaattaggttagctccacctcccccaaagaagtagaacaccaaattcctatcactatttttttcattagtaatgtttctattactcatttgacaataaccgaatgctaataacactggaaatttgaaatatattttttttctgaaatagaagaaaaagggagtagcaagcatctctagtttataagataaacatcttcccactaaaaaatgacctagttcatgtaatgtaattgatattaacgaaattaaaatcaatcgaaaataatagattaatgaatcatttggaaaaattatcaataataggaacaataacggaatcaaacataaatatatgacagagttatttaatattttcaacataataccattcctctaaactattagcttcaaaaaggcgttttttctcccaatacatcttctcaaaatgttcggaatcataattttctaaaattaattttatgtctggtaagctctttcttgataatccgttgttttgtacttaattttcccttcaagtacatcttcaattttataagttgcctccatcaactgagcctctgcaatatctttgagtgaattggtaattgaaacttggtgtaatatctgtcctsccatatatgaaaatatatctctaagatattctgacacattatcagagccgttactctcagcaacatctaatgttacaacaaactttccagctaatcgaaaaagatggctccaccccccaatcctttcaataaagttttttgtgtccacagatacgttttgtaaatatacaggagaagagataattataatatcagactctaataactctttttttataacacctccatcatcagcattactttgcctatcaattcctttcttaaacaactcttctgaatcagaattagatatttctagctctgaattgaaaggtgtcctgaaagatatatcaacattatttctactagaaatgatacttgaaagtctcttagtatactctaaagtcttagagttatgatttcgcactcctgcatatataaatattttattcattttaattcatcctctcaatttgaatttagtagatttttcaagatagtatggtacaaaaacagacttttgttgactcacattattacatatgttttgtattaaaccaaaatcaatactatttttggagtaattttgattttagtttaaaatcatttctataacagtagcatatacctcaagccgtttagcaattagaatagaacttttctttattatattattatctcaacgaaaagctacactattaaaaatattttatagaattacatattaaactagtcaatcttggtatttttatattgcttaatgagtggacacctctattttagaaacaaaactataaattaagctagatttcaagtaatgaggggataactatctttttgtcattctgattcagtgcgatataccttaaaaaagtataagcaataccagtcacacctgtatacaaagaaaaatctgggaaattgcttgtttggacgatacgatactctccttcttttgatttattcattacaacactacacaataaagactccaattccatactagtatccatttctttcatgtagtcgatgtaaaaatttattatggccatacttccatggcaaaatgtatcattatctaaactagctacaattccctctggaacactttggggatgattaactaatgtcccaaattctccactacaccacttcaaagaatgaattttgattttctccctaggaactagttgtaaaattaattctttatattttttaagtcttgtcactttataaatattttttaatgtaaaaattacacctgatagtccatggccaaaactatatccaaaattactattatctctctcgcttacatcattatatagcgtatcacctaaacttaatactagccttagaacacgttccttctctattcctctcctataatatcttaccagtgtattaattaaaggtagaagaccattaatatagtcagacttgtttgaaacacttgcaaaatcagtcttttcaagctcagttaaaacactctttatataatttaagcatgcgagagtatttgtatcgtaatcctctataatggatagaacaatgaaatatcctatatccccagttaaaccaaatgtggtcttagataaagaaacagatggcggaattgcagataacattttattgtacagttgagtatatgatgatttatctttcaataattttacatagtacataaacagtaatattccagctctacccctatacatatcattmcccgtttgttcaagacaccatttagaacctttaaaattaacaggtatactccaaattggatattcgtcataaatattattaataaccaaagagtctgcaatattttctacttcattatgcagaatagtaactaaactttcatttgggagtttttttctattagataagtttaatttatatcctttttttcgctgatcaaagcttggaaaataaatttcaatgatatcaagttgcttttctaaattttccaaattattattaggtaaatatttcataaaatagtcatatccagaaaattgatgtagggaaataaaatgatttccaaaatcatcgtagatttcattgatatttgtatctgtataaaaaatcggaatatctaataacctcatttgttcacattcgcttgctacaataccttgattagaaaacttattgctccagagattttccaatgctttttctctatctaacatttcttcataaaaatcaggatgatataaaaaagatagtactgaagcatagctatttgtgtctctaaaaagtacccttgtctttaaaccatacaagtttgcttttaatagcattttaaattcttctgttttatttaactcttcaaatatcagataaaaatccctaaaaccttttttgaaatcttttatatacttatcaaattctatatcaccatcccgaacaggcaggtttttcccaccttcaaaatcaattttcccaatatcaaactttaccttatcagtatttaaattaattaaaacttgaccagggatcctcta

SEQ ID NO: 207 - DNA, 3454 bp; double-stranded, linear
gagaaaagaatgttaaagaaaaatgatattgtagaagttgaaattgttgatttgacccatgaaggggcaggagttgccaaggtagatggtttggtcttttttgtagagaatgctttaccgagtgaaaaaattctcatgcgtgtcctcaaggtcaataaaaagattggctttggaaaagttgaaaaataccttgtccagtcaccacaccgtaatcaagatctagatttggcttacctgcgttcaggaatcgcggatttaggacacctttcttatccagaacagctcaagtttaaaaccaagcaagtcaaggacagtctctacaagattgctggaattgcagatgtagaagttgctgaaacgcttggtatggaacatccagtcaagtatcgcaataaggcgcaggtgcccgttcgtcgagtgaatggtgtcttggaaacaggatttttccgtaagaattcgcataacctcatgccccttgaagatttctttatccaggatcctgtcattgaccaagtcgtagtagctcttcgagacctgctccgtcgttttgatttaaaaccttatgacgaaaaggaacagtctggattgattcggaatcttgtggtgcgtcgtggtcactattcaggacaaatcatggtcgttttggtgacaactcgtccaaaagtttttcgtgttgaccaattgattgaacaagttatcaagcagttcccagagattgtgtctgtcatgcaaaatatcaacgaccagaataccaatgcgatttttggtaaggagtggcgcactctttatggtcaagactatattacggaccagatgttgggaaatgacttccaaatcgctggcccagccttttaccaagtcaatactgaaatggcggagaaactctatcaaacagccattgactttgcagagttaaaaaaagatgatgtgattattgatgcctattctggtattggaaccattggtttatcagtcgccaagcatgtcaaagaagtctacggtgttgaactgattccagaagcagtagagaatagccagaagaatgcttctttgaacaagattactaatgcccactatgtctgtgacacggctgaaaatgccatgaagaaatggctcaaggaaggtattcaaccaaccgttatcttggttgatcctccacgcaagggcttgacagaaagctttatcaaagcaagcgcccaaacaggagccgatcgcatcgcctatatctcctgcaatgtcgcaaccatggcgcgtgatattaaactataccaagagttgggatatgaattgaagaaagtccagccggtggatctatttcctcaaacgcatcacgtcgagacggtagcacttttgtccaaactcgatgtcgataagcacataagtgttgaaattgagctggatgagatggatttgacaagtgcggagagcaaagcaacatatgctcaaatcaaagaatatgtttggaataaatttgaattaaaagtttcgacattatatattgcacagataaaaaagaaatgtggaatagaattacgagaacattacaacaagtctaaaaaggataaacaaattattccacagtgtacacctgaaaaagaagaagccatcatggatgctttgagacacttcaaaatgatttaatagaaaagaatgacagtatatgactttctgcatttattacattcctacttggtataggaacagctattattcctttcttgcaaggtatcaattagaaaataggctcaatataaagattgataggatcatttttatatttaaaggagcgttgaaatgattgataaaggcaacaaaaaattttaggataaatttgctaagttgtatgcctcttttatgaaaaaagataaagaggtttatgataaagtttgtgaatatcttagtcctcatttgaataaagatatggaggtgcttgaacttgcttgttggtttcgtgtcataacagttatagaggcaaatagttatgtaaatataaggagttcaagacttctaccaaagtttaaaactcaaaaaataaatagttggtgtgctgcttacaatatccattttaataatggatattgtaagcagcacccccatgaatttaaagattctttaaagagtcttattttgtgatgaaaatttaatatgtaaatctcagacgatagaaattaaaaactctatcgtcttttttatactcaaaattaggaggtaaaaatggtaaggataagaggtcccacttaaaacaatttatggcaaaataaggacggaataacacaacaaattctctaaaacaaatcactaaatcaatgtaagattgaatgaaatcaatatttatgctataattaaataaatttaatgaagaaaaaaagagggatattatggcacttaactataaaccattatggatacagttagcaaaaaaaggactaaagaaaacagatgtaatagctatggcaggacttacaacaaatgttatggcacaaatgggaaaggataaaccaattacatttaagaatttagaaagaatatgtaaggctttatcttgcactcctaatgatattattagttttgaagataattttagtgacgaggaatagaaaatgactttaaggacagaagatcaagttagggattatgcaagagaagtataggctttaatgaagttgaagaaaacatcaatcaaggtactggtcaaataactacttttaatcaattaggcttcaagggatattcaaataagccagatggttggtatttacctaaaaatatgaatgatgtagcaataatccttgaaacaaaatcagaagaaagagatattagcaaacaaatttttattgatgagttaatgaaaaatatagacataatttaactaaaaataaaaactagatccttttttgaaaaaattatattattaaatttgtaactgtatctattgacaatgataattattatcgatacaatagacttgaaatatgtttaaggagtttttatgaaaacaaattttttctaatmgctattttagctatgtgtatagtttttagcgcttgttcttctaattctgttaaaaatgaagaaaatacttctaaagagcatgcgcctgataaaatagttttagatcatgctttcggtcaaactatattagataaaaaacctgaaagagttgcaactattgcttggggaaatcatgatgtagcattagctttaggaatagttcctgttggattttcaaaagcaaattacggtgtaagtgctgataaaggagttttaccatggacagaagaaaaaatcaaagaactaaatggtaaagctaacctatttgacgatttggatggacttaactttgaagcaatatcaaattctaaaccagatgttatcttagcaggttattctggtataactaaagaagattatgacactctatcaaaaattgctcctgtagcagcatacaaatctg

SEQ ID NO: 208 - DNA, 3752 bp; double-stranded, linear
cgggagtatacttaatataattatagtctaaaaatgactatcagaaaagaggtaaatttagatgaataagaaaaaaatgattttaacaagtctagccagcgtcgctatcttaggggctggttttgttacgtctcagcctacttttgtaagagcagaagaatctccacaagttgtcgaaaaatcttcattagagaagaaatatgaggaagcaaaagcaaaagctgatactgccaagaaagattacgaaacggctaaaaagaaagcagaagacgctcagaaaaagtatgaagatgatcagaagagaactgaggagaaagctcgaaaagaagcagaagcatctcaaaaattgaatgatgtggcgcttgttgttcaaaatgcatataaagagtaccgagaagttcaaaatcaacgtagtaaatataaatctgacgctgaatatcagaaaaaattaacagaggtcgactctaaaatagagaaggctaggaaagagcaacaggacttgcaaaataaatttaatgaagtaagagcagttgtagttcctgaaccaaatgcgttggctgagactaagaaaaaagcagaagaagctaaagcagaagaaaaagtagctaagagaaaatatgattatgcaactctaaaggtagcactagcgaagaaagaagtagaggctaaggaacttgaaattgaaaaacttcaatatgaaatttctactttggaacaagaagttgctactgctcaacatcaagtagataatttgaaaaaacttcttgctggtgcggatcctgatgatggcacagaagttatagaagctaaattaaaaaaaggagaagctgagctaaacgctaaacaagctgagttagcaaaaaaacaaacagaacttgaaaaacttcttgacagccttgatcctgaaggtaagactcaggatgaattagataaagaagcagaagaagctgagttggataaaaaagctgatgaacttcaaaataaagttgctgatttagaaaaagaaattagtaaccttgaaatattacttggaggggctgatcctgaagatgatactgctgctcttcaaaataaattagctgctaaaaaagctgagttagcaaaaaaacaaacagaacttgaaaaacttcttgacagccttgatcctgaaggtaagactcaggatgaattagataaagaagcagaagaagctgagttggataaaaaagctgatgaacttcaaaataaagttgctgatttagaaaaagaaattagtaaccttgaaatattacttggaggggctgattctgaagatgatactgctgctcttcaaaataaattagctactaaaaaagctgaattggaaaaaactcaaaaagaattagatgcagctcttaatgagttaggccctgatggagatgaagaagaaactccagcgccggctcctcaaccagagcaaccagctcctgcaccaaaaccagagcaaccagctccagctccaaaaccagagcaaccagctcctgcaccaaaaccagagcaaccagctccagctccaaaaccagagcaaccagctccagctccaaaaccagagcaaccagctaagccggagaaaccagctgaagagcctactcaaccagaaaaaccagccactccaaaaacaggctggaaacaagaaaacggtatgtggtatttctacaatactgatggttcaatggcaataggttggctccaaaacaacggttcatggtactacctaaacgctaacggcgctatggcaacaggttgggtgaaagatggagatacctggtactatcttgaagcatcaggtgctatgaaagcaagccaatggttcaaagtatcagataaatggtactatgtcaacagcaatggcgctatggcgacaggctggctccaatacaatggctcatggtactacctcaacgctaatggtgatatggcgacaggatggctccaatacaacggttcatggtattacctcaacgctaatggtgatatggcgacaggatgggctaaagtcaacggttcatggtactacctaaacgctaacggtgctatggctacaggttgggctaaagtcaacggttcatggtactacctaaacgctaacggttcaatggcaacaggttgggtgaaagatggagatacctggtactatcttgaagcatcaggtgctatgaaagcaagccaatggttcaaagtatcagataaatggtactatgtcaatggcttaggtgcccttgcagtcaacacaactgtagatggctataaagtcaatgccaatggtgaatgggtttaagccgattaaattaaatcatgttaagaacatttgacattttaattttgaaacaaagataaggttcgattgaatagatttatgttcgtattctttaggtacctatcttatgatttcaggaaatgtcattaaaaaaacgactcattttctctaacctgaaaaatagattagagaaaatgggttgttttatctattatagttatttgaatgaagmtaagaagaaggtatactcacatcattcacataatctgtatattgactataagttttaaaaaacaatttttaagctcttccttgtcttctctaaccaagcgtgttataatgaatactgctcaagcgaccttcaatcgtgaagcacacacgaccttcaatcgtgaataaacgaatagatgggagacttaccatgagtgataactctaaaacacgtgttgtcgtggggatgagtggtggtgttgattcgtcggtgacggctcttttgctcaaggagcagggctacgatgtgatcggtatcttcatgaagaactgggatgacacagatgaaaacggcgtctgtacggcgaccgaagattacaaggatgtggttgcggtggcagaccagattggcattccctactactctgtcaattttgaaaaagagtactgggaccgcgtttttgagtatttcctagcggaataccgtgcagggcgcacgccaaatccggacgttatgtgcaacaaggaaatcaagttcaaggcctttttggactatgccataaccttgggggcagactatgtagcgactgggcattatgctcgagtggcgcgtgatgaggatggtaccgttcacatgcttcgtggcgtggacaatggcaaggatcagacctatttcctcagccaactttcgcaagaacaacttcaaaaaaccatgttcccactaggacatttggaaaagcctgaagtacgcagactagcagaagaagcaggcctttcgactgctaagaagaaagactcgacagggatttgctttatcggagaaaagaactttaaaaactttctcagcaactacctgccagctcagcctggtcgcatgatgactgtggatggtcgcgatatgggcgagcatgcaggtcttatgtactatacaatcggtcagcgtggcggactcggtatcggtgggcaacacggcggtgacaatgccccttggttcgttgtcggaaaagatctaagcaagaatattctctatgtaggacaaggattctaccatgattcgctcatgtcaactagcctagaagccagtcaagtccactttactcgtgaaatgccagaagagtttacgctagaatgtacggctaaattccgttaccgtcagcctgactctaaggtgaccgttcatgtcaaaggagaaaagacagaggtcatctttgcggaaccacaacgcgcgattacaccaggacaggcagttgtcttttacgatggcggg

SEQ ID NO: 209 - DNA, 3580 bp; double-stranded, linear
tatttatatttttttatctctggcatactttgatacctttttagacttaaagtctttaatagtgcctttccacctctttttatctataaagattctcctacatcataattcatttttttatttaaacctttctgtcttagtttgtctttatcttcttcataccattttaagattgtcacatagtggttttgataggtcttaccactgctttccatgtatctggatagtttatttatcattatatctgtgtgtgagtttaatttttcttttagatttttatattcttctttgcttaaccttacatttttgaattctccataaaaaatgggggtggactttttatctatctctccctctctctctttatctatctctatatctttccatgtaattccaatctggagtacctctactgtctatcggtaatttaattttgatatctggcaatactgtgctagatatttgatctttatattcagtattttttaaagcttgcctaataattgaagttaaatagaatgctacttctttattcaattctttattttttaattttaaacaatgaattttcatatctaggcttgctttatatttatgataaaagactgctcctaaaaatgaaacagatataaaattttcaaaaactctataatttttatcatctatatcttcgtagtaacctaagataccattgtcaatatttgtagcactaattctaggagtttttccatcgagtaaatatctttttggaatagatgagcctgttggtacttaactcgatttcccctttttttcggtaataaatatttctttttattttgttgtctgatatttttcctacctgtcctttgtaggatgagtattttctagattttcytgaataactttttacttgaagttttagcttttgaactagtcgttgtactttctttttgtttattatcagtcctgatctttttaatattgctgttattctctatatcctatttttcattcatgatattcttttactaattttatcttaaattctgtgctgtatttgccattaaaaaactgacctcctttagttagttttttggcctaacttttgagggtcagttcaaaatttgcgacttttaaatgaattccaatattcaattattaagagttaacatggtgcttgccaataggaatcattagaggcgaattggaaatagggtcacgtataatttttgcttcaagattaaagatatctttaactagtttatcatttagtatatcttcaggctttccctctgcaacaagtttaccttctttaattgcaaataggtaatcagcgtatcttgctgttagatttatatcgtgcaaaatcatgcaaatggttgtcttatatttttggtttagatcagtcaagaggtctaatagttctatttgatatgagatatccaagtaagtagttggctcatctaaaagtaggatacttgtatcttgggctagggctagagctatccatactctttgcctttgacccccagaaagttcttcaactaggttatttgctagatcttcaacattggccttaaccattgatctgtttattatttcaaggtcatcttttccaagactcttaaaaggctttctgtaggggaaacgaccacggcttacaagatcagctactgttattgattcagggattattggagattgaggtaatatagctatgtgttttgctaaatctttttctttataagaattaattgatttattatcaagcaatacttctccctctaatggctttataagtcgagacaaggttttaatgagtgttgatttcccacaaccatttgacccaataataactgatattttttcttcaggtatttttatatttatattttccaagattattttttcatcataaccgcaggtaagattatttgaccacagacctttcattatatattcctcctgttcatttttattagtaagtatattaagtatggtgaacctaacaagccagttacaacacctactggatatctagctggtaaaatattttgagagaatatgtctgataacaaaactagtaaaattccaaccaatccagctaatattgggcttcttttcttgccaatatttaaggctatgggaccagctaaaaaagatatacaagctattggtcctgtaattgaagtagaaaaagcagttaaagatacagcgcaaaaaattaaaacaagccttgaaagctcgggatttgctccaagtccgattgctatttcttcaccaagttcaataatttctagtcttttattaaaaaataaaactaatatagtagcaataatacttactattagaacaagaggtatgtcatctaactttgtaaaagataaagagccactgagccatctcataacttcttgtaattcatatcttgctactttcaacaataaaaatgaggtgcctgctcttgtgacagcttgaaaaccaatacctaatattatcagtcttgctgctgaaaaaccatcttttttagctagtaaaaataatattaaagatgatgttagtccacaagttattgaaataattccagtagttaaactatttgtttttaataccaatatgcaaaagaccgctgcaatagatgaagaacttgtgacaccgattatatcaggacttgcaagaggatttcttaacatagtttgaaagataaatcctgccaatccaaaagaccagccagctataattcctgctaataattttggtaatctaatttccataatcgaaaaactagctccaggaacagtttcactatttaagactttaatcaaagttgaaaaagaataactttcatctccgataagtaaaatgaaaaatgatagactgattattattaataaaaatagtgaggaaaatagtgttattctattttttcttttttgaatacctataattaaattttgcattagttattaacccctctatttttcatagttacataaataagtactggacccccgattattgcagtaattatccctacttcaatttcacctggtttacctaacatacggccgattatatcacatataagcaagagctctgcacctataaaagatgaagaaatggtcattgtgcgtatatctttgcttataaataagccacaaaagtgaggaactataagacctacgaagccaataggtccaccaattgcagtaatacttgaacataaaagcacacttgcaattattgcaagtgatcttatcctattaacattaactccaagaccaacagccatttcatcacccatagctaaagcgtttaaatctgatgaaataaatatagctatcaagtgacctaaaattataaaaggtagtagtgtagatatagaagataatgtagctgctccaaggctacctatttgccaaaatctaaatttgtctaagacgttattattcggtaaaattaaaaaacttacaaaactgcttaaagccatactaacacaagttcctgataaggcaagttttataggggtaaggcctgcttttccgttacagcaatcgcgtatacaaaaattgcacttactaagccaccaatgattgcg

SEQ ID NO: 210 - DNA, 11378 bp; double-stranded, linear
ccaaattgctccacaattattatggagtcgtcgtttggcagatgggcgtgatatgtgtgctcaagaatggttgacaggcaagatattgaccccctatgatatgaatcgtaagcaaatcgtcaatattttaacccgtcttcatcgctcacgtccgttgatgacacaattgagtcgtttgggctatgccatggaaacacctgtagatttactacagtcttggcaggaaacggctccagatgctttgcgtaaaaatcattttatcagtgaagtgatggctgatttacgtcagactattccaggatttagagaggaccatgcgaccattgtccatggagatgtacgacatagtaattggattgagacagatagtggcttgatttatttagtagattgggattcggttcgcttgaccgatcgcatgtttgatgtggcccatatgctctgccattatatttcagaacatcagtggaaggaatggttgacctactacggttacaagtacaatcaaacggtattaagtaaattgtattggtatggtcaattgtcttatttgagtcagatttccaagtattatatgaaccaagatttagaaaatgtcaatcgggagattcatggtttgcgtcatttccgagacaagtatggaaagagaagatgagagttagaaatcgtaaaggggcaacagaattactagaggcaaatccccagtatgtggtcctcaatcccttggaagccaaggcaaaatggcgggacttgtttggcaatgataatcccattcatgtggaagttggaagtggaaagggtgcctttgtttcaggtatggccaagcaaaaccctgacatcaactatatcgggattgatattcaaaagtctgttttgagctacgctttggacaaggtgcttgaagttggagtgcctaacatcaagctcttgtgggtagatggttctgacttaactgactactttgaagacggtgagattgatcgcttgtatctgaacttttcagatccatggccgaaaaaacgccatgaaaagcgtcgtttgacctacaagaccttcttggataccttcaaacgtatcttgcctgaaaatggagaaattcatttcaagacggataaccgtggcttgtttgagtacagtttagtgagcttttctcaatatggcatgaaactcaatggtgtctggttagatttgcatgccagtgattttgaaggcaatgtcatgacagaatacgagcaaaaattctcaaacaaggggcaagttatctaccgagttgaggcagaattttaagagataacctaaaattaggctgtacaagtgcttttgctttacataagttggcaaacgtgctatactgatagtaagaatatgaaaagtgaggcggggaaatatcttcgcctcttgcttatgaggaggtggacgcaatcgcaacaatcgtagaattagtcagagaagttgtagaacctgtcatagaagctccttttgaactcgtggatatcgagtatggaaagattggcagtgacatgattctcagtatttttgtagataaacccgaagaattaccttgaacgacacggcagacttgacagaaattatcagtcctgtcctagacaccatcaagccagatcccttcccagaacaatatttcctagaaattaccagtccaggtttggaacgtcctttgaaaaccaaggatgccgtcgctggagcggttggaaaatacatccatgtcgggctctaccaagccatcgataagcaaaaggtctttgaaggaaccttgttggccttcgaagaggacgagttgactatggaatatatggacaagacgcgtaagaaaaccgtccaaattccatacagtttagtatcaaaagcacgtttagcagttaaattatagaaaaagaaaggatagcttttgaggattcaaaagtgaagaaaacatgagtaaagaaatgctagaggccttccgcattttggaagaagacaagggaatcaaaaaagaagatatcatcgacgcagtagtagagtcgcttcgttccgcttatcgcagacgctatggtcagtcagacagcgtagctattgacttcaacgaaaaaacaggtgactttacagtttatactgtccgtgaagttgttgatgaagtatttgatagccgtttggaaatcagcttgaaagatgctcttgccattaattcagcttatgaacttggagacaaaatcaagtttgaagaagcaccagctgagtttggtcgtgtagcagcccaatctgccaaacaaaccatcatggaaaaaatgcgcaagcaaacacgtgccatcacttacaatacttacaaagaacatgagcaagaaatcatgtctggtacagtagaacgctttgacaaccgctttatctatgtcaaccttggtagcatcgaagcccaattgtcaaaacaagaccaaattcctggagaagtttttgcttctcatgatcgtatcgaagtttatgtttacaaggttgaagacaaccctcgtggtgtgaacgtctttgttagccgtagtcatccagaaatgatcaaacgtttaatggagcaagaaattccagaagtttatgatggaactgttgaaatcatgagcgtggctcgtgaagcaggtgaccgtacgaaggttgctgttcgtagccacaatccaaacgtggatgctatcggtacaatcgttggacgtggtggtgctaatatcaagaagattactagcaaattccacccagctcgttacgatgctaaaaatgaccgcatggtaccaatcgaagaaaatatcgatgttatcgagtgggtagcagatccagctgaatttatctacaatgccatcgctcctgctgaggttgaccaagttatctttgatgaaaacgacagcaaacgtgccttggtggttgttccagataacaagctttctcttgccattggtcgtcgtggacaaaacgtgcgcttggcggctcacttgactggttaccgtatcgatatcaagtctgctagcgaatttgaagccatggaagacgctgcttcagtagagttggaagtagaaaacgatactgtagaagaataaaagctgctagaggagggaaagatgaaaacaagaaaaatccctttgcgcaagtctgttgtgtctaacgaagtgattgataagcgtgatttgctccgcattgtcaagaacaaggaaggacaagtctttattgatcctacgggcaaggccaatggccgcggcgcttatatcaaactagacaatgcagaagccctagaggcgaaaaagaagaaggtctttaaccgcagctttagcatggaagtggaagaaagcttttatgacgagttgatcgcttatgtggatcacaaagtgaaaagaagagagttgggacttgaataagcaaaagataagtaatctcttggggcttgctcagcgagcagggcgcatcatatcgggtgaagaattggtggtcaaggccattcaagacggcaaggccaagttggtctttctagctcatgatgctggacccaatctgaccaagaagattcaagataaaagtcattattatcaagtagaaattgtaaccgtgttttcaacactggaattaagcatagcagtcgggaaatcgagaaaggttttggctgtaacagatgctggatttacaaagaaaatgaggtctcttatggaatagaagaggaggacatgatttgtctaagaaaagattgtacgaaatcgcaaaagaacttggaaaagaaagtaaagaagttgtagcgcgtgcaaaagagttgggcttggatgtgaaaagccactcatcaagtgtggaagaagctgtcgctgcaaaaattgctgccagctttaagcctgcagctgctccgaaagtagaagcaaaacctgcagccccaaaagtaagtgcagaaaagaaagccgaaaaatctgagccagctaaaccagctgtagctaaggaagaggcaaaacctgcagccccaaaagcaagtgcagaaaagaaagccgaaaagtctgaaccagtaaaaccagctgtagccaaggaagaggcaaaaccagctgagccagtcactccgaaaacagaaaaagtagcggctaaaccgcaaagtcgtaatttcaaggctgagcgtgaagcacgtgctaaagagcaggcagagcgacgcaagcaaaataagggcaataaccgtgaccaacaacaaaacggaaaccgtcagaaaaacgacggccgtaatggtggaaaacaaggtcaaagcaaccgcgacaatcgtcgctttaatgaccaagctaagaagcagcaaggtcagcaaaaacgtagaaatgagcgccgtcagcaagaggataaacgttcaaatcaagcggctccacgtattgactttaaagcccgtgcagcagccctaaaagcagagcaaaatgcagagtacgctcgttcaagtgaggaacgcttcaagcagtatcaggctgctaaagaagccttggctcaagctaacaaacgcaaggaaccagaggaaatctttgaagaagcggctaagttagctgaacaagcacagcaagttcaagcagtggttgaagtcgtccctgagaaaaaagaacctgcagtggatacacgtcgtaaaaaacaagctcgaccagacaaaaatcgtgacgattatgatcatgaagaagatggtcctagaaaacaacaaaagaatcgaagtagtcaaaatcaagtgagaaatcaaaagaatagtaactggaataacaacaaaaagaacaaaaaaggcaataacaagaacaaccgtaatcagactccaaaacctgttacggagcgtaaattccatgaattgccaacagaatttgaatatacagatggtatgaccgttgcggaaatcgcaaaacgtatcaaacgtgaaccagctgaaattgttaagaaacttttcatgatgggtgtcatggccacacaaaaccaatccttggatggggaaacaattgaactcctcatggtggattacggtatcgaagccaaacaaaaggttgaagtggataatgctgacatcgaacgtttctttgtcgaagatggttatctcaatgaagatgaattggttgagcgtccaccagttgttactatcatgggacacgttgaccacggtaaaacaacccttttggatactcttcgtaactcacgtgttgcgacaggtgaagcaggtggtattactcagcatatcggtgcctaccaaatcgtggaaaatggtaagaagattaccttccttgatacaccaggacacgcggcctttacatcaatgcgtgcgcgtggtgcttctgttaccgatattacgatcttggtcgtagcggcagatgacggggttatgcctcagactattgaagccatcaaccactcaaaagcagctaacgttccaatcatcgtagctattaacaagattgataaaccaggtgctaacccagaacgcgttatcggtgaattggcagagcatggtgtgatgtcaactgcttggggtggagattctgaatttgttgaaatttcggctaaattcaaccaaaatatcgaagaattgttggaaacagtccttcttgtggctgaaatccaagaactcaaagcagacccaacagttcgtgcgatcggtacggttatcgaagcgcgcttggataaaggaaaaggtgcggtcgcaacccttcttgtacaacaaggtaccttgaatgttcaagacccaatcgttgtcggaaataccttcggtcgtgtccgtgctatgaccaacgaccttggtcgtcgtgttaaagttgctggaccatcaacaccagtctctatcacaggtttgaacgaagcaccgatggcgggtgaccactttgccgtttacgaggatgaaaaatctgcgcgtgcagcaggtgaagagcgtgccaaacgtgccctcatgaaacaacgtcaagctacccaacgtgttagccttgaaaacctctttgatacccttaaagctggggaactcaaatctgttaatgttatcatcaaggctgatgtacaaggttctgttgaagccctttctgcctcacttcaaaagattgacgtggaaggtgtcaaagtgactatcgtccactcagcggtcggtgctatcaacgaatcagacgtgacccttgccgaagcttcaaatgcctttatcgttggtttcaacgtacgccctacaccacaagctcgtcaacaagcagaagctgacgatgtggaaatccgtcttcacagcattatctacaaggttatcgaagagatggaagaagctatgaaagggatgcttgatccagaatttgaagaaaaagttattggtgaagcggttatccgtgaaaccttcaaggtgtctaaagtgggaactatcggtggatttatggttatcaacggtaaggttgcccgtgactctaaagtccgtgttatccgtgatggtgtcgttatctatgatggtgaactcgcaagcttgaaacactataaagacgacgtgaaagaagtgacaaacggtcgtgaaggtggattgatgatcgacggctacaatgatattaagatggatgatgtgattgaggcgtatgtcatggaagaaatcaagagataagattttttgctcctttcttaggtggtgagggacgcaagcaaaccgatggtttcattgcttatttttgagcctagggtctcaaaaatcccctgtgatgggactgataaatcagttccatcactttcaccacggcgaaagaagcagatgacttcaaattgaacttcgtttcaatttaaactgaaaatcaagaagtttaaaatagctaggtctgctggcctagcttttggttcaaagtagagaaaggaatatcatggcaaatcatttccgtacagatcgtgtgggcatggaaatcaagcgtgaagtcaatgagattttgcaaaagaaagtccgtgatccacgtgtccaaggtgtgaccatcatagatgttcagatgctgggtgacttgtctgttgccaaggtttattacaccattttgagtaaccttgcttcggataaccaaaaagcccaaatcgggcttgaaaaagcaactggtaccatcaaacgtgaacttggtcgcaatttgaaattgtacaaaatcccagatttgaccttcgtcaaagacgagtccatcgagtatggaaacaagattgacgagatgctacgcaatctggataagaactaaagaagaggggttgcccctcttttttggtggaggaaaataggttgaatttgaaatggaaaaatattcttttataatagattgaaactagaatagtacgcctctacttctaaaatattgttagaaatcgatttgactgtcctgatcgatttgtcctgttcttgtttcattttaatataaaaaagggattctgtattttttaatgttatctaattagaaaatgctttttttgtaggaaatataatatgataaggtgcaaaaaagaaataaggagtttgtatatggctgaacaagacttagctatgcaagtattgcaacaagtggtgaaactacctgttgttaaggttgatcgttcgaaatttttagtggataagttttccaaagaattggatccaaaagatattcctaccttattggaacaaggtccaacgactcttctatctcaagaaatattagatcgtgtagctaatgcttgtattcgggacaatgtattattagcgagtgggacttctgttttggcaggattacctggagggcttgctatggcaattaccattccagctgatgtggctcaattttatgctttctctctgaaattggctcaagaattaggttatatttatggttatgaggatctttgggcttcacgagaggagttgagtgaagatgctcaaaataccctcttgctttatctaggcgtaatgttaggggtgaatggaaccgctgctttgctacgtgttggtagtataacaattgccaaacaggtaatgaaaatagtgcctaataaagctttaacaaagacgctttggtaccctattttgaaaaaagtcttaaaaatatttggtgtgaatcttaccaagggagggttggccaaaggaatggggaaatttattcctatcttgggtggtatcatttcaggtggtttaacctttgcaactatgaaaccaatgggggaaagcttgcagaaagaattatccaagctagtcaactatagtgaagttcaatatcaagaagatgttgaaacaatccgaaaagaggctgaaatcatcaaaggagagtaatatgaatcctatcaaagcttttgctaaaatttatggtaattactttttgaccgtgcaaggtgtaaaagtgatgaaaacgataaagaaagctgaccatgtcgttgttggtctggggaaactttttattgccgacaagttaatggatacggctcggtggctcattaagccagaggagagagaatgaaatttttttggtcttcttgctattctttttatcaaaccgattattgggattgtgaaattcttttggatgatcatctcttttgcagtccaattgctgttttacaagatagtgtttaagatattggattggctctttaaacttatctagatggtaatccaagttgcagagaactagcaggaactccactgctagttttttattctctttccatatggtataatataagcagtaaaatcattttatactcttcgaaaatctcttcaaaccacgtcagcttcaccttgcagtatatatgttactgacttcgtcagttctatccacaacctcaaaacggtgttttgagctgacttcgtcagttctatctacaacctcaaaacactgttttgagcaacctgcggctagcttcctagtttgctctttgattttcattgagtattagaacatacaatggaggtcgtcatggacaatatcatcgatgtgtcaattcctgttgcagaagtggtggacaagcatccagaagtcttggaaattctagtggagttgggttttaaaccccttgccaatcccttaatgcgcaatacagttggtcgtaaagtatcacttaaacagggttctaagctagcaggaactcctatggacaagattgtacgcacactggaagcgaatggctacgaagtgattggattagactaatgacagatgaacggattcatatcctacgggatattttgttagaattgcacaatggcgcctctcctgagtcggttcaagatcgctttgatgcgacctttacgggcgtgtcagccatcgagatttcccttatggagcacgagctgatgaactcggattcgggcgtcacttttgaagatgttatggaactctgtgatgtccatgccaatctttttaaaaatgctatcaaaggtgtcgaagtttcagatactgagcatccaggtcacccagttcgtgtcttcaaagaagaaaatctggctctccgtgcggccttgattcgcattcgtagattgttagatacctatgagtctatggaagacgaggaaatgctggcggagatgcgtaagggtttggtgcgtcagatgggacttgtgggtcaatttgacatccattaccaacgtaaggaagaactcttctttcctatcatggagcgctatggacacgattcacctcccaaagttatgtggggagtggatgatcagattagggaactctttcaaacagctctaacgacagccaagtcactaccagaagtgtcaattagcagtgtaaaggaagcttttgaagcttttgcgacagagtttgaaagtatgattttcaaggaagagtccatcctcctcatgattctccttgagtcttttactcaggatgactggcttcagattgcggaggagagcgatgcctatggctatgccatcatccgtccgtcagagaaatgggtgccagaacgacagagctttattgaggaaaagattgcagaggagcctgtacagctagatacggcagaaggtcaagttcaacaagtcatagatacgccagaaggccattttaccattacctttacccctaaggaaaaggaagctgtgctggaccgccatagtcaacaggcttttggtaatggctatctttcagtcgagcaggccaatctcatcctcaatcatctccctatggagattacctttgtcaataaagaagatattttccagtattacaatgacaatacgccagctgatgagatgattttcaaacggacgccgtcccaagtcgggcgcaatgtcgaactctgccatccgcctaagtacttggacaaggtcaaaactatcatgaaggggcttcgtgagggaagcaaagacaagtatgaaatgtggttcaagtctgagtcgcgaggtaagtttgtccacatcacctatgctgcagtacacgatgaagacggagaattccaaggagtgttggagtatgttcaggatatccagccctaccgtgagattgatacggactattttcgtggattagaataaggagaaaaaatgagttacgaacaagaatttatgaaggaatttgaagcttgggtcaatacccaaatcatgattaacgacatggcgcacaaggaaagccaaaaagtttacgaagaagaccaggacgagcgtgccaaagatgccatgattcgctacgagagtcgcttggatgcttatcagttcttgcttggtaagtttgaaaacttcaaagtaggcaagggattccatgatttgccagaaggcttgtttggtgagcgaaattattaaacgagaaagattcttgatttttcactaaaatcttgatagaatgtttatgttaaatccttgtcagagcagggattttttattgaaaggattttatcatgtcaaagaaactcaatcgtaaaaaacaattacgaaatggcctccgtcgcgcaggtgccttttcaagtacggtgactaaggttgtagatgagacaaaaaaagtcgtgaagcgtgcagaacagtcagcaagcgcagctggtaaggctgtttctaaaaaagttgaacaagcagtagaagctaccaaagagcaagctcaaaaagtagctaattctgtagaagattttgcagcaaatttgggtggacttccacttgatcgtgccaagactttctatgatgaaggaatcaagtctgcttcagatttcaaaaactggactgaaaaagaactccttgccttgaaaggaatcggcccagctaccatcaagaaattgaaagaaaatggcatcaagttcaagtaatttttcttgagccttgcatttccgaaaaaatcttgctacaatagagccattagaggtgttttgaatcccacattttacagaaagtggcggcgctgagaagtccacaaatgtgtcaaaactggttgctaatggatgaaaaattgaaataaaagtgtctttttgctttaaagacgagagttgcg

SEQ ID NO: 211 - DNA, 4156 bp; double-stranded, linear
ccgcgagccacggcgaatttgctgcgggtattcatcagtcaggatctatgatctttggtgaacaagaaaaggttcaagttgtgacctttatgccaaatgaaggtcctgatgatctatacgctaagtttaataacgctgttgctgcatttgacgcagaagatgaggttctagttttggctgacctttggagtggttctccatttaaccaagctagtcgcgtgatgggagaaaatcctgagcgtaagtttgccatcatcacaggacttaacttaccgatgttgattcaagcctacacagagcgcctcatggacgctgctgcaggtgtagaaaaagtcgctgctaatatcattaaagaagccaaagatggcatcaaagctcttccagaagagctaaatccagtcgaagaagttgcaagcgctgcagctgctccagttgcccaaactgctatcccagaaggaactgttatcggagacggtaaattgaaaatcaatcttgcccgtcttgacacacgtctacttcacggtcaggttgcaactgcttggactccagattcaaaagcaaatcgtatcatcgttgcttcagataacgtggctaaagacgaccttcgtaaagaattgattaaacaagcagctccaggtaatgtcaaggctaacgtggttccaattcaaaaactgattgagatttcaaaagacccacgttttggagaaacacatgcccttatcttgtttgaaacacctcaagatgcccttcgtgccatcgaaggcggcgtgccaatcaagactcttaatgttggttctatggctcactcaacaggtaaaacattggtcaataccgttttgtctatggacaaagaagacgttgctacatttgaaaaaatgcgtgacttgggtgttgaatttgatgtccgtaaagtaccaaatgattctaaaaaagatttgtttgacttgattaacaaagccaatgtcaaataagccattatttatgaaaggattttaaacatgtctattatttctatggttttagtagtcgttgtagccttctttgcaggtcttgaaggcatcctcgaccagttccaatttcaccaaccacttgtagcctgtacccttattgggcttgtaacaggtcacttggaagcagggattatcctcggtggatcgcttcaaatgattgcccttggttggtcaaatatcggtgctgctatcgctcctgatgctgcacttgcttctgtcgctgctgccattatcatggttcttggtggtgactttaccaagactggtatcggtgttgcccaagcggttgctatccctcttgctgtagctggacttttcttgacaatgattgttcgtacaatttcagttggtttggttcatactgcagatgctgccgctaaaaaaggtgacttcggcgctgtggagcgtgcgcatttcatcgcgctacttttccaaggacttcgtatcgcgcttcctgcagctcttctccttatggtaccaactgaaactgtacaaagtatccttagtgccatgccagactggctcaaagatggtatggctatcggtggtggtatggtcgttgccgttggttacgccatggttatcaacatgatggcaactcgtgaagtatggccattcttcgctcttggtttcgttctcgctgctgtgtcagatattactctaatcggattcggtgctatcggcgttgctatcgctcttatctaccttcacctttctaaaactggtggaaatggtggcggaggagccgcaacttctaacgacccaatcggcgatatcctagaagactactaagataagaaaggactgaaaacatcatgactgaaaaacttcaattaactaaatcagatcgtaaaaaagtttggtggcgttcaaccttcttacaagggtcttggaactttgaacggatgcaaaacttgggctgggcttatacactcattccagctatcaaaaaactctatactaaaaaagaagatcaaatcgctgctcttgagcgtcaccttgagttcttcaacactcatccatacgtagctgctccagtcatgggggttactcttgcgcttgaagaagaacgtgctaacggtgtggaaatcgatgacgctgctatccaaggggttaaaatcggtatgatgggacctcttgctggtatcggtgacccagtattctggtttacagtacgcccaatccttggatctctcggtgcttcacttgcccttactggcaatatcttggggccactcctcttctttgttgcatggaacttgattcgtatgtcattcttgtggtatgttcaagagattggatacaaggctggatcagaaatcactaaagatatgtctggtggtatccttcaagatatcactaaaggagcttctatccttgggatgttcattcttgctgtccttgttcaacgctgggtaaatattaaatttgctttcgatgtttctaaagttcaactagatgaaaaggcttatatccattgggataaattgccagaagggtctaaaggtatccaagaagcattcgcacaagtaggacaaggattgtctcaaactcctgaaaaagttactactttccaacaaaacttggatatgttgattcctggattatcaggactactccttactttactttgcatgtacttacttaagaaaaaagtatctccaatcactattatccttgccctcttcgcagtgggtattgtggcacatgttcttcacatcatgtaatcaagcaactaaaaaggaaccaggttctaaaatctgattccttttttctatgcttttattcagccaaggctcccattggatcccatggtgcaagtacgattggttctgctccataggcagcttgttcttctgctgtcagcaattccttacgaacaacgatttggtatgtgtattcgtccatccaagcgtctgaggcaacaaagtaaccatctgtaccgaccttgtctccccatgagttttcaaccttccacttggttgatttaccattttcgtccaagtcaacacctgtcaagaccatggcgtgggtcatcaagctttcactatagtccaaacgtccagccttgtcttgagtaagtttaatgtccatgcttgattcaaagtcataaacatctgtcgcaaggatgccagcttacggttgctgagctggccgacatcagaaccaaaccaaacagtctcacctgcttgcatttgggcaatcgccaattctttcaagcgctccattggaacgttgatgtagcgaactgcacggctaccaaccacattccccaacatctcaactgtgtaagattttccgtaaggtttatcagcagttggagcattgataacagaaacgtagtcttctaaaggaagattgacatatttcttgtaaaactcttgtggtgtgattcctttttcacttttgtagttgttatctttatcgcgataagcaaagtcaaacttgcgtggtggaagtcctaatgacatagcaagaaagttaaagatttcttgcaagaggtcttctttcttagcttgaacagtcgcttgatctgcaccagaaacaagcaagtcacgcaagatttgagcatcttgacgaagcaatttattaaggatcgcatttagctcacgactgctgctagatgaaacagactcaggataaactgacttaggcacgacaccgtatttttcaaagagggaaacgaccatatcccattgaccgccatcttgttgaggtgtttggagtaagaagctaacttgcggctagtcaattcttggtctgaagtcgcaatgacttgctccaagaaccagtttgatttctcatacttatcccagaagaaagtgtgggcttgtgacaactcaaagttctccaatttgtattgcgagatgagtttgtggcggaaggtgttgagagccgcaaacatccagcaacgaccagacgctttctggttagtgaccttgtccttggttaaatccaatgagaaaacaggtgtgttgtctacatggctttggcgacgttccagagctgcaaaaattccgttgtggctggcagcattttcaatcgcttggtattttacatttgcttcatagttggcaaatagtttatcagtaaatgattcttgaatcgcgttcatagattcctccttttagtctacagtgtattgg

SEQ ID NO: 212 - DNA, 3902 bp; double-stranded, linear
aaaaacaacaaaataaaacaaaaacaaaaatatcgaggtttattttcaaaactttcgatatttttattaagttattattttgttgtttctagtttactttttgatggttaagagtggtggagaattatactcaatgaaaatcaaagagcaaactaggaagctagccgcaggctgtacttgagtacggcaaggcgaagctgacgtggtttgaatttgattttcgaagagtattagtgcaaaccgtagttgtagtcatcatcttgcatggcttcaacttcgccaagaaggtaaccatttccgacttgagagaagaagtcatggttggaagttcctgttgaaataccgttcataacgattgggttgacatcttcagctgaatctgggaaaagtggatcttgtcccatgttcatgagagctttattggcattgtagcgaaggaaggttttaacctcttcagtccaaccaacaccgtcataaagactctctgtgtagccttcttcattttcataaagagtatagagtaggtcgtacatccattctttgagtttttcttgctcttcttcaggtaattcattgaaaccaagttggaatttgtaaccaatgtaggttccgtgaacagactcgtcacgaataatcaatttaatgatttctgcaacgttggcaagtttgttgttaccgagatagtagaggggagtgaagaaaccagagtagaagaggaaggtttcgaggaagacgctggcaactttcttttcaagtgggctgccgtttaggtagatttcgttgacaatctcagccttcttttgtaggtaaggattggtattggtccattcgaaaatttcttcaatctcagccttagtattcaaggtagaaaagattgatgagtaagatttagcgtggacagattccataaattggatgttattgaagacagcttcctcatgtggtgtacggatgtctgcgcgaagggcttgaaccccagtttcagattgcatagtgtcaagaagggttaaaccaccaaaaacttttccgaccaagtctttctctttgttagatagctttctccagtcatccaagtcgtttgataagggaatacgtgtatcgagccaaaattgctccgtcagtttttcccaagttgatttgtcgatgacatcttcgatggcattccagttaatggctttgtagtaagtttccatttaaaatctctttctgtgtttagtattgcgaactcacaattatttctactttaccataattctataggagtatcgcacaaaaagtcggaagcccgacttttaaaatgttacataaattatgttatgacatagtagatttgattttatcagtgctgcttagggaaaaatagtgtttctatgctagaaactaaatcacacagctttcacattggttggcgccgacttctccaccgtcatctgtaaaggtacggacgtagtagatagacttgattcccttgttaaaggcatagttacgaaggatggacaagtcacgtgtcgtttgtttattttccctcttccattcgtaaaggccttttggaatgtcactgcgcatgaagagggtgagtgaaagtccttgatccacgtgttcagtcgcagcagcgtaaacatcgatgactttacgcatatccatatcgtaggcagaagtgtagtaaggaatggtttctgtagacaagccagcagcagggtaatagattttaccaattttcttctcttggcgttcttcgatacgttgcgtaatcgggtggatagaagcagaaacgtcgttgatatagctgatagaaccatttggcgctacagcaaggcgattttggtggtaaagaccatcttcttgaaccttgtcgcgaagttcagcccaatcagcaacaccagggataaagacatttttgaagagttctttaacacggtctgatgttggaacaaattcaccagttacatacttgtcaaagtaacttccgttagcatagtctgatttttcaaagttgtggaaggtaataccacgttcacgtgcaatattgtttgactctaccaaggtccagtagttcataagcataaagtagatgcttgtaaattcaacagactcaggtgaaccatattcaatgagttgttgggcaaggtagctgtgcagtcccatggcaccgagaccaaaggtgtgggcttggctatttccatggtcaatcgttggtacagctacgatatgtgaactatctgtaacgaaagtaagggcacgaaccatagcacggatagaacgaccaaaatcaggtgaagtcatcatgttaaccacgttggttgaacccaggttacatgaaacatctgttcccatttgaaggaattcttgagcatcgttgatcaagcttggttcttgaacttgaagaatctcagaacacaagttactcatgataatctttccatcaacaggatttgcacggttagccgtatcgatgttgactacataaggatagccagactcttgttgcaatttagagatttcagtttccaaatcccgcgccttgatttttgtcttgcgaatatttggatttgcgaccaattcatcgtatttttcagtaatgtcgatgtaattgaatggcacaccgtattctttttctacagagtaagggctgaagaggtacatttcttcatttttacgagccaattcgtagaatttatcaggtactacaacaccaagtgatagagtcttgacacgtactttttcatcagcgttttctttcttagttgaaaggaaagcgatgatatctgggtgaaagacgttgaggtagacaacaccagcaccttgacgttgccccaattggttggagtaagagaagctgtcttcaaaaagcttcataacaggaacgacacctgaagcagctccttcatagcctttgataggtgcaccagcttcacgaaggttgctgagggtaattcccacaccaccaccaatacgtgaaagttgaagagctgagttgatagaacgcccgatagagttcatatcatccgtcacttggattaggaaacaagataccaactccccacgacgagcacgtccagcattcaagaaggaaggagtagcaggttggtagcgttggtggatgatttcattggcaatatcgattgcaacagcttcattcccatcagcgaaataaagggcattgaagaagacacggtcttccatattttcaagatagtattcaccgtcattagtctttaaggcatattgattgtaaaatttataagctgccatgaatgacttgaattggaagttttggtctttgataaattgagctaattcttccaagaactctggacggtatttcttgataaaggctgtttcgatgtagttgtgttcaatgaggtaattgattttgtctttgattgaatcaaaaaccatagtgtttggaactacattttctttaaagaaagcatccaaggcttccttgtctttatgaagcatgatttgtccattaacaggacggttaatttcgttattaagacggaagtaagtcacgtcttcaagatgttttaatcccataaaatttcccttatctaattacaaaagaaaggcttctaagttagccctaaaagcagtttcttctggatgatgtactaagattatgctaattgtttcagttttcctggttggaaacctgaaaagacttcagttggtgtttggataacaggagctgcgctaaaaccgagctctttaacttgatcgacgtactcaggttgctcatcaagattgatttcacgataagagacattattactgtccaagaaacgcttggtcattttacattggacacaattgtttttagaataaacggttaccattgtgtaactcctcttcaaaatttaatactatcttagtatatcagaaaataaaattttgtcggg

SEQ ID NO: 213 - DNA, 2456 bp; double-stranded, linear
tattgaagctattgtagactacaaagataaggatttgcagttagtaggcggtgagactcactgataacctaaaaaggatagtcaattatgcttgtttactaactattaactatgctaaatcaattgaggttgtttacataaaactctatatcagagaagcctgatatagagttttttcttgctagttttaggatttttttgtaaaatagaaaaagtgaagagaggtatgaaatgagcaagaaagataaaaaaatcgaaattcaagtagcggatgccaaagttaatgttggtaaagacagttttgaaggttatacattgactatcggtaaaaaagttatcggagaaattgccgaattagacggacaatttgccattataaagaatgggaatgtcgatagtttttataaaaaattggaaaaagctgtggaaattttgattgaaaattataatttagcaaaataagtcttgtttttttgaaattttcatgatataatagtccatgttgattgtaggagagatagcgaagaggctaaacgcggcggactgtaaatccgccccttcgggttcgggggttcgaatccctctctctccatttcattaatggggtatagccaagcggtaaggcaagggactttgactccctcatgcgttggttcgaatccagctaccccagttcttaggtaataatcaagatagaaagcaaaatatcttagggtattttatttttataattgaaagacgtgaatgatatgaacatgtccttgcgggtgcttaggaaaaaaattataagtatgtcaagtttaagaaaaacttgattgttggaggattttttagatgaacgaatttgaagatttgctaaatagcgttagtcaagttgagactggtgatgttgttagtgctgaagtattgacagttgatgcgactcaagctaacgttgcaatctctggaactggtgttgaaggtgtcttgactcttcgcgaattgacaaacgatcgtgatgcagatatcaatgactttgttaaagtaggagaagtattggatgttcttgtacttcgtcaagtagttggtaaagatactgatacagttacataccttgtatctaaaaaacgccttgaagctcgcaaagcatgggacaaacttgttggtcgcgaagaagaagttgttactgttaaaggaacgcgtgccgttaaaggtggactttcagtagaatttgaaggtgttcgtggatttatcccagcttcaatgttggatactcgtttcgtacgtaacgctgagcgttttgtaggtcaagaatttgatactaaaatcaaagaagttaacgctaaagaaaaccgcttcatcctttcacgtcgtgaagttgttgaagcagctactgcagcagctcgcgctgaagtattcggtaaattggctgttggtgatgttgtaactggtaaagttgctcgtatcacaagcttcggcgctttcgtcgaccttggtggtgttgacggattggttcacttgactgaattgtcacatgaacgtaatgtatcaccaaaatcagttgtaactgttggtgaagaaattgaagtgaaaatccttgatcttaacgaagaagaaggacgtgtatcactttcacttaaagcaacagtaccaggaccatgggatggcgttgagcaaaaattggctaaaggtgatgtagtagaaggaacagttaaacgtttgactgacttcggtgcatttgttgaagtattgccaggtatcgatggacttgttcacgtatcacaaatttcacacaaacggattgaaaatccaaaagaagctcttaaagttggtcaagaagttcaagttaaagttcttgaagttaacgcagatgcagaacgcgtgtcactttctattaaagctcttgaagaacgtccagcccaagaagaaggacaaaaagaagaaaaacgtgctgctcgtccacgtcgtccaagacgtcaagaaaagcgtgatttcgaacttccagaaacacaaacaggattttcaatggctgatttgtttggtgatatcgaactttaatcaaattgaaaattcacaaaatcctttgtttactaaacaagggatttttctggctctttgtcaactgtagtgggttgaagaaaagctaagctcgagaaaggacaaattttgtcctttcttttttgatattcagagcgataaaaatccgttttttgaagttttcaaagttccgaaaaccaaaggcattgcgcttgataagtttgatgagattattggtcgcttccagtttggcgttagaatagtgtagttgaagggtgttgacaagcttttctttatctttgaggaaggttttaaagacagtctgaaaaataggatgaacctgcttaagattgtcctcaataagtccgaaaaatttctccggttccttattctgaaagtgaaacagcaagagttgatagagctgatagtggtgtttcagg

SEQ ID NO: 214 - DNA, 10974 bp; double-stranded, linear
aaataggatatagagacatccttctgatctgcttttwacaaagtccaattatatgcggatctatacctccacaatgtccattattatmcctaactataatatgagccgaaaacactatatccttaatgtctccatatccatcagggatattaatatttatttttccacaactatattgcattgtaaccatctccttaaacgacgcattatgatatttgatagagaaatttttatgaataactcaataattttatagtaaatcatgcttatatctcaaagatacctattttatcttgtctcgaccttctccaaagaattgctataatactattacaaatccatctgcactacacttcaaattttagcactgtataaaaacgtttcaatacactaacttcaagaaaacttccactattaattgaaaaaattgatagagataaattaaaaatctatattgaaactcatcccgatgcttatttgactgaaatagctgctgaattcaactgtcctccaacaactattcattacgctctaaaggctatgggatatagtctaaaaaagagccgtacctactgcgaacaagacccagaaaaagtaaatcggttccttaaagaattgaatcacttaagctacctgactcctatttatatttatgagacaggggttgagacctatttttatctcgaatatgatcgagccttgagcaggcagttagtctctctggaagaagatataattatttgaattaagatcgagacaacgcacaccagagattgcgatactgttatagaagtactaatgcccttttttgtttcaatatactatggctccgatgacctataaagatacgatgacgagtgactttttcgaagcttgcttccaaaaattcttactacctactttagatacaccatcccttatcattatggacaatgcaaggtttcacagaatgaacatgtgtaaggagcagggcatagactgttaccacttcctacctattcacccgagtataatcccattgagaaaatatgggcttacatcaaaaacatctcagaataatattgtcaaattacgatgcttttcttgaggcacttttgtcctattcttgtttcagccgactatactccgttattgggcagctacggaacagtcgatgggacgatggggggacataaaaaaatcctccagttttgttttttataacagtatactggagaattgacaatctcggtagatacctcgttatagcgcggttacttattaggcagttacaaaacaactgtgaacagaaaacattccagagtcagacaagactttggaatgttttggctctataatttctgtagtgggtaatcccaccccaggaattatagggtcgtttcttgtagaaaaaaagccccatatgacctataatgaaaagcgtctaaccaactcattagaaagggttcatatggaacaacttaagaataccacagatttgctcggattggaagacaaaaatatcaaaatcttgtctgttctgaaataccaaacccatctagtcgttcaggcaaagttggattcccccgctcctccttgtcctcattgtcaagggaagatgatcaaatacgacttccagaaagcctctaaaattccgcttctcgactgtcagggtttacccacggtactgcatctcaaaaagcgccgctttcagtgcaagaattgccttaaggtggtcgtttctcaaacatccattgtcaagaaaaattgccagatttccaacatggtgagacaaaaaatcgctcagctcctccttgaaaagcagtctatgactgagattgcccacagattggcggtctcaacttccaccgtcatccgaaaactgagggaatttaagtttgaaaccgattggaccaagttgccaaaagttatgagttgggatgagtatagcttcaaaaagagcaaaatgagcttcattgcccaagattttgagtccaaatccatcctcgcaattttagacgggcgaactcatgcggtgattcgaaaccatttccaacgctatcagagagaggttcgggagctggtcgaggtcatcaccatggacatgtacagcccttattatcggctcgctaagcaactctttccaaaggcgaagattgttcttgaccgcttccacattgtccaacatctgagccgagctatgaaccgagtacgaatccaaatcatgaaccaatttgaccgaaaatccttggagtatcgggcgctcaagcgcttttggaaccctcgctttttcgtttctaggctcgggctaaatcagtccactggactgatttactacaccagtatagcttcaagctctgtcagaaacgattctatcagcccacgtttcgaatgcacttaacccatcgggaagtacgagataagctgctttcttactctgagggattacaggttcactacgaactctatcaactcctgctctttcattttcaagagaagaatgccgaccatttctttggattgattgagcaagaactgccaacggttcatccgctttttcaaacggtcttttggacttttttaagggatagagataagattatcaacgcacttaagctgccttattccaacgctaaacttgaagcgaccaataatttgattaagattatcaagcgcaaagcctttggtttccggaactttaacaattttaaaaaacggattttgatgactttgaacatcaaaaaagagagtacgaatttcgtactctccagattgcagcttttcgcctacccactacacttgacaaagagccactctttattccatggtatcaaaggcaagacttggtttggcattgaggtcccagcctgcgaagttttctttgttccactcgctgacgctggcataggcaatcatacctgcattgtctccgcagagtcgcagaggggggatgataaccttgacatctgtgatttcggctgctaggcgttctctgagacctttattggctgccacaccacctgccacaactaggattttaacaggatatttctccaaagccttcttggtttttgccatgagaatgtccataactgctgcttggaaggaagcacacaaatcttctgtagacaggctttctcccttttgctcggcattgtgatgaagattgataaaggcagatttcaaacctgagaaggagaactccagattatcttccttaatcatggcacgggggaaatcataaatatcctgcccctgatgagccagctcgtcaatctcacgacctgcaggataggtcaagcccatgacacggccgaccttatcataagcctcaccaaccgcatcatcacgggtttccccaacaatcttataatctcctgcctccgaaacataaaccaactctgtgtgtccgccgctgaccaagagggctagcaagggaaactccaaaggctccacactctgagctgccatgaggtgcccagccatgtgattaacaggaatcagtggaagtccgtgagcccaagcaaaggccttggcagctgacaaaccaactagcaaggctccgaccaagcctggtccgtaggtaaccgcaacagctgtcacgtcctcttcggtaatccctgcttctgccaatgcctcctcgatacaggctgtaatgacctcgacatggtgacgactggctacttcgggcactacgccaccaaaacgtttgtgactctcaatttgactagcaatgacattggacaagagctcatcgtcgtttttcaagacggcgacactggtctcatcacaggatgtctcaaatgctaaaatatatctatccttcatctatttctctcttcatgataatggcgtcctcgactgggtcatggtagtaggcctttcgctcagcgataactgtcatcttttctttcttgtaaaatgcttgcgctcgttgatttgactgtctgacttcgaggaaaatttccttgtctgtcggcaattgagcaaacaaggctgacgcaatcccctgaccctgataagctcctttgacagcgatttgcaggacttctgcttcaaaaagattctcctgcacagctagaaatccaatcacttctgccccatcataagccaatgcataccaagtctggtcttgggacagatctgcttggatttgctccagagtccaaggactgactaggtaaacagctgccataacagcgtagatggcttgagctaggtcaggctgttgttgaattcgcttgatttctatcataggcgtttaatgtaagactcgccagactcggtatggttcttgagccagttttcctcagcctcgactcgtttgaggtaattcggcacaaaatcatgcaaggagtctgcttccttgtcccaggccaaaagagctagattagctgcattgggcaatgtttctttgtaatcagtccttggcaagtgtttttgaatctgctcaacaaaggggccaacttctccgacaaaggttacctgactagtacccttgactttttctagcacctcttcaaaagataggtgcgcttctgccatgacaggtttggcattttcataaaatcctgcataaacattattgcgacgcgcatccatcaaggggacaaacaaaccttcttgttgatggggcaccagagccaagagactcgacataccaaccaactcgatgttcagggtgtgagctaaggtcttagcagttgctaccgcaattcgcaagcctgtatagctacccggcccttcagctaccacgattcggtccaaatccttgggtgtccaatccaaacttgccatcaaaaaatcgatggcaggcataagagtaatactgtgatttttcttaatattaatcgtcgtctcggcaagaacctgcttatcctctaaaatagccagagaaagagccttgctggacgtatcaaaagctaatactttcataacacattcctatctttttgtctgcttactattatactacaaaagctggcacatgggaattttctttgcccccagacaagagtgccctcacttaactaaaaataatttaaaaaaatgctcacttttccttttcttttccgaatataaaagtgaacaagaaaaaaggaggaaagttcaatgacaaattttgacattcttgacaatcaatttttatccttatctgaaaatgaattatcagatattgatggcggtctcgctcccttggttatctttggagtagcagtatcttggaaggctattgcaggtggaacagcacttataggttctggtttggcagctggttattttttaggaggagattaatatgatgaaagatttgaacaattatcgtgaaatttctaataaggaattgcaagaaatcaagggtggctttggtgtcggtgttggtatcgctttatttatggcaggttataccattggaaaagaccttcgtaaaaagtttggtaagtcatgctagataagaaacacatttttagaaggataaattttattgtcttcatctcttacagtttgctcagcattctcaatgatttgaacattactaccatccctttaccattcgatttatctgtttgtattgttttatttttatgcttcaactctatttttgatcagaacaatgactcccataaaaataataagctttgaaaattccattgtcatgtcatgttagaaaaatgcaaagaccacctcatcttgatagatggggtggaattttcgtgtcgtaaatctactatctctacattcccaaacaaaaaaccccagcataagcagggcatctaagcatttaattcaaagtaaaatacaaaccaaacgacataggtcacgaggaggagaaaaagcgagtagagagtcacaaaggtcattttccacaagaacttggtttgtcgtcgttccagtttggcaaatagaagattccccgcataaacgcaagcaacaaaaacaataaaagctaccaagcgagctccgatagcaaaagcaaataagttatacatagggcaacctccttgacttaaaatctatatggaattatgacaagcaataaatttcacttccgttatcaacataatacattttctttatttttgaaaacgcttaccaaagaaatcgtcccctaactttctcgtttccgtcttttactaatttttcattttgtggtataattgaaataattgtaacgaatcaaggtcaatctagacacaaaatggaatgaaatcaagcaaatatctgctaaaagtttggaataagctgacctgtaaatagaaaggaactatatgatttacaaagttttttatcaagaaacaaaagaacgtagcccacgccgtgaaacaacacgcacgctttacctagacatcgatgccagctcagaacttgagggccgtatcactgctcgccaacttgtcgaagaaaatcgcccagagtacaatatcgagtatatcgaactcttgtctgacaaattgctcgattacgaaaaagaaactggcgccttcgaaattacggagttctaatatggcctacactcttaaacctgaagaagtcggcgtttttgccatcggtggtctaggagaaatcgggaaaaacacttacggaattgaataccaagacgagattatcatcgtcgatgctgggattaaattcccagaagatgacttgcttggtatcgactatgtcattcctgactactcttacatcgtggacaatatcgaccgcgtcaaggctgttttaatcacacacggacacgaggaccacattggtgggattccgttcctactcaagcaagcaaatgtccctatttatgctggaccgcttgccttggctttgatccgtgggaaactcgaagaacacggcctcttgcgcaacgccaaactttacgaaatcaaccacaacaccgagttgacctttaaaaatctcaaggcaactttctttagaacgactcactctattccagagcctttggggattgtcattcatactcctcaagggaaaatcgtctgtacgggtgactttaagttcgactttactccagttggagaacctgcggacttgcatcgtatggctgcgcttggtgaagaaggcgtgctctgtctcctgtctgactcgacaaatgcggaagtaccaacctttaccaactctgaaaaagtcgttggtcagtccattatgaagattatccaaggtattgaaggacgtatcatctttgcatcctttgcctcaaatatcttccgtctccagcaggcaacagaagctgctgttaagactggacgcaagattgcggtctttggtcgttctatggaaaaggccattgtcaacggaatcgatcttggctacatcaaagctcctaagggaacctttatcgagccaaatgaaatcaaagattatcctgcaggagaagttcttatcctctgtacaggtagtcagggtgagcctatggcagccctctctcgtatcgccaacggaacccaccgtcaagtacaattacaaccaggtgataccgttatcttctcttctagtcccatccctggaaacactactagtgtcaacaagctgattaacatcatttctgaagctggtgtcgaagttatccacggtaaagtgaacaatatccatacatctggacacggtggtcagcaagagcaaaaactcatgctctgcttgattaagccaaaatacttcatgcctgtccacggtgaataccgcatgcaaaaagtccacgctggactagcagtggatactggtgttgagaaggacaatatctttatcatgagcaatggcgatgtgcttgcccttactgctgactcagctcgtatcgcaggtcatttcaacgcccaagatatctatgtcgatggaaatcgtatcggtgaaattggcgcagctgtcctcaaagatcgtcgcgatctatctgaagacggtgtcgttctggcagttgcaactgttgacttcaaatcgcagatgattctatctggtccagacatcctcagccgaggctttgtctacatgagagagtctggcgacttgattcgccaaagccagcgtatcctcttcaatgccattcgtatcgcactgaaaaataaggatgctagcgtgcaatctgtcaatggtgccattgtcaacgctattcgccccttcctctatgaaaataccgaacgtgaaccgatcatcatcccgatgatcctcacaccagatgaagaataaagcaagaaaacagccccgtcctcggagctgtttttctctatgctttcttttgagattaaaactcatactcaatgaaaatcaaagagcaaactaggaagctagccgtaggttgctcaaagcactgctttgaggttgtagatagaactgacgaagtcagtagccatacctacggcaaggcgacgttgacgcggtttgaagagattttcgaagagtatcaataaaaatcgaaatcagactagaaggctaagcgaaagcataacttgagttagctcccatagttcgggaaactatgggaggctggagatgaatcaaagccaagctttgaactcattcgtaagaagccgacgacgtatcattttgatttttgaagagttttagaaatactacgatttttaccttccagatacaccatcaaaatagaaatatctgctgggtttactcccgaaatacggctggcttggccgatggtttctggattgatgagtttgaacttctgacgggcttcggttgcgatagaatcaatgtcatcccagtcgatattggccggaatgcgtttttcttccatgcgtttcatcttggcaacctggtccatggctttggaaatatagccttcatacttgatttctgtttcaatcaattcgataatcttgtcatccaagtcttctgcagctggtccgatgaaggccaccacatcttggtaagaaacttctggacggcgaaggaattccttggctgtcactgcatcggtcaagggtttgaagcccatctcctcaaccttggcattggtttccttgactggcttgagtttgatactgtctaggcgcttcatctcattatcaaattgatttttcttgatttcaaaacgagcccagcgttcatcgtccacaaggccaatctcgcgtcccatctcagtcaagcgcatatcagcattgtcatgacgaagaatgagacggtattcagcacgactggtcaagagacggtagggttcaatggttcccttggtcaccaagtcgtcgatcatcaccccgatataaccatcactgcgcttcaaaatcaattcaggcttgccttggattttcagagccgcattgatacccgcgataatcccttggcctgctgcctcttcgtaacctgatgttccatttgtctgaccagcagtgaagagacctgagattttcttggtttccaaagtcgcacgcaactgatgaggcaagaccatatcatactcaatagcataacctgtccgcatcatctctgcattttccaaacctttgatggaatgcaccaagtcacgctggacatcctcaggcagactggttgaaagtccttgcacatagacttcctcagtattgcgcccttctggctcaaggaagagttggtgacgttccttgtccgcaaagcgcacaatcttgtcttcaatcgacggacagtaacgaggccccactcccttgaccacacctgtaaacataggcgcacggtggaggttgttttggataatctcatgactggtaccattggtataggtcaaccagcatggtacttggtccttgacataatcctcatcacgtgaagtgtatgagaaatgattaggcacttcgtctcctggctgaatttctgtcacatcgtaattgatagaagaagccttgacacgtggaggggttcctgtcttgaaacgaccgatttcgagacccagttccttgagattgtcagctaggttaatagaagccaagctgtggttaggacctgatgagtacttgaggtctccgatgataatttccccacggagagcagtccctgtcgtcacaataacagccttagcagcatattcttgatgggtggctgtacgcacaccgacaaccttgccatcttccaccaaaatctcatcaatcatggtttgacgaagggtcagattttcttggttttcaaccgtcttgcgcatctccttagagtaaagttccttgtcagcctgcgcacgaagggcacggacagctggccccttccctgtgtttagcatcttcatctggatgtaagtcttgtcaatggttttggccatctcgccaccgagggcatcgacttcacgcacgacaatccccttggcagaaccaccgatagagggattacaaggcatgaaagccagcatttcaatattgatggtcgcaagcaggaccttacagcccatacggctagcggccaaggaagcctcaaccccagcgtgtcccgcaccaattacaataatatcgtattcttcagtaaaatgataagtcatgtttctctcctattcctcaagatgaatgtgtcttagttggccttcccaatctggtagggctgtttttaaaaagactggaactagctggatattctggagcttatccaagtcaatccactcacagggctgccttttctcatcttcctgcatggtcaacggggcatcttcaagcaaatccaccagataatgaaactcgatattgtgataggaaacgccgtccacttcaaaacgattttcaaccacaaaagctagctgcccagcttgagctttgacacccagttcttccttcacttcacggactaccgcgtcttccgtgctttcattgacttgaatcgcacctccaatagtgtaatacttgcccttgtctttggtaactagaagcttgtgattttggacaatcaaggctgtagcccgaacaccaaaaaccgtattgtctacttttgtccgaaagtcttgttgagtcattcttgtcctttcccttaaacgacacaaaaacagtcaaaactacaaagaagtgcaggacaaaaaagcctgcaacatccagg

SEQ ID NO: 215 - DNA, 987 bp; double-stranded, linear
cccgttatgattatggatagcgctttcaaatttttaaactcctatcccatccttttatctatataataagtgaaaatataataactgtcaagtaactgaagtgaattttataaaaaaattacaagccaaatttgtaaagtttacactaagccgctaggcaatcgtctatcagaatatccgtttatttgtcaataatccgagaaaatcttgcaacgcttagaagtctataaaaactatcaacatttatatgacttgcgaatagcaatcctgctaaacctttccacactctatctatacaatcaagataaaaacatgtgtaagcaaatctgctacactttactggaggacgccaagaataagaaaagctacgataggcttgctatctgctatgtccgtattgggatttgtacagacgattctaaacttatccaaaaagggttctcccttctggagctgaccgaggaaacttctatgctgtctcatctcaaaaaagaagtagagacccattatcaaccaaagaaattataaaaaaagtcgagggagctcctcgaccttttcatagaatcgccgaacgatttaacgagaaagtatgacttttacgtttatcccaactcaattatgacatttttttcaaaagtcaatatatctcactttttcaacgacaagaaagaggctgataatctaccaacctcttattctgaacccatcactccatcactttttagcttcattcgctttcttagcgactgcaatctggtattcgacttggtcattccccttaccggtacaaccatgagcaattgtagtcgctcctatctgatgcgctatttcaaccaattttttagaaatcagagggcggctcaaggcagataccaagagatacttttgttcataataggcatgtgactgatgagccactagcacataatctgtagcaaattcgtccttaacatcaatgacataagattctactgcccaaaccttaag

SEQ ID NO: 216 - DNA, 2651 bp; double-stranded, linear
ctgggtcttgttcatagtaggtgtggttctttttttcgagtgtagcccatagctttgagcgcatagtggatggtagttggatgacagccaaagtcagaagctatttcagtcaaataagcatctggattgtcagtaagatagtttttaagtctatctctatcaacttttcttggttttgttccttttacttggtggtttagctctcctgttttctcttttagctttaaccagccataaatggtattacgtgagatttggaaaacgtgtgatgcttctgttatactacctattcgctcacaataagagagaacttttttacgaaaatctattgaatatgccataagaagattataccacattgtgtactatttttggttcattttactatattttataagttatagtgtagcattccaacttcaaagcactataaagtaaattgaaacaagaacaatacaaacaattctcgtaaacggattgcaaccacaaaaaagcaagcattcacaagaatacttacctatcatgggaggaacaaccgttcctcttttttattactaaaattcaaagaattccaatgcttttttcaagagcaaatccgtatattctggatcttcttgggctacttctatttcccgctgaactttttccaaatcatctgtaatcactccatctactcctaagtgaagagatttgctgatagcttctgaatcattgacagtccagacataaagtttctgatccgttgtccatagtttgcttacaaaatattcatccaaggttgagtactccatagtatatcctgtcgctcttgttttaggaaagacagaattgtagggcatgatgaaataaactggtagttcggcatcatactgtcttactttttcgacaacatggtagtctaaagactggatttgatgtccataaatcttgagctttgcagcataacgggctaaaaagcggttcatcatgtctggactatcttttttactggttttaatttcaattagtaatttttgaccaagttcgttggctcgactgagataatcttcaaagcttgaaattttagtctggtagccattttcaaaaatatcaatccctttaagctcctccaagtttaagtcttgaggacttttattgatacctgctagatttttcaagttagcatcatgcatcatgacaaactgcccatcttttgtttcctgcacgtccgtctccaccaagtctggtttgagttgtgctgtagtttccaaggactctactgtattttgaatcccatttgcattggaaacccctcggtgagaaataagttgaggtagatgaaccatgggagcctccagataaatataaccttctaaggcaaagaaaagactggcacaagtcatgacaccccatcgcacgatgtgatctttttctctcctaggaagcatatccagctcctttcctgtcaaaaatgaaacaaatttaaccaaaaaataagtcagagccatataatagagatttttaatcacgacaaaattcaaaataccaagaatcagagactctctctgagtgatatcatctaccaaagtttgagccaataataaaggaatcaaaggaagataraataataaatgtgctttgagcaagatgtaaaataaattccaagcataaaaagtaactctcttcttggttttctccaagctaaacatcactgcttctcgaacagtcagctgatcatatacaatcttcggaagggcaaacatcaatctgacagagacatagagaaagataagagatagaagtaggatgctcagccaccacatccaatatctatcttctaaataagcttggataaactctggaatgacgattttattaagataataaatcttcagcattttccgtataaaaggaaacagcatagctatatagaaaaagataaacaaggctttagcgcaagttagctttttcataaatccaaaactttcatggaaaaccttgcggatatactcaattagccttcgcttttcattatagaggagatgacgagcaccaataaagaggagtcctatttgaaaataagcaaccagaaggttaattacaatcaaggctaaaaaagctagactaatcaatggagaatgagtaaggatggctaagacattgttataggaaataaaaagataacctgtctgatctaataagaagctagccaaccatgaattgaatggtacccacaaatactccactatcataaaaatcaagaaaaatagaaagaggattttatcaagatcgaggtaaatctgtttaagacccaattttttaggtttttcaggtttcataggcactcctagtcaaataattgagacaagtccaagccaccaaaaggattgtttgataagctactttctgtctctaacaattccctagcttgatccgactctaagaaggattcgtaaacacgcgccgtcatccgagcatcctctaaactattatgagactgaccttgaaatccaagaaatgaggcaacagtttgcaatttgagattggcaataccatgtaaatctgaactccgacgttcaaaagcttcatcatacaaatccaccttgtactgttggctatagtctaaaccatgctctgctaaaataggtaaatcacttttagcagcattgtag

SEQ ID NO: 217 - DNA, 5638 bp; double-stranded, linear
cgttataataaacttgtgaaaaaattaacaaaggatatcgttccttgaaagctatggaggaaaatatggctgataaaaaaactgtgacaccagaggaaaagaaactcgttgctgaaaaacacgtagatgagttggttcaaaaagctctagttgcccttgaagaaatgcgtaaattggatcaagaacaagttgactacatcgttgccaaagcatcagtagcagctttggatgcccacggagaattggctttacatgcctttgaagaaacaggacgtggtgtatttgaagacaaagcaactaagaacttgtttgcctgtgaacacgtagtaaacaacatgcgccacactaagacagttggcgttatcgaagaagacgatgtaacaggattgactcttattgctgaaccagttggtgttgtttgtggtattactccaacaacaaacccaacatcaacagcaatcttcaaatcattgatttcattgaagacacgtaacccaatcgtctttgccttccatccatcagcacaagaatcatctgctcatgcagctcgtatcgtccgcgatgcagctatcgcagctggtgctcctgaaaactgtgtgcaatggattactcaaccatctatggaagcaacaagtgcccttatgaaccacgaaggtgttgcgacaatccttgcaacaggtggtaatgccatggttaaggcggcttattcatgtggtaaaccagctcttggggtaggtgccggaaacgttccagcttatgttgaaaaatcagcaaacattcgtcaagcagcacacgatatcgtcatgtctaaatcatttgataacggtatggtctgtgcatctgaacaagcagttatcattgataaagaaatttacgatgaatttgtagcagagttcaaatcttaccacacttactttgtaaacaaaaaagaaaaagctcttcttgaagagttctgcttcggcgtcaaagcaaacagcaaaaactgtgctggtgcaaaattgaacgctgacatcgttggtaaaccagcaacttggattgcagaacaagcaggatttacagttccagaaggaacaaacattcttgctgcagaatgtaaagaagttggcgaaaatgagccattgactcgtgaaaaattgtcaccagttattgcagttttgaaatctgaaagccgtgaagatggtattactaaggctcgtcaaatggttgaatttaacggtcttggacactcagcagctatccacacagctgacgaagaattgactaaagaatttggtaaagctgttaaagctattcgtgttatctgtaactcaccttctacttttggtggtatcggggacgtttacaatgccttcttgccatcattgacacttggatgtggttcttacggacgcaactcagttggggataacgttagtgccattaacctcttgaatatcaaaaaagtcggaagacggagaaataacatgcaatggatgaaacttccttcaaaaacatactttgaacgtgattcaattcaataccttcaaaaatgtcgtgacgttgaacgtgtcatgatcgttactgaccatgccatggtagagcttggtttccttgatcgtatcatcgaacaactggaccttcgtcgcaataaggttgtttaccaaatctttgcggatgtagaaccggatccagatatcacaactgtaaaccgtggtactgagattatgcgtgccttcaaaccagataccatcatcgcactcggtggtgggtctccaatggatgctgccaaagtaatgtggctcttctacgagcaaccagaagtggacttccgtgaccttgtccaaaaattcatggatatccgtaaacgtgccttcaagttcccattgcttggtaagaagactaaattcatcgcgattccaactacatctggtacaggatctgaagtaacaccatttgccgttatctctgataaagcaaacaaccgtaaatacccaatcgctgactactcattgacaccaactgtggcaatcgtagatcctgctttggtattgacagttccaggatttgttgctgctgatactggtatggacgtattgactcacgcgacagaagcatacgtatcacaaatggctagtgactacactgatggtttagcacttcaagccattaaattggtctttgaaaatctcgaaagctcagttaagaatgcagacttccactcacgtgagaaaatgcataacgcttcaacaatcgctggtatggcctttgccaatgccttcctaggtatttctcactcaatggcccataagattggtgcgcaattccacacaatccacggtcgtacaaatgctatcttgcttccatacgttatccgttacaacggtacacgtccagctaagacagcaacatggcctaagtacaactactaccgtgcagatgaaaaataccaagatatcgcacgcatgcttggacttccagcttctactccagaagaaggggttgaatcttacgcaaaagctgtctacgaactcggtgaacgtattgggatccaaatgaattttagagaccaaggaattgacgaaaaagaatggaaagaacattctcgtaaattagccttcctggcttatgaagaccaatgttcaccagctaacccacgtcttccaatggtagaccatatgcaagaaatcatcgaagatgcatactatggctacaaagaaagaccaggacgccgtaaataattgtttatcagtctagaagcaagacaaaaactcaatttgagggaaagatccagtaatttttctatgataaaaggcatcctatcaaggtttttgaacacctgataggatgcctttttatgatattgaggcctttttgccctttttgaaaaactagaatagaaacaaaatatataatagattgaaactagaatagtacatatctgcttctaaaacattgttagaattcgatttgactgtcctgatcgatttgtcctgttcttatttcattttgatatataaaaaatatagtatagtagactgaatctaaaatagtacgaaacaattgctaaaacatttatagaaattaattttacttttctgatagagttgttcacatcttatttcaattcactatagtttaatttaagagtagtatttactaaggcccaattaaaatcaaagagcaaactagaaaacgagtgccattcagctcaaaacactgatttgagattgcagataagactagccccctcattaacagatttacgataaaacgatgacaaggtgtgttgctttttgatttctaaagagtataatgatagatctctataaaataagtgcgaaggaaatgagcttttatagtcctttcgttttaaaatactatctcagatattcttatatcgacaagaagtttttgagtcattccctcatcatacatattaaataaatagtggctcattcaatttttcactagaataataagctagtatagtaaactgaaataagatataaacaaataaattggagcttaacatccatttccagcaattttttagaaactacagtggactattctagattcaacatattataaaaactagagtaaaagaaaaggattggatcttgtgtaatgcaggatccaatcctttcaatcattttgtccaacttttggaggttcctacaatgtagtcgtcattaataaagacagatgggaatgacagtgttcctatttattttgatagagatcgatgaattctttagatagcaactgaataatctctgttgaagccatttggtcttctgcatgcataaatagcaaggagaatcctattttttctccagtagcttctttttgtatgagattagagtgaatcttgtgcgcttctactaaggagtcttccgcttcttcaactttaattttcgcttcttttaaatttcctgccttagctagttggatggcttcaataaaggatgatttggctgctccactattggcaatgagctgaaaacagatatattccatttcttctgtcatcttatttctcctatccatgcaagtgcttgttccagaacttttgctccattcatcattccgtaatcccgcatatcaatggtatctacagggatatttcctgcaatttctttcacagcaagtaactcataacgaatttgtggcccaattagaatgacatctgcttcatggatattctttttagcttctgtcattgattttgcttggatagagatttcaatcccacgttcagtcgcactttgttgcatttttttaacaagcatacttgtcgacattcccgcattacatactaataaaatttgtttcataatcttaaccttccatttcttgttcaacaactttgtcattaactttgataaatggaatgtatagaagaactccaagtgcaaagatgatgaattgaactagaactgctctcacgtcccctgctgttgctaaccatgcatttaagaatactggtgtagtccaaggaacttgtataaatgcaggactcatgaattctgtaactgttgctaagtagctgattaaaataccaaggactggaactgtgataaatggaatagctaatgaaatgttataaacgattgggtaaccgaataatactggttcattgatattgaagataccaggtccaaaagataatttagccacgtttttagagacagcattgcgactcactaagaatgttgctattaataaacataatgtagatccactaccacccattaaagcgaatgtttgtatttgtgataggttgatgatgtgtggaatggcttgtccattatttgctgcagtgatgttttcagtaatgttaattaatagtaatggttctaggatggcactgtaaataactgcttggtgaataccaaatagccataacatatttcctaaagagtaaataataatgaccccgattaagcttgtaccaatatgacgaattggttcttgaataaagattgtaatgattgagattaagttcattccagttatattgaataataatgctgaaacaaccccaaataaggagatgacggtcatgactggaagtaatacgctaaatgatctactaacagctggtggaatattttcaccaaggttcatttgtaaagctttaacgtttgataattcaatgaataattctgttgcaataatcgtacgataaccccggcgaacattgcgcctgtacctgtgttgttgaatgaaagaacacctgaaatgtttaccgcatcttttgctccgtcaggaactacagaaactgtatttggcatcatcacaattaaagaaactaatgatagcattgatgctgctaacgggttttcgaaatctctgtttttagctaagaaataaccaaccattacagcaataatcatacctgaaatacttaaagtaccgtttgcaattgttattccccaatattggaatcttgttaatgtatccccttggaaaatccacttaaataccgtgttgttcaaaagaacgattaaacctgccaaaatatataatggcattactgttacgaatgcatctcttagggtttttaaatgaatttggttccctagtttaccagcaaaggatggcaaaaaaatttttttgggggggggggttattaaacccccctttttaaaaaaaa

SEQ ID NO: 218 - DNA, 4745 bp; double-stranded, linear
ccggaagctgttgcccttggaactccaaatgaagaaacagcctttgtcttgaactattttggtgtggaagcaccacgtgttatcacttctgccaaagcagagggggcagagcaagttatcttgactgaccacaatgaattccaacaatctgtatcagatatcgctgaagtagaagtttacggtgttgtagaccaccaccgtgtggctaactttgaaactgcaagcccactttacatgcgtttggagccagttggatcagcgtcttcaatcgtttaccgtatgttcaaagaacatggtgtagctgtgcctaaagagattgcaggtttgatgctttcaggtttgatttcagatacccttcttttgaaatcaccaacaacacacccaacagataaaatcattgctcctgaattggctgaattggctggtgtgaacttggaagaatatggtttggcaatgttgaaagctggtaccaacttggctagcaaatctgctgaagaattgattgatatcgatgctaagacttttgaactcaacggaaataatgtccgtgttgcccaagtgaacacagttgacatcgctgaagttttggaacgccaagcagaaattgaagctgcaatgcaagctgccaacgaatcaaacggctactctgactttgtcttgatgattacagatatcgtcaactcaaactcagaaatcttggctcttggtgccaatatggacaaggtcgaagcggctttcaacttcaaacttgaaaacaatcatgccttccttgctggtgccgtttcacgtaagaaacaagtggtacctcaattgactgaaagctttaatgcgtaagattttgggtgtcagctcaaaatcggaaagtctagtttgccttatatcgcaaggagtttcggctccttttttctaggagtgaagtatgttagaaaatggcgatttgatttttgtgagagatgggtcagacatgggacaggccatccagacttccacaggtaactatagccatgttgccatttatttggatgggatgatttatcatgctagtggacaggctggtgttgtctgtcaagaaccggcagacttctttgagtccaatcatttatacgacctctatgtttacccagaaatggatatccagtcggtgaaggaaagagcttgcaaacatcttggagcaccctacaatgcttctttctatccagatgcagctggtttttactgctcccagtatatagcagaaatcctacctatttttgaaactattcctatgaaatttggagwtggggagcaggagattagtgatttttggagggagtattacatagaactaggtctgcctgttcctctgaaccaagctggtaccaatcctagtcagttggcagcatcgcctctgttacaatgtaaagaaaggaatcttcatgattcagatttttaatccatctcgtttgacgagacagccatttttggagaattgatccgctatctggatcagtatgaggatgtgattctacgggaaattaaggctcaatttccagatgttgcagttgataaactcatggaagagtatataaaggcaggcttgattctacgtgaaaataagcgctattacctcaattttcctacgcttgaatcacttgatagtcttgaactggatcaagagatttttgtcagagaagctagtccggtctatcaagccttgttggagcagagttttgagacggaattgcgcaatcaaatcaatgcagctattttagttgaaaagacggactttgcgcgcattaaaatgaccctgtccaattatttttacaaggtcaaacagcagtatcctttgacagaaaaacagcaggagctctatgacattttaggagatgttaatcctgagtatgccctcaagtatatgacggcttttttgttgaaatttctcaaaaaagaccagcttatgcagaaatgccgtgatatctttgtggacagttaggttgtcttaggctatattgtgcaaaatgaagatggaaagtatgagttggctatcgattttgataaggagaggttaactttctacttagcgtgatttcttgtttctgagtacattgtttgactttccttagtattcggtataaactatatgtaaccggtaacacatatcggaataaactaaaggagacaatcatatgtcacttgaaaacaaattggaacaagcaacaggcgctgtcaaagaaggttttggtaaagttactggagacagcaagacagaacttgaaggagctgttgaaaaaacagttgctaaggcaaaagacgttgtagaagacgcaaaaggtgctgtagaaggtgccgttgaaggtttgaaaaacgtttttactaaagaataggaaaaaatcaagggtttcattttcccttgattttttctattcttataaataattttctgcgacggctgtatctcctgggtaggattctttcttgccctggatgatttggtaacaatcggctcccttacccgcaataataactgcatctaattcgtgatttgtgatagccattgccgccttgatggcttcttggcgatccgcaatcttttcaacaggatgattgatgtagctactaatttcatctgcaatggccattgggtcttcatagttagggtcatcagcagtcagaaagacttgaatctcagggtgttgattgaggaggaggccaaagtccttacgacgactttctcccttgtttcctgttgatcccagaaccagagcaatctttccggtttgatgagtttcaaccacattgatgagttttttcagactatccccattgtgggcatagtcgatgaagaccttggctccatttttctgagtgaggacttccatacgaccaggaacgcgggttgcagcgatgccttttttgatgtcctcaagacttgctccgagacggagacaagcaagtccagcagcaactgcattttcttggttgaagttgccaatgagttgaatatcataatctccagcgagtttacccgtagctgaaaagctaaaggctttggaattctcgatttggttatcaaattggctaccatagaaatcatggtcttgatcttcaacctgttctttcaagactgagaagtggtccatgtcactgttaatgatgactgctcggctcttttccatcaagagacgcttgtggtagaaatagtcttcaaagctagggtgttcaatcgggccgatatggtctgggctgatatttaggaaaactcccacatcaaaggttagaccatagacacgtttgaccagataggcttgactggagacttccatgatgaggtgggtacggtcattttgcacagcctgattcatcatgtcaaagaggtcaatactctcaggggttgtcaacgctgacttaaagaaagtctcgccatcaagagttgtgttcatggtcgacaacatagcaggtctatgcccttgagataagatgttataggcgaaataggctgctgttgtcttacccttagtaccagtaaaggcaaggagtttgagtttttcctgtggattaccatagaactccatggcaatcaaactcatggctttctttatatcgttcacaatgatgacagggataccgacttcgtagtccttttcagctacataccaagctaatccttgtgttatagcagaaagaaggtattcttttttaaaggcagcgccttttgcgaaaaaaagagtgtcttctgttacttttcggctgtcgtagctgatgctatcaaaaataactttgctgtagttgtagtggtaatgaccttggtcaataatttcgcgaaaaaggccatctttctttaaaatatctaatacggtttcaatcttaatcatactttctattgtaaaccgaaagtcgtaaatttacaagtaacaaggaaaagtttataatggaagataaggagtttttcctagttatcaaaattgaatgaggaatctatgtcgcacgaaaacaatcaccagcaggcccagatgttacgggggactgcttggctaacggctagtaactttatcagtcgcctactcggggctgtttacattatcccttggtacatctggatgggggcttatgcagctaaggcaaatggtctctttaccatgggttacaatatctatgcttggttcttgttggtttcaacagcggggattccagttgcggtggccaagcaagttgccaagtataataccatgcgagaagaagagcatagctttgccctgattcggagcttcttaggctttatgacaggactaggcctggtttttgctttagtcttgtatgtctttgctccttggctagcagacttgtctggcgtgggcaaagacttgatcccaatcatgcaaagcttggcttggggagtcttgattttcccgtctatgagtgttatccgaggatttttccaagggatgaataacctcaaaccctatgccatgagccaaattgctgagcaggtcattcgtgttatctggatgctcctagcaacctttatcattatgaagctcggttcaggagattatctagcagccgttacccaatcaacctttgctgcctttgtcggtatggtagccagttttgcagtcttgatttatttccttgcccaagaaggttcactcaaaagaatctttgaaacaggagataagattaacagtaagcgtctcttggttgataccattaaggaagccattccttttatcctgacagggtctgccatccagctcttccagattttg

SEQ ID NO: 219 - DNA, 1900 bp; double-stranded, linear
cctgattgaccttataataaggaacaaaacacaatgcactaccttttcaacaaaagagttgctgcttgattaaaaccatcacaccagttataccattttgcttcatacccatcttgagctaggatacgatcttctaaatcaaaaacagagtaaatctttctttcctcgcaagcttgcgcatagagatgatatagttcatcaccaccatctctatcccactcagcagaaatcgtatcccgacctgccaataaagcctgataagccctgtgatgcccatctgtaatcagcaaacaatctccaaaggcaagaatactgattggatcgacttggattgtttctgccgactggtaaagcatctgaatatcttgcaacttcttttctgataaatatagttgagtcagatgaagatctgctatattgactttcatttctttctcctcaagggaattcgatactcacttctgtttgcctttaaatcgccattggaagcggagcttgtcataaaagggaaactcgataaacaggactcccaagcccacacagagactggcaaggacgtctgatgggtaatgaactcccagatagactcttgataccagcacactgactaggtagaggccaaggacgatttgtacgatttttctccagacctgatctttaatccgctgactaagaataacaatcaaagtccctaccatcagcgttacagctagagaatgcccacttgggaaggaaaatcccttctcctccaccagatgtaaaatagctggtcgtgggcgctggtagatatttttaaaggtcacgattaaaagacctgccaaagccagatttcccagcatgaagaaactttctatcttccatcgcttacgataaaagacaaaagctgtaatgacaacccaagtgataatcactgggatatcaatcagacgtgtgagggctcgaaaaagaatagtcaaataatctggtaagtctcctcgaatggcagtctgaatcgattggtcaaaattgaccaacatttcagggtaaaatttgaccatgtagccaagaataacgaaaagtaaaagggcaaaactgcccttcattaaaaatgtttgtttatctctcataatgttttaaggttggtttcaagagaacatacaacaaccagaatgaaacggaaaagataacaccttcaatcaagttaaaaggtaataccatggtcattaggtagttggaaagtcccaaaatttttccaatatcaaagttagcaaacttagcgtacaaaggaacagcataaacatagttgagaaccaacatggccaaggttaaaccaatagttccagctagagagcctagtaggaaacgaagggttgtccgttcctttttccaaatcaaagcaaatacgatgacaaaaactcccaaagctacgatattcatcggcaaaccaatgtaagtattcactccttggctgttaagaagcaatttcaagagtgagcgaagcaagagcactcctagagmcscaggcaaatccatgaccaccagacccacaaggactggcaagatactaaattcgatcttgaggaaagatgccgctggtaaaagcggaaagtcaaagtacatcagcacaaatgagatggctgatagaattgcaatggtcgaaagtcgacgtgtgtttgtcataacaggttcctccaattttctataaaatcagaagaagttggaaaggattcctctatctattctcactttttatatcccaaaagttccctcttactctattaaagaaaaacaaagcaagtggttacaatccggctataaatctatcaaaacagacaaggctattctttcgtcttctcccatccagactatactgtcggttgtggaatctcaccacatcacgttgcgctcacggacttcttta

SEQ ID NO: 220 - DNA, 4692 bp; double-stranded, linear
ggttttccagcaggagcttctcctttatcagaatgaccatcccatctgctcacgatagatgaataatgatattttttaccatgatagtaatttgaaaaagcctaaccacctcctgaaccttctccatatgtccatactcctccatctggatattatacagcagctgatgcagctcccaataatgtaaaacttgaaataagagctagagcaagtaatctatgttttttcgttttcattttattttttctttcaaaaaaagcacaccttgagcaacaatgcaacaaaataaatcctcctctctcttttattgaaaccgctttcttatgtgataagaataacttttttattatttgttgtcaaggaaaaaatcgaattttttagatattttactatattacctctgtgaataatattatatagtagttttatttcaaaataatatgcaaccagtactaaccaaatataaaatagatgccattaacgaattttattcaagtttttcccattcatactatacaagtaaaagagatggtgttaactaaaaagcaattcaaactattgtaaaattcctagcaaaaagagagccgaaactctcttttttatcttcttttactttttttgactggcatgagtgtgatgtctctaacactaaagtaagctaggatcaacatggctattgctaggaatatttctgttggtaattgaaaaattttcagaaaagatagaaccaataaaatcaagagtgccactaaaatacataccatagcgacgatattgacagtccctttaatgctttctggtgtcgcaaatacatagagtaggagcagtaaaattcctaggactaaatagaccatctttctctctttctagctcttattcagctgattttttcttcttgttagctttctcacgctctgctttgttaaggatttgtttacgcaaacggatagactcaggcgttacttccatgtactcatcgtcgttcaagaactcaagagactcttcaagtgtcaagatacgaggcgtcttgataacagctgtttggtccttagtagctgaacgaacgttggtcatttgttttgccttcgtgatgttaactgtcaagtcattttcacgagagttttcaccgatgatcattccttcataaacctcagtacctgggttgacaaagatcgtaccacgttcttcgatagacatgattgagtaagttgtagccttaccagcatcgatagaaacaagggcaccacggtgacgtccaccaatttcccctggaatcaatggcaagtattggtcgaaggtatggttcatgataccgtaaccacgagtcattgataagaactcagttgagtatccaatcaaaccacgcgctggaacaaggaagaccaaacgagtttgaccattaccagttgaaatcatatccaacatttcacctttacgttcagaaaggctttggataacagacccttggtattcttctggagtgtcgatttgtacacgttcaaatggttcacatttaataccgtcgatttcttttacgataacttctggacgagatacttgaagttcatagccctcacgacgcattgtttcgataaggattgacaagtgcaattctccacgtcctgaaacagtccatttatctggtgaatcagttgggtcaacacgaagggaaacgtctgtttgcaattctgcctgcaagcgttcttccaccttacgagaagttacccatttaccttctttaccagcaaatggtgagttgttgaccaagaaagtcatttgaagagttggctcatcgatgtgtaggattggaagagcttctactgcatctgtcggagtgatggtttcaccgacaaagatgtcttccatacctgaaacggcaatcaagtcacccgctttggcttcttggatttcacgacgttccaaaccaaagaaaccgaagagttttgtaacacggaagtttttagttgtaccgtcaagtttagaaagggtaacttggtccccaaccttaactgtaccacggaagacacgaccgataccgatacgtccaacgaagtcattgtagtccaaaagtgacacttggaactgcaaaggctcatctgagttatctactggagctgggatatggtcgataatcgtgtcaaagattggtgccatagtcgcttcttggtcagctggatcatctgacaatgaagaagttccgttgatcgctgaagcataaaccactgggaaatcaagctggtcgtcatctgcaccaagctcgatgaaaagttccaagacttcatccactacttctgctggacgagctgatggcttatcgattttgttaacaaccacgattgggacaaggtcttgttccaaggcttttttcaatacgaaacgagtttgtggcatggttccttcataggcatctacgaccaagacaacaccgtcaaccattttcatgatacgctcaacttctccaccaaagtccgcgtgtcctggtgtgtccataatgttgatacgagttccgttgtaagcaacggcagtatttttagcaaggatggtaattccacgctctttttcgatatcgtttgagtccatagcacgctctgccaattcagtccgtgcatcaagcgtttctgattgtttcaataattcgtcaaccagggttgttttaccgtggtcaacgtgggcgataatcgcaatgttacggatatcttctcttaattttgtcatgatttcctctataatattcaaaatttattttctaactgaacgattataccataatttcaaataaataacataactcaagcaagtgtaaatgttttcactctgcttttcttttcacgtcaagccttttcaaagcgagcgacttatgataagataggcacagtatgcgtttagataatttattagctcaagaaaaaatcagccgaaaggccatgaagcaagcactcctcagaggggaaattctagtcgatggttgcccagcccgctccctagctcaaaatatcgatacaggactacaagaactcctttttcaggatcgaatcattcaaggctatgaacacacctatcttatgcttcataaacctgctggtgccgttacagccaacaaagacaaggaacttccgaccgtcatggacctgcttccatctaacatccagtctgacaagctctatgccgttggccgactggaccgagatacaacgggactcctcctcttgaccgataacggtcccttgggctttcagctcctccatccccaatatcatgtcgataagacttaccaagttgaggttaatggacttctaacacctgaccatatccaaacctttcaaaaaggaattgtctttttagatgacactgtctgtaaacccgcaaaactagagattctatctgcaagtcsctccctcagtcaagcctctatcaccatttcagaaggaaaatttcatcaaatcaagaaaatgttcctctcggttggtgttaaggtgactagcctcaaaagaatccaatttggggacttcacattgaacccagatttagcagaaggtaactaccgccctttgaaccaaaaagagttacaaatcattaaaaactatttagagatgagtcgataaaacaaaaaaagctttaaaactaaagcttttttcttttatttaccgaaaaattaaggcgattgctacaatccagttaactacagaaatcacaattcctaagatattaagaatcttttctattttatagtctaattgtgactctttttggtatgaaatagccaagaccaatcctatgatacccaaaatcaggcctacaattggaaataacaaaccaagaataatcgacaagatacccacaaaaagtggatttttcttcttttcttttatgttctaagaactccttaaattttatacaaattaattatactataaaacaatagcttcatcctatcattcgactaatttggaaataaggttagctagtcttcactttccctttccaagaatccaagccataagaaaggatataaatctcagaaaaaccttgttttttcaagtaaagagctgcatttgtaactcgttgcgcacgttggttttcgtagagaaggacaggtttatctttacgaagggctgcaagactagttttcaactgacttgaaggaatattgcgtgcaccaaggatatgttttctgtggaattctgctgggtcgcgcaaatcaatcaattgacccgtacgaatcaaggcttcaaactcctcattgtccacaattttagccgcacggcgaatacgaagatagttaaagcccatccacgccaacattgctagtataagtgcccacaaaatccaagtaaccattagttcttttctccatttttctcaatataatccaattctaccttgtgctctctgcgaagaactgcttctgcctctagatagtctaatttatccatcaaccctgcatcgtaaatccgagatagttccaacttcatcagttcaatatcatataagcgttttcccatgtaaacaataataccaaatcgtttgaggaattgctgcacatcatagaatgttttcataagactcattctagcaaaattttgtgtttttttcaagaagagactcacacaatgctccttattttcctatcttctttagcgattctaaggcaagtatggtacaataaaaacatggggattcaacaattacatt

SEQ ID NO: 221 - DNA, 706 bp; double-stranded, linear
gctaaaaagctgataatcttcgactcctgtatatgatgtgtcttttcatgtaagacacgcgccgccagaatcatggcaagagctgcaagactggcaagtaagaagccgataagataggcaaaaagataagtgaatttgacaaagaaagtcaaaagaactaggaaaccaaagcctcctccaaaaactaccaaagtctttcgtaaatcccagattttatccaactgcttgacgagggaagtcgtctgacgaacgcctacaatagttgctaacatacttcctaaaaagaatggatagacatgagttaaactggagaaataaacagaggaataagaggtcactagaaaactaccaataaacatggagaagaaactgatcaagaaggcaacagcagataagagaaagaccatccccttcaactgaccatttgatttagcttgtttggataagaaccaaactgccaatccccaaagaatatagtagtgaacctcaactgccaaactccaattatgaacaaacaaatgaggaatgaactgagattcataactcccacctgttaggagttcatagaagttggtcataaagcctaagacgcccgcaatctggccaccaattccagcaacatagtcttggcgaaccaagaaagtaaaaggcatggtcaccaagaccatcaaaaccacaggtggcacaatctcgataaaagcgtctt

SEQ ID NO: 222 - DNA, 3236 bp; double-stranded, linear
cagctgatgggcaatatcagtcatagaaattttttcaattaacttttgagcaattttttggttgatgatacgagggatttggtgatttttctttaccaggggagtctcagcaaccatcatttttgaacagtgatagcacttgaaacggcgttttctaaggagaattctagaaggcataccagttgtttcgaggtaagggatcttagacggtttttgaaagtcatatttcttcattagacttccacaatcagggcaagatggagcctcataatccagcttagcgataatttctttgtgggtatccatattgatgatatctagaatcttgatgtttgggtctttaatatcgagcagttttgtgataaaatgtaattgttccatatgattctttctaatgagttgttttgtcgcttttcattataggtcatatgggactttttttctacacaaaaataagctccataatatccataggggatttacccactacaaatattatagagcccgaaaatatgggaaaactgatccttgtttctgcttttgtctatagaagaataataaagattatcttcttcaaattctccgatattctctaaagttttgtgcaagttgcacagaacttgtttatttttttggtcatcttgccatagaaatataaagcgttttcatatataatataattatcaaaagacaaaaggagttcacctcatggtagaattgaatcttaaaaatatttacaaaaaatatccaaacagcgaacactattcagttgaagatttcaacttgaacatcaaagataaagaatttatcgttttcgtaggaccttcaggatgtggtaaatcaactacactccgtatgattgctggtcttgaagacattacagaaggtactgcatctatcgatggcgtagttgtcaacgacgtagctccaaaagaccgtgatatcgccatggtattccaaaactacgctctttacccacacatgactgtttatgacaacatggctttcggtttgaaattgcgtaaatacagcaaagaagacattaacaaacgtgttcaagaagcagctgaaatacttggattgaaagaattcttggaacgtaaaccagctgacctttcaggtggtcaacgtcaacgtgttgccatggggcgtgcgattgtccgtgatgcgaaagtattcttgatggacgaacctttgtcaaacttggatgccaaacttcgtgtatcaatgcgtgctgaaatcgctaaaattcaccgtcgtatcggagctacaactatctatgtaactcacgaccaaacagaagcgatgacacttgcagaccgtatcgttattatgtcagctactaagaaccctgctggtacaggtactatcggacgtgtagaacaaatcggtactcctcaagaagtttacaaaaatccagttaacaaattcgttgcaggattcatcggaagcccagctatgaacttcatcaccgtgaaattggttggtagcgaaattgtttctgacggtttccgtttgaaagtgccagaaggagcattgaaagttcttcgtgaaaaaggctacgaaggaaaagaattgatctttggtatccgtccagaagacgtgaatgcagaacctgctttccttgaaacattcccagactgtgttgtaaaagcgactatctctgtatcagaactgcttggttcagaatctcacctttactgtcaagttggtaaagacgagtttgttgcaaaagttgatgctcgtgactacttgcaaacaggtgcaacagttgagcttggatttgacttgaacaaagcacacttcttcgatgtagaaactgaaaaaacaatctactaaaataaataaaattcaaagcactacaagaaaagatatctctttatcaattgtagtggagagatatcagttaatctagggagagaaacaaaatgcttctctcctttttgctagagaagtcatattatgcatctatattgtgatgctctttaatactcttcgaaaatctcttcaaaccacgtcaacgtcgccttgccgtacgtatgattactgatttcgtcagttttatctgcaacctcaaagatgtactttgagcagcttacggctagtttcctagtttgctctttgatttccattgagtattatttgtgggtaccatctacaagtgaagctatatgcgtaaactacgtgagcaattgaattcgaactagagaggtaataataaatttatgctatagttatggtgacttgtatgcttttgattctagtttatcaaataatagattagaattgtcagataatatcattttgtgttataatgaagaaaaaacagaggtgttcaaatgtcagaagcaggtcataagtttttagcaaaattggggaaaaaacgcttacgtccaggtggaaagcgtgccacagattggttaattgcagaaggaggattttcaaaagaaaagagaatactagaggttgcgtgtaataggggaactacagcaattgagttggcacagcgttttggttgcaagataactgctgttgatatggatgctcaagctttagaagtggctaaaaaatctgctggaacggcaggtgttgctcatttaatcagttttgaaagagcaaatgcaatgaaacttccttatcaagatgctagttttgatattgttataaatgaagctatgctgactatgcaagccgatcaagctaagaaaaaatgtgtaatggaatatctaagggtattaaaacctggaggtcttctcttgacacatgatgtgcttcttaaggaagctaaagagtctatcagacaggaattatcacaagcaattcatgtaaatgtaggtcctttaactcaagatggttgggaacaggtgatgatagaatcaggttattgtgatgtgaaagcattgactggtgaaatgacattaatgaaattatcgggtatgatttatgacgaaggtttgctaggaactttgaaaatttgtgtaaatgcttgtaaaaaggagaatagaaagcagtttttaactatgtataaaatgtttgctaagaataaacagaaattgggctttattgcgatggctagttataaatcgtcaaaacgttagataattattgaagttaacttttccttttttctttcttaaaaaatatgctataatagagagtaaaaaactttgaaagaaagaaaaagatgaatttaaaagattacattgcaacaattgaaaattatccaaagggtaccg

SEQ ID NO: 223 - DNA, 2885 bp; double-stranded, linear
cctgacttttcaaattggttagtttgccacacttggtttatatggtcgtggaaagcatggctattacttctcaaagggcgatttctcaccccatgaaaagtgtctatttttgtttaggtttgtaagttaattcattgtcacatattactctttaactgattgagtgagtaccgcttatatttgatgccaaacgccttaaaagtgttaccctcaagtccttttagaatacggctataattccgctcattgtaaactatcttaagctcatcactatctaggttggtattaaaaatggtattttcacgattgtttagcacgtcaaagagtaaatcctgctcccagtcactcttaggcttaataacagcattttttgctcctaaatcatcaataattaagtaatcaacagacttcatgagttcagtagcttcaaactctgtaagtgttgcacctttaccataattccacccctctttaatttgtttgatcatttcggttaggcttacaaaaagcacactcttaggttctccttttgtcttatacccctcatttatacctttggcaatagcaactgataaaagtgtttttccaatccctgtacctcctgtgataagcgtatttcccctcatgccatcaagatatttttgtacctgaccttttgcaaattctaaaaatcgcttttcttctgatgttacagcattaaaatcatcaaaagttttagttttaaactcatctgctacatagctcttattgctcatcaacacattataagtttgcatatatagtttagcattcaaattatcagcaatcgcatcttcttcatcttgctttttctgttcttcttggcattgttcacaatagggtgggatacagcgaacttcttttattgcctctccgttctcattccaccccactactacatgtctttctcctttgatttgtgttagctgtatttcatgcttaggacacaattcgtctagtttaaatgtctcaatatttcctaaactagattgtaatgatttcattttctgacctcctaaaatggtttttcttgtgttggtatccaatcttcatagctggtaggctctagttgattggtttgctgttttttagcctcacgcgctgccctgctatttctaacaagttccaccgtcaataaattgtcctgtttccaacggttaaggattaccttgatgtatgcaaagtttgctttaccctgactgacagcctcttttaacgcctcatggataagctctgggctaaaatcttctagcatatactgcaattcttgaatctgtaacggtgacaatgctttacctgtctcagctcgcttcatattcaacaagtcgtctatttccacactggttacttttttatttacaaaatcagaaatcagttgaaaaatgtttggactttgtagctggatttcagccattacctcatcaaattctgcttgtgtcatgttgtctaaatctagtgtcattgcattgcctcctcaaacttctctataagacaacttttatttgctttctgagttccatttttagagttaaaaagaatatcttttaaggttacagtagcctctaaatactccttttcagcatgctctatatacgcctgttgctctgcttcgttctcaaaaaagtgcttagcttggcgtttaaagaatgcttttcgcatagcgtccatttcaaaaataccaggggcgaaaaacattcccgtagtgcttttagagaccgcttcgattttatggctttcattcaattcaggaagttcaatccaaagtaaacgggacaactcatctttgatggattttgtctgactttccaataaagaaaggattcttaggccattttcttcgctaatttctcgcatttctgcgctaattctgtctatacgtctagttaaattctcatatgttgtttctgtcatgtttttacctctgtttctttgttggtgtgattttttagcttatttttttacttctaaacatcattgtcttaatttcctgataactcattttcaattcaatcatagctattgccatatcctcaaatgcctggtactgctccaactcctcactagtcaagctatcgataccgttatagcccccacgctcttctcttaactgcttagcgttcatgtctgttactgcctttagtagcaagttgttcatggtgctatgcgcgtgctttggtgcattaggccatgtttctatactgtcatgcaaggtttttcttttcggtttttctagcgccctctgcagacgaatttcagaaagttcctcacgcatttcaaagaatgctttgactaggtttagtttgaattgccgtactgtttcggtattctttaaataagtgatcagaaaagtagcctgttgctcgttcagaatataggattttttaggttgtcctctagtatctaatttatggattttaaatccaagtattcccaactcttcaaagtcagccttattttctcttattaagcgcgtgatagtgtggtgttgtacttcagcacattcagcgatgatctcgcttgtggtgtacggctctttcttaccgtccatgtaaactagttccattacggttctacctcctgtataaatctggttagcttactttttaattgcctcctctagcctcttttttagcctctaaaacggctttggctagtggttaatattatttaccacttgtctctataaacgtgttagaggcctttataacgacttgtatcgctgtatcgatatcctccgtggaatagtagatttattttctaatatcattcaagacttgtttaacccatttcttgaaagaaataaaattacatcttctttatccttggcatctgctttgtctgagacaaattagaatgtcaatacttgg

SEQ ID NO: 224 - DNA, 3144 bp; double-stranded, linear
tatcaatcctttcccattataggagcaacagagtgggagtagtcatctaaggactaatttatgtatttttacgagtcagtatcttgggatactggtttttacttttctagactttttgactacttgttaaaactgggataattttcgactgtttaacagttattatgcaaagtctaaaagattagaattgtcaaaacaatccgtctaggcttgattttatcctttatttactataaaatgagaaggaaaaatgtcaaacttttatattgcaaataggagaaatcatgacaaaaacattaaaacgtcctgaggttttatcacctgcagggactttagagaagctaaaggtagctgttcagtatggagcagatgctgtctttatcggtggtcaggcctatggtcttcgtagccgtgcgggaaactttactttcgaacagatggaagaaggcgtgcagtttgcggccaagtatggtgccaaggtctatgtagcggctaatatggttatgcacgaaggaaatgaagctggtgctggtgagtggttccgtaaactgcgtgatatcgggattgcagcagttatcgtatctgacccagccttgattatgattgcagtgactgaagcaccaggccttgaaatccacctttctacccaagccagtgccactaactatgaaacccttgagttctggaaagagctaggcttgactcgtgtcgttttagcgcgtgaggtttcaatggaagaattagctgagatccgcaaacgtacagatgttgaaattgaagcctttgtccatggagctatgtgtatttcatactctggacgttgtactctttcaaaccacatgagtatgcgtgatgccaaccgtggtggatgttctcagtcatgccgttggaaatacgacctttacgatatgccatttgggaaagaacgtaagagtttgcagggtgagattccagaagaattttcaatgtcagccgttgayatgtctatgattgaccacattccagatatgattgaaaatggtgtggacagtctaaaaatcgaaggacgtatgragtctattcactaygtatcaacagtaaccaactgctacaaggcggctgtggatgcctatcttgaaagtcctgaaaagtttgaagctatcaaacaagacttggtggacgagatgtggaaggttgcccaacgtgaactggctacaggattttactatggtacaccatctgaaaatgagcagttgtttggtgctcgtcgtaaaatccctgagtacaagtttgtcgctgaagtggtttcttatgatgatgcggcacaaacagcaactattcgtcaacgaaacgtcattaacgaaggggaccaagttgagttttatggtccaggtttccgtcattttgaaacctatattgaagatttgcatgatgctaaaggcaataaaatcgaccgcgctccaaatccaatggaactattgactattaaagtcccacaacctgttcaatcaggagacatggttcgagctcttaaagaggggcttatcaatctttataaggaagatggaaccagcgtcacagttcgtgcttaatgtagttgtttagttttaaaaaactatgcaaagctccatatacaacacttaaacgagattaaagaatggcgaaatcccttgatgcgcaagagattagctgtcttttttattttttaagtgataaagtcggagtttaggcatcaaagcctatcaaattaaacaaagaagcgatgtcttagatattttgaaaaaaattaataagcagaaaactctctattattttgttgtagagagttttttgttaataaaatttcacaaaatgacatttatatattgcattaagttagatatatgatataatattgttaaaaagaggcgcaactttttaaaattaatgagaatcaaagagaaaaccaataatattaatggaggaataaaaaatgtaagtaagcattatggtcattcaatcattctcaaagatataaattttgcacttaacaagggtgaaattgttggtctagcagggagaaatggagttggtaagagtacgttgatgaaaattcttgttcagaataatcaaccgacttcaggtaatattataagcagtgataatgttgggtatttaatcgaagaaccaaaattatttttatctaaaacaggtttagagaatttaaaatatttgtcaaatttatatggtgttgactacaatcaagaaagatttagatgtttgatccaagagttagatttgactcagtctattaataaaaaagtaaagacctattctttgggtacaaaacaaaaattagctttgcttctaactctcgttacggaacctgatatattgattttagatgaaccgactaatggtttagatattgaatcatcacaaatagttttagcggttctaaaaaaattagctttacatgaaaatgtgggaattttaatatcgagtcataaattagaagacattgaagaaatttgtgagagagttcttttcttggagaacgggcttttgacatttcaaaaagtaggaaaagatagtcataatttcttgtttgagatagctttttcatcagctacagatagagacattttcattaccaaacaagaattttgggatattgtttaggaagagggattgagaattactatgtctgggaatattcaaaatagtgagctttttaaattttttaacgaaaactctattaaagtagttgattttgaaactaaaaaagagacgcttaaagatatttacctaaatcgttcaaaataaaggaaggttataatcatgaaattaaataaacagaagaatcggatgatttacgtcttgtctaattttctatatgctatctcagtttccattatttatgctttgaatggcattgtgttactagtcatagtaagtaaattgggtattccaggtgatttaggattaaattttatagtagctattgtagtcaatacaattttgttagtcctgttttattttctattatcttacattttctatttatacaaattgaaaagtggcttggtatwtggtattttagtagctttactactctttatctctaatatattaaatacgatgatgatgaatactagtaatgatttgtttatcaaagcaattgaa

SEQ ID NO: 225 - DNA, 3766 bp; double-stranded, linear
tacggtattatttttaaggagaaagaatcatgaaaatcaaaaaatggcttggtctagcagcccttgctacagtcgcaggtttggctcttgcagcttgcggaaactcagaaaagaaagcagacaatgcaacaactatcaaaatcgcaactgttaaccgtagcggttctgaagaaaaacgttgggacaaaatccaagaattggttaaaaaagacggaattaccttggaatttacagagttcacagactactcacaaccaaacaaagcaactgctgatggcgaagtagatttgaacgctttccaacactataacttcttgaacaactggaacaaagaaaacggaaaagaccttgtagcgattgcagatacttacatctctccaatccgcctttactcaggtttgaatggaagtgccaacaagtacactaaagtagaagacatcccagcaaacggagaaatcgctgtaccgaatgacgctacaaacgaaagccgtgcgctttatttgcttcaatcagctggcttgattaaattggatgtttctggaactgctcttgcaacagttgccaacatcaaagaaaatccaaagaacttgaaaatcactgaattggacgctagccaaacagctcgttcattgtcatcagttgacgctgccgttgtaaacaataccttcgttacagaagcaaaattggactacaagaaatcacttttcaaagaacaagctgatgaaaactcaaaacaatggtacaacatcattgttgcaaaaaaagattgggaaacatcacctaaggctgatgctatcaagaaagtaatcgcagcttaccacacagatgacgtgaaaaaagttatcgaagaatcatcagatggtttggatcaaccagtttggtaataagaaacagggaggtgggagagaaaattccacctcttgcttttgtatagagtatagattgtaaagaagactattcgttcatagaaaggtagagagaatatggtttttcctagcgaacaagaacagattgaaaaatttgaaaaggatcatgtagcccagcattattttgaggttttgcgtaccttgatttctaagaaatcagtctttgcccagcaggttggactcaaggaagtcgcaaattatctgggtgagattttcaagcgtgttggagctgaagtggagattgatgagagctatacagcgccctttgtcatggcacatttcaagagttcgcgtccagatgccaagaccttgattttctataaccactatgacactgtgccagcggatggggatcaggtctggacagaggatccktttacgctttcggtccgcaatggcttcatgtatgggcgtggggttgatgacgacaagggtcatatcacagctcgcttgagtgctttgagaaaatatatgcagcaccatgatgatttacctgtcaatatcagctttatcatggagggagcggaggaatcggcttcaacagacctagataagtatttggaaaagcatgcagacaaactccgtggggcggatttgttggtctgggaacaagggaccaaaaatgccttggaacagctggaaatttctggtggcaataaggggattgtgacctttgatgccaaggtaaaaagcgctgatgtggatatccactcgagttatggtggtgttgtggaatcagctccttggtatctcctccaagccttacagtctcttcgtgctgcggatggccgtatcttggttgaaggcttgtacgaagaagtacaagagcccaatgaacgagaaatggccttgctagaaacttatggtcaacgaaacccagaggaagttagtcggatttatggattggagttgcctctcttacaggaggagcggatggcctttctaaaacgtttctttttcgatccagcgcttaatatcgaaggaatccagtctggttatcaaggtcagggtgttaagactattttacctgcagaagccagtgccaagctagaggttcgtctggttccgggcctagaaccgcatgatgttctggaaaaaattcggaaacagctagacaaaaatggctttgataaggtagaattatactataccttgggagagatgagctatcgaagcgatatgagcgcaccagccattctcaatgtgatcgagttggccaagaaattctatccacagggcgtttcagtcttgccgacgacagcggggacaggacctatgcatacggtctttgatgccctagaggtaccaatggttgcattcggtctaggaaatgccaatagccgagaccacggtggagatgaaaatgtgcgaatcgctgattattacacccatatcgaattagtagaggagctgattagaagctatgagtagagatattatcaagttagatcagatcgatgtgacttttcaccaaaagaagagaaccatcacagcggttaaggatgtgaccattcacatccaagaaggggatatctacggaatcgttggatattctggagcaggaaaatcaacccttgtacgggtgattaatctcttgcaaaaaccatctgcagggaaaattaccattgacgacgatgtgatttttgacggcaaggtgaccttgacggcagagcagttgcgtcgtaaacgtcaagatatcggaatgattttccagcattttaacctgatgagccaaaagacagcagaggagaatgtagcctttgcccttaaacactctgaactcagcaaggaagaaaagaaggctaaagtagctaagttgttggacttggttggtttggcagatcgtgctgaaaactacccttcacaactatctggagggcaaaaacagcgtgtggcaattgcgcgtgccttggccaatgatccaaaaatcttgatttcagacgagtcaacttctgcccttgatccgaagacaaccaagcagattttggccttgttgcaagatttgaaccaaaaattaggcttgactgttgtcttgattacgcatgaaatgcagattgtcaaagacattgccaaccgtgttgcagttatgcaggatgggcatttgattgaagagggtagtgtgcttgaaatcttctcaaaccctaaacaacctttgactcaagactttatctcaacagctacaggtattgacgaagccatggtcaaaatcgagaagcaagaaatcgtggaacacttgtctgaaaacagtctcttggtgcaactcaagtacgctggagcttcaacagacgagccacttttgaatgaattgtacaagcattaccaagtaatggctaatattctctatgggaatatcgaaattctcgatggtactcctgttggagaattggtggtggttttgtcaggtgaaaaagcagcgttggcaggtgcccaagaagccattcgtcaagcaggtgtacaactaaaagtattgaagggagtacagtaagatggaatcattgattcaaacctatttaccaaatgtctataagatgggttgggctggtcaggcaggctggggaacggctatctacttaactctttatatgacagttctttccttcattatcggaggcttcttggggctagtggcaggtctctttctcgtcttgacagcgccaggtggtgtcttggagaataaagtcgtattctggattttagacaaaattacctcaatttttcgtgcggttccctttatcatcctcttggcaatcttgtcaccactttctcacttgattgttaaaacaagtatcgggccaaatgcagcccttgtcccactttcttttgcagtctttgccttctgg

SEQ ID NO: 226 - DNA, 2520 bp; double-stranded, linear
tgttgctgagttaatcggtacgttcatgtttgtattcgtcgggacaggagctgttgtttttggaaatggtcttgatggccttggtcaccttggaatcgcctttgcctttggtttggcaatcgtggtggcagcctactcaatcggaactgtttcaggtgctcacttgaacccggctgtttcgattgctatgtttgtaaacaaacgtttgtcatcttcagaacttgtaaactacatccttggtcaggttgttggagctttcatcgcttctggcgctgtcttcttcctcttggctaactcaggtatgtcaactgctagtcttggtgaaaatgccttggcaaacggtgtcactgtctttggtggtttcttgtttgaagtcatcgcaactttcttgtttgtattggttatcatgactgtgacttcagaaagcaagggcaatggcgcgattgctggtttggtaatcggtttgtcattgatggcgatgattcttgtcggattgaagattactggactttcagtaaacccagctcgtagcttggcaccagctgtcttggtaggcggcgcasccttcaacaagtttggattttcatccttgcaccaatcgctggtggagttcttgcagcccttgttgcaaaaaatttccttggaacagaagaataattgaaactcaaaaagccttgctcctcatcttgaggaacagggctttttcgtatgatactcttcgaaaatctcttcaaaccacgtcagcttcatcttgccgtagtatggttactgacttcgtcagttctatccacaacctcaaaacagtgttttgatctgacttcgtcagttctatctgcaacctcaaaacagtgttttaagctgacttcgtcagttctatctgcaacctcaaaacagtgttttaagctgacttcgtcagttctatctgcaacctcaaaacagtgttttaagctgacttcgtcagttctatctgcaacctcaaaacagtgttttaagctgacttcgtcagttctatccacaacctcaaaacagtgttttgatctgacttcgtcagttctatccacaacctcaaaacagtgttttgatctgacttcgtcagttctatccacaacctcaaaacagtgctttgagcaacctgcggctaacttcctagtttgctctttgattttcattgagtatgactttagcggttgtcaattttctctggataaaggtcgtgttggaagaggcgttgttctgccaagccctcatacttagttccttgcttaccgtagttgtagtaggggtcgattgaaatgccaccgcgcggagtgaattttccccagacttctaaatagcgagggtctagcaagttgaccaagtctttcccgatggtgttgatacagttttcgtggaaatctccgtggtttcggtagctaaatagatatagtttgagggattttgactcgacacagagcttgtcaggaatgtaggaaatatgaatcgtcgcaaagtctggctgagcagtgatttgtcccagcagagacatatcgaggatatggtgacgaatgccctgttccttagcgatttctctagtaatttgaatttcgaggtgatgacgttggccgtaggcaaaggtgacagcttcgactgtttcatagtgttgcatgacccagaaaaggcaggttgttgaatcttgaccaccactaaagacgaccaaggctaattgacgtttcatagtactccttccaaaatgggaaatgttcagagcacgcaaaaagctcccattagggagctaaaaaataccaaatcgaggtttttttagcgatggcatatcccaaacatcgtaatattctacttatatagtaaaatgaaataagaacaggacaaatcgatcaggacagtcaaatcgatttctaacaatgttttagaagtagaggtgtactattctagtttcaatctactatagtctagcatattttttgaaaaatggcaaagggcaagaaaaaagagaccaaagaaagtacttggtctctcgtttgattagctcaattcagcaatgatggccttgatttgttctgctgtgtgaacacctgcaacttgtttgacaacttggccgtcttttttgaagagaagagttggaatagacatgattccaaaagcacgagctgtgtttggattttcatcaacgtccattttaacgattttcaagacatcttctgaaagttcttcagacaatttgtccaagattggaccttgcatacgacatggaccacaccaagttgcccagaagtctactaagaccaaaccgtcttttgtttcttgttcgaatgttgcatctgtaattgcttttgccattgtatttctcctttttttagttatattggcttaaatcttgtttcatgagatagaagaagatatctccataagtcccatggtagtccaaattatgacccttgtaagttaatttttggacagggtagtakkctgcgacgccgataaggcaagcttgttgcgaacgttcaaagtcttcataagactcgg

SEQ ID NO: 227 - DNA, 5278 bp; double-stranded, linear
actcagttagattttgttttcaaaaacaacgaagaaaaagaccatgttgctctacttggaagaattggctccgaacgtgtttatcgatatattaataaaaaatatttagatttaccggaaacattcgaaaattataatgtttttgtaccagaagctaatggaagtggtgccttaggtgaagtcttatcaacacccctaatcggggaacccctaatcgggcatacagatacttttttatctattggtaattttaaaacaaaatttgaagccgatgcttgtattaaatttattaaaactaaattcgctagagtattattaggtgttttgaaagttactcagcataattcacgcaaaacttggtattacgtccccctccaagactttacggtcaattcggacattgattggacacaatcagtgactgatattgaccgccagcttgatcaaaaatatgacttttcccctgaagaaattgcctttattgagaatcatgtaagggagatggattagaaaagtatttttatttgacaaatagtgctcaatgatctaaaatgactatataggattaggtcaggaagcatacgatgccctgaccctttttgtacttatgagatgagaaagtcatttgttagataaattgactcgttagcaaacgttcaaaaaaggaaaacttatgccagtagaaattaaaaccactaaagaaattcatcctaaaatctatgcctacaccacaccgacagtaaccagtaatgaaggctggattaagattgggtatacagaacgtgatgtcacacaacgtatcaaggagcaaacgcatacagctcatatagctacagatgtcttatggactggtgatgcagcttatacagaagagcctgataaggggaaaactttcaaggaccatgatttccaccatttcctttctttccatgatgtagaacgtcgtcccaagacggaatggttctattttaatggaactcctgaaaaatcaaaaaatctttttgataagtttgttcagcatgatttgtctggttatcagcctggaaaaggacaggactatactctgcgacaagagcaagaagaagcagttgctaagacattagcttatttccaagaacatgctggaggcaagtttctctggaatgccaagccacgctttggtaaaaccttgtctacctatgacctagctcgacggatggaagctgtcaatgtcctaattgtaacaaaccgccctgccattgctaactcatggtatgatgattttgaaacattcatagcaggtcaaacgacttacaagtttgtttctgaatcagatagccttaagagtcgtccaatcttgtcacgacaagaatttcttggtattttagctgacgatgtaagacaacttgcttttatcagtctccaagacttgaaaggatctgtttatttaggtggagagcacgataaactcaaatgggtaactgatctgcattgggacttgttggttattgacgaggctcatgaaggagttgataccttcaagactgaccaagcctttaataagattcgacgaaattttactctgcatttgtcaggtacatcatttaaagcattggctaaaggagattttacagaggaacaaatctacaactggtcttatgctgatgagcaggctgctaagtattcgtggtctcttgagcaagaagaggaaaatccttatgaaagcttgcctcagttgaatctctttacctatcaaatgtctcagatgattggcgaaaagttagaaaaaggcgctcagatcgatggtgaaaatattgactatgtttttgacttaagtgaatttttcgctacagatgataaagggaaatttattcatgagcatgatgtcagaaattggttagatactctatcaagcaatgaaaaatatccattttcaaccaaagaactccgtaatgaactcaagcatactttttggcttttagaacgtgtcgcttcggccaaagcattaaaagccctactagaagaacacccaatctatgaaaactatgagatcgttctagctgctggtgacggacgtatgtccgaagaagacgataaagtcaaactcaaatccttggacttggttagaaaagcgatagcagagaatgacaaaaccattaccctatccgttggtcagctgacgacaggtgtcactatccctgaatggacaggtgtattgatgttatcaaatttgaaatcaccagctctttatatgcaggccgccttccgtgctcaaaatccttactcatggagcgataacaaaggaaatcactttcgcaaagaaagagcctatgtatttgactttgcgccggaaagaaccttgattctctttgatgagtttgccaacaacttattgcttgtaactgcagctggtagaggaacttcagctacacgcgaagaaaatattagagaattattaaacttctttccaattattgccgaagaccgtgctggtaagatggttgaaattgatgcaaaggcagttctaaccactcctcgccagataaaagctagagaagttcttaaacgaggttttatgtccaatctcttatttgataatattagtggtattttccaagcaagtcaaacagttttagatattttaaatgagctgccagttgaaaaggaagggaaggtacaagatagttctgatttattagatttttcagatgttacagtcgatgatgagggaaatgcagtagtagaccatgaaattgtagttaatcagcaaatgcgactttttggtgaaaaagtttatggacttggtgaatctgttgctgagttagtcacaaaagatgaggaacgaactcaaaaacagctggtcaatgacttgagtaagaccgtttcttcagtgattgtagaggaattgaaagcagattattctctaaaaacaagggaaactgagcaaattaagaaacaaattacagcaacacttgagaatgaaattcgaaaaaatgatatcgaaagaaaaatttctgaagctcatatcaagcaagagttgcaacagcagctcaaagaagcaaatgataaagcgcaaaaagataagattcaagaagatttggaaaaacgtttagaagaaaataaactcattcataaagaaaaactagaacaaacactcaaaaaagaagtggaaaaaatgcctgagaaatttatcgaacaggttgagataaaacgtgtggaacagttgaaacaatcagctcaagatgaaattcgtgaccatttacgagggtttgcaagaacaattccaagttttattatggcttacggtgatcaaactctaacacttgataattttgatgcctttgttcctgaacatgttttttatgaagtaacagggattacgattgatcagtttagatatttgcgagatggtgggcaggattttgcagggcatctctttgataaagcaacatttgacgaagctattcaagaatttcttcgcaagaaaaaggagttggcggattattttaaagatcaaaaagaagacatttttgactatattccaccgcagaagaccaaccaaattttcactcctaaacgagtggtgaaaaggatggtagatgatttggaaaaggaaaatccagggatttttgatgatccatctaagacttttattgatttatatatgaagtcaggcctctatattgcagaacttgtgaagcggttatataatagcaatggcttgaaagaggcctttccaaatcctgaagaacgcttaaaacatattttggaaaagcaagtttatggatttgctccgtctgagattatctataacatttccactaattttatatttggcaatctttctaaagatatcagtaggaagaattttgttttagcagataccattccagcggctaaagaagggagcattcaaaagttggttgattcctattttgaaaataattaaaaagaaggccgagtcaaaattctttgaaatcagaaaaaacgcataatattgagtgcttttgtactgccccccaaaagttagacagaaaaaatctaacttttggggggcagttcagacaatccttggtattatgcgttttattgtgggaagatgtataatggattgaaataagatatgaacaaatcaattaggaatttaaagcattttataacaacgttttagagtaatggggggctatttcaacttcaacctactataatacagaaaaaaacaactccctgataattcaaggagttgtctatagttaaattagtttttagaagcttcttggaattctgggtttttccatgcttcgtcaatgatagcttgtaattctttagcagatgcttgcattttttgagtttctgcgtcgttcaatgggatatttactggacgaacgataccatgtgcaccaacaacagctggttgaccgataaagacattctcaactccgtattgaccttcttggaatactgaaagtggaagtactgcgttttcatcgtcaaggattgctttagtgatacgagcaagggctactgcgataccgtagtatgttgcaccttttttgttgatgattgtgtaggctgcatcacgaacaccttcgaacaattcaatcaattcagcttcttgaacattttgagtgtctttaaggaattcttcaaggtttacaccagcgatgttagcgtgtgaccaaacagcgaactcagagtcaccgtgttcacccatgatgtaggcgtgcactgaacgagcatccacatccaatttttcagcaagtgcttgacggaaacgagctgagtcaagtgaagtacctgaaccgataacgcgttctttagggaaaccagagaatttccaagttgagtaagtcaaaacgtcaactgggttagcagcaacaaggaagatacctttgaaaccagattcaacaacttgagttacgattgatttgttgatagcaaggtttttacctacaaggtcaagacgagtttcacctggtttttgaggtgcacctgcagtgatcacaacaaggtcagcgtctgcacagtcagagtattgagctgcatagatttttttaggtgaagtgaaggcaagggcgtgactaaggtcaagcgcatcaccaacagctttttcatgcaattgtggaatttcgataattccaagctcttgtgcaattccttggttaacaagtgcaaaagcgtaagatgaacctacagcaccatcaccgacaaggataacttttttgtgttgtttagttgaagtcattgttttaaacatctccttaattttattaggggattttccctagacaacttcatt

SEQ ID NO: 228 - DNA, 1941 bp; double-stranded, linear
ataaggaatctctaaaaaattttaaggagaatctagcaaatggatttcacatgggcactgaagtatgccactgaatttttgggaactgccattttgatcattcttgggaatggtgcagttgccaacgttgaacttaaaggtacgaaaggtcaccaaagtggctggatcgtcatcgctgttggttatggtatgggggttatgatcccagccttgatgtttggtaacgtatctgggaatcacatcaaccctgctttcactctagggcttgcagttagcggtcttttcccttgggcacaagtggtaccttacattatcgcgcaagtcttgggggctatctttggccaagccttagttgtggcaacataccgtccattctacttgaaaactgaaaacccaaataacatcttgggaactttctcaactatttcaagtattgaccatggtacaaaagaaagtcgctatgcagcaactgtcaatggtttgattaatgagtttgttggttcatttgttttgttctttgcagctcttggtttgactaaaaacttctttggtgctgaagtgcttcaattcatgaaacaaaaggcaacagaagcaggacaaacagttgatttttctgacttggctattaaagcacaggtggctccacacactgcttcaggactttctgtggctcacttggcacttggattcctcgttatggctttggtaacatcacttggaggacctacaggacctgccttgaacccagcccgtgacttgggaccacgtctccttcatgctttccttcccaaatcagttcttggtgagcataaaggcgattcaaaatggtggtattcttgggtaccagtagtagcacctatcgcagcagcaattgcggcagtagctgtattcaaattcctttatctctaagaaatagctcctttaacatttgagtgagcaccatctataagtaagagaggatcagactggktctctcttttkgatttttagggaaatgaaagaactctaaacaaactcctctccagcagtggtttagaagtctcagtgggctattccagcttcaatggactatagtaggttgcagttgaaataatagacccttgtttctaaaacattgtgagaaattggtttgaattctccaatcaaattgtgcagttttcattctactatatattatcggaatattatcggagatgggttccctatcttgtaagtctgctttatagtgggttgaagttggaatagtcctcccttctttctcaaacattgtgaggaattgatttaccttcctcaacaaaatgttcagtttctatttcattttactataaaataagcgattaggggggctattcttcgacctacattgactctgctgagtcctatgattgttatcgttttatctgcaattttatactcaatgaaaatcaaagggcaaactaagaagctagccgcaggttgttcaaaacacagttttgaggttgtatagtagattgaaactagaatagtacacatctacttctaaaacattgttagaaatcgatttgactgtcctgaacgatttgccctattcttgtttcattttactatataaaccagagactgtttacattttcagcaagtgagtggatggataatgctgaaaactccttgaaggataagtctatttagtactttctattaattagttaaatttttaccaagaataattcacaaaaacgttgtaaaacacttgcaatttagctgaaatttgataaaatagtaaggaaagttagactgtattgcctactgtctatctataaaatatattttattggaggcttttactcaaatggcaaaagaaaaatacgatcgtagtaaaccacacgttaacattggtactatcggacacgttgaccacggtaaaactaccctaactgcagctatcacaactgttttggcacg

SEQ ID NO: 229 - DNA, 755 bp; double-stranded, linear
atttgaagaaattgaagaaatcgtagcccctacagatggtgaatttttgggggaagttttacttggaactggggtagttctcttaattggagtagcctgttgttaaaaagatagggagtgataatcatgcaagataactttttatttgaggaaattgaagaaatttcagtaccagttaatgatttttcagctggacttgcaacaggtatcggatttggtttagcaatccttgctcttgctggttgttgaagtttgttcatttactaacatcaagctttttcaatttcattttagacagtcatttaaattttccgtattagtcttgcagcaagagattaatagaattagtcattattttattgattgcggactgagggactagagtatgttttacttaacccctcttttatttattaaaggttaggtttgttatgagaattgttgataagattaagatattacctactccttatgagggacactatcatttatatataccatccagtaagaaacatgtattagttgggaaacaggaaaaaaatggttagagcaactaataggtcaagaatttaccatatcggacttattagtgttagtagggaagaaatatttttaaaatatcttgggactttaatataacattatctgaaaaattaaactataaaagatttaataagaattttgaaaaaatcctatcttgttgtcattatatttgcaacgatacatgaaattagtcatgcaataattgctaataa

SEQ ID NO: 230 - DNA, 1483 bp; double-stranded, linear
ccagaaaaaccgtagtggagctcgtggaacagtggaattgattttccaaaaagaatacaataaattttcaagtatctcaaagagggaggcataagatgtcagatgcatttacagatgtagccaagatgaaaaaaatcaaagaagaaatcaaggcacatgagggacaagtcgtagaaatgactttggagaatggtcgtaagcgccaaaaaaatagattgggtaagctaattgaagtttatccatctctatttattgtggagtttggggatgtggaaggagataaacaagttaatgtttacgttgaatcctttacttactcagatattcttacagaaaagaatttgattcattatcttgactaaagtgagaaattttctcactttttcttttttctccgaataatttaggtgaaggcaatcatcgctttatattatttttcaaggaggaagaatgaaaattttaccgtttatagcaagaggaacaagttattacttgaagatgtcagttaaaaagcttgttccttttttagtagtaggattgatgctagcagctggtgatagtgtctatgcctattccagaggaaatggatcgattgcgcgtggggatgattatcctgcttattataaaaatgggagccaggagattgatcagtggcgcatgtattctcgtcagtgtacttcttttgtagcctttcgtttgagtaatgtcaatggttttgaaattccggcagcttatggaaatgcgaatgaatggggacatcgtgctcgtcgggaaggttatcgtgtagataatacaccgacgattggttccattacttggtctactgcaggaacttatggtcatgttgcctgggtgtcaaatgtaatgggagatcagattgagattgaggaatataactatggttatacagaatcctataataaacgagttataaaagcaaacacgatgacaggatttattcattttaaagatttggatggtggcagtgttgggaatagtcaatcctcaacttcaacaggcggaactcattattttaagaccaagtctgctattaaaactgaacctctagctagcggaactgtgattgattactattatcctggggagaaggttcattatgatcagatacttgaaaaagacggctataagtggttgagttatactgcctataatggaagctatcgttatgttcaattggaggctgtgaataaaaatcctctaggtaattctgttctttcttcaacaggtggaactcattattttaagaccaagtctgctatcaaaactgaacccctagttagtgcaactgtgattgattactattatcctggagagaaggttcattatgatcaaattctcgaaaaagacggctacaagtggttgagttatacggcttataacggaagtcgtcgctatatacagctagagggagtgacttcttcacaaaattatcagaatcaatcaggaaacatctctagctatg

SEQ ID NO: 231 - DNA, 1027 bp; double-stranded, linear
cccggaaaacaagttaaagttgaagttggtcaagcagtttacgttgaaaaattgaacgttgaagctggtcaagaagttacttttaacgaattgttcttgttggtggtgaaaacactgttgtcggaactccacttgttgctggagctactgtagttggaactgttgaaaaacaaggaaaacaaaagaaagtggttacttacaagtacaaacctaaaaaaggtagccaccgtaaacaaggtcaccgtcaaccatatacaaaagttgtcatcaacgcaatcaacgcttaattttaaggagaacacatgatacaggcagtctttgagagagccgaagatggcgagctgaggagtgcggaaattactggacacgccgagagtggcgaatacggcttagatgtcgtgtgtgcatcggtttctacgcttgccattaactttatcaattctattgagaaatttgcaggctatgaaccaatcctagaattaaacgaagatgaaggtggctatctgatggttgaaataccaaaagatcttccttcacaccagagagaaatgacccagttattctttgaatcatttttcttaggtatggcaaacttatcggagaactattctgagttcgtccaaaccagagttatcacagaaaactaacacggaggaaaacattatgttaaaaatgactcttaacaacttgcaacttttcgcccacaaaaaaggtggaggttctacatcaaacggacgtgattcacaagcaaaacgtcttggagctaaagcagctgacggacaaactgtaacaggtggatcaatcctttaccgtcaacgtggtacacacatctatccaggtgtaaacgttggtcgtggtggagatgatactttgttcgctaaagttgaaggcgtagtacgctttgaacgtaaaggacgcgataaaaaacaagtgtctgtttacccaatcgctaaataaaaaggtccattgaaccttttatcccgaaccttgaaatgtagaggtgaggaagctagaaacagcttaaaat

SEQ ID NO: 232 - DNA, 1990 bp; double-stranded, linear
cggttcaaatggtgcaggtaaatctacgttaattaattctattgtaggttttcaagagatttatttaggagaaatagagtattgtgataaagatttgatagttagttctcaaccttttgctcatttaggctttactcctcaaaccacagtaattgatttttatactactgtgaaggacaatgtaatattggggctgaaccttgctggaaagtttgggaaaaatgctgagaagttgtgtcaaatagccttagaaattgttgggttagctgataaaaaaaataatttggtagaaacattgtcaggtggacaactgcaacgcgtccagattgctagagcaatagctcataatccagatttttatattttagatgaacctaccgttggtttagatactgaatctgccgaaaaatttttaatgtatttaaaagataagagtttggaaggaaaaactattatcatatcttcacatgacataaatctactcgaaaagttttgtaaaaaaatactttttttacaaaatggctccatatcattttttggtgatatgcgtgactttgtagataattcaactatcaaattaaatttttcaatgcagaatagaatttctagatatcaaattgaatttttagaaaattttagatttaaagttcacatcgaagataatgatagttttacaatagaagtccctatagaagaaaagatcttagatgttatcaatgaggtaggaaaagcatgtgaaattaaaaacttttcaacaagtaaattaaccttacaagaaagttatttgcaaagaataggaggagaaaaatgaaggctgatcaattaaggcacaaatcggacttaggtttaagaggtctagcgattattgctaaaaatgagattattgctttttttagaagtaaaggtttaattatttctcagtttctacaaccaatcttatatgttgtttttataataataggattaaattcttcgataaagaacattcagtttaatgatataaaaacctcttatgcagaatatacaatcattggtgttatagctttattgataatcgggcagatgactcaagttatttatagggtgacaatagataaaaaatatgggctacttgctcttaagttatgcagtggagttcgtcctttatattatattttagggatgagtatctattctatattagggttgatagttcaagaaattattatatatataattacgttagcgtttgagataaatatcgcaatggatagatttttttatacagttttgttatctattgttgttttattattttgggactcccttgcaattttacttacaatgtttatcaatgattacagaagacgtgatattgtaatacgttttgtactaacaccgcttggttttacagctcctgttttctacttaatagattctgctcctagtattgtgagatggattggtcagttaaatcccttaacttatcaattaactattttgagaaacttttattttaaaaattcaacaactttggaattagttttcttattgttaacatcattacttgtccttatatctgtatcttttattataccaaagataaaattgatactgatagaaagataaaagttgggtcatccaacttttttgttgtctcccgaaaaccactagctatgctagtggttccatagagcttttagcgtggtaacaaaaagaacctcctaaaatgataagatagaagtggtttctccgccactacaacatatcatacaggaggtacctcatgagagaggataatcaaagtttatcacataccacatggaattgtaaatatcatattgtttttgcacccaaatatcgtcgtcaaatcatttatggcagatacaaagctagtatcggaagaatcatacgtgacttatgtgagcgtaagggtgtaataatccatgaagcgaatgcttgttcagaccatattcacatgcttatcagtattcctccgaaacttagtgtt

SEQ ID NO: 233 - DNA, 4766 bp; double-stranded, linear
gaactatattgcatatatttctagcaatgatcatggcgaatcttggtctgcaccaactttattacctcctataatgggacttaatcggaatgcgccatatttaggtcctggacgtggaatcattgaaagctcaactggacgtattcttattccgtcttacactggtaaagagtctgcgttcatttatagtgacgataatggagcatcttggaaagttaaagtagtgccacttccttctagttggtcagcagaagcacaatttgtagaattgagtccaggagtaattcaagcatatatgcgtacaaataatggtaaaattgcatatttaacaagtaaagacgcaggtactacttggagtgcaccggaatatttgaaatttgtttcaaatccaagttatggaacacaattatcaatcatcaattatagccaattgattgatggtaaaaaggctgtcattttaagtactccaaactccacaaatggtcgtaaacacggacaaatttggattggtctaattaatgatgataatacaattgattggcgttatcatcacgacgttgattatagtaactatggatactcatattcaacattgacagagttaccaaatcatgaaattggattgatgtttgaaaaatttgattcatggtctcgtaatgaacttcatatgaaaaatgttgtaccatatataacatttaagattgaagatctgaaaaagaattaaagctgaaatttgaaaatatataaaaagaggataaaaattatggtaaattacggtattgttggagctggatattttggagctgatttagctcgctcaatgaacaaaattgaagatgcaaaagtggttgcggtatttgacccaaatcatggagaagaagttgctcaagagttgggatcagatgtttgtgcaagtttagatgaacttgtagcacgtgaagatattgattgtgtgatcgtagcttcacctagctaccttcaccgtgaaccagttgtgaaagctgctcaacatggcaaacacgtattttgtgaaaagccaattgcattgtcttatgaagattgtaaagccatggttgacgcatgtaaagaaaataatgtcatctttatggctggtcacatcatgaacttctttaacggtgtacaccatgctaaagaattgattactcaaggtaaaatcggtaaagttctttattgccatgctgctcgtacaggttgggaagaacaacaaccaactgtatcatggaagaaacttcgttctcaatctggaggacatttgtaccaccatattcatgaattagattgcattcagtttatcatgggaggacttcctgaaaaagcgacaatggtaggaggcaatgtatatcataaaggtgaaaactttggtgatgaagatgatatgctcattgtaaacttagaatactctgatgatcgttatgctgttttggaatatggtaatgctttccgttggggtgaacactacgtcttgattcaaggaactgaaggagctatcaaacttgacttgttcaatactggcggtactcttcgtgttaaaggtgaaggagaatcacacttcttagttcatgaaactcaagaggaagatgatgatcgtacagctatctataccggtcgtggtatggatggagcaattgcgtacggtaaaccaggagtacgttgcccattatggttgcaaacatgtattgataaagaaatggaatatctacatgacatcattaaaggtggagaaattacagaagaatttgaaaaacttctcaatggtgtagctgctttagaatcaatcgctaccgctgatgcatgtactttatcagttaaagaagatcgaaaagtaagtctttcagaaatcacaaatgcttaacttttgtaaaacagaatagtaaattcttgtcattatataatttctaaagttctgtgatacaactcattgaataaagaaatagagatgggactgggataatgcccagtcccattttttatcaaaaagtaatgagatcaaaaatgtgggagtgttgaaatgaagattataggtatcgatattggcggaacaacaattaaggcagatttatacgatgagtttggaacgagtttgaatcatttcaaagagatagaaacaattattgactatgatttgggaacgaatcagatattaaatcaggtctgtgatttaattggtgagtatactttaaatcattcaattgatggtgttgggatttccactgctggagttgttaatgctaatactggagaaatcatctatgcaggctatacaataccagggtatatcggagtaaactttactgccgaaatagaaaaacgttttgggttgtatacttttgttgaaaatgatgttaattgtgctgcattaggtgaattgtggaagggacaagccaaagataagaaaaatgtagtaatggttactattggaacaggtataggaggcagtattattgtcaacggacaaattgttaacggatttaactatactgctggtgaagtaggttatattcctgtaggtaattcggattggcaaagtaaagcctcaacaaccgcattgattcatttatatcaaaaaaagagcttgaaaactaatcaaactggacgtactttcttcactgatttaagatctggagataaagttgctgaagaaacttttgaaatttttgtagaaaatctaacaaaaggtttattaacgatttcttatctacttaatccagaaattctcatattaggaggtgggattctggatagtaaggatattttgttacctgaaattcaaagttctttagctaaaaatgcaatggataataggtttttacctaaaaatcttgtggcagctacattaggaaatgaagctggtcgtataggagctgtaaaaaatttcttagatagaatttctaataaatagtatgtaagataaggaggtgtcacaatgactaactctgtattttcgacaatgcaagatattgagaatgttgcaaccgatattataaaatcatatgataatgagatttatacttataaagctgtttcccaagaagaattggaaaaactagaaaaaagttatgatgaaaaaagtcacgaagaattagtttcaatagaaagcaatttagaaatgaaacaacagaaccttattgatgaggttaataaaacaatcaaggaaaatgatgcaaatattcagtatatttcatcaagtaggagaggagaatttgtagaaaaaattattggtagggtggtagaaaaatatggccattagtcagatgaaaagaatctctctactattttctaaaagtagtcttgatgatgttttaaaaactattcaagaactagagtcagtgcagttccgtgatttaaaggttcaggataactggtcagaagctctagaaaaagatgaagttgtatttccaactattcaaatttttcatacttctaattccaatcatggggttattgagggaaatgatgccttgacttatttgatgaatcaacaacaacatttagaagcaactgtagagaaattacaagaatacctaccgaaagaaaacacgtttaaattattgcagcaacctccgataactacctcttatgaagaattagagaaatttggtaaagctaatgttgctgagggtgttcttaaaaaagtgaatcatcaaattaacagagttcatgaattagaaagacacattcaaagtaataatgaggaaatagagcgattaataaagtgggaaaaattagaaattgttcctgcgaatttagaacaattttctttctgtaaaggaaaagtcggaacaattccaaggactgaagataatcgcttatacaatagtcttttagaaaacaatattgaagttcaagaaatattttctaatgatagagagtacggtgttgttgttttctatcagtctagttactctatagattttgatgaatacttatttgaaccatttgattattctagaaaggaattaccgaagcagcgagtagtagatttagatcaagaaaacatgcagttaataactgaaaaagagaatattatcgcatcgttgcaagattcaaagaaatatttgatagatttacaatggcaaatagactatattttatctatctatgctcgtcaaatctctaagaataactttttgtgcactccgcatctagttgcattagaaggatggatagaagaaactcgtattttatattttataaaagttatggatgagcattttggacattctatttatatttatgaatcggaaacattgacggataatcaagatgaaatacctatcaaattaacgaatcattctttaattgaaccatttgaattattgacagaaatgtatgctctgcccaaatattatgagaaagatcctacacctgtattagcaccattttactttacattttttggaatgatggttgctgatttaggctatggtttactattgtttttaggaacaatgttagcattaaaaatttttcatctaccttcagcaactaagagatttttaaaattctttaatatattaggggtagccgttgcaatttggggtggaatctatggctcattttttggatatgagttgccatttcatctgatatctacaacctctgatgtcatgactatattagtagtgtcagttgtgtttgggtttattacagtatttgcaggtttgttagcttcaggactacaaaaagtaagaatgaataaatatgcagaagcatataattcaggatttgcgtggtgtgttattctg

SEQ ID NO: 234 - DNA, 2484 bp; double-stranded, linear
ccttttagaaaaaattaaagaatacgacaccattatcattcatcgtcatatgaaaccagaccctgatgccttgggaagtcaggtgggattgaaagccttgctggaacatcatttcccagaaaaaaccatcaaagccgtcggttttgatgaaccaactcttacttggatggctgagatggatcttgttgaagatagagcctaccaaggcgcacttgtcatcgtctgtgatacagctaatactgctcgtatcgatgataagcgctatagtcaaggtgattttctcattaagattgaccaccatccaaatgatgatgtatacggtgacctgtcttgggtcgatactagttcaagtagcgctagagatgattaccctatttgcccaaacaacccaactagccttggcagatcgcgatgctgagttgctctttgcaggaattgtcggtgatacaggtcgcttcctctacccttctaccactgcacggactcttcgcctggctgcttatttgagagaacataactttgactttgcggctctcactcgcaaaatggacactatgagctacaaaattgctaaactgcaaggctacatctacgaccatctggaagtggatgaaaatggtgctgctcgcgttatcctgagtcagaaaatcttgaaacaatacaatataaccgatgctgaaactgcggccattgtaggtgcacctggacgcattgacagagtgagtctctggggaatttttgtcgaacaggctgatggccactaccgagttcgcttacgcagtaaagtccatcctatcaatgaaattgccaaggagcatgatggtggaggccaccctctagcaagtggtgctaattcctatagcctagaagaaaacgaaatcatctaccaaaagttagaagacttgcttaaaaactgataaaatacttgccaaacttttcagaatctgatagactagtatagtaacaatctatggctcgcaaagagaccatggcagaaaggaaatattgcaaaatgaaaaragatatccatccagaatatcgcccagttgtcttcatggacacaactactggttaccarttccttagcggttcaacaaaacgctctaacgaaacagttgagttcgaaggcgaaacttacccattgatccgtgtggaaatttcatcagactcacacccattctacactggacgtcaaaagttcactcaagcagatggacgcgtggatcgtttcaacaaaaaatacggtctcaaataatgataagagaacagttttggctgttcttttttgtttcttgaaatcaactgctgttttcatgttccagactcatctgtaggttcgatttccatgctactaggcaggaaggaaatagctgtttcaacacgtccataatgagctatactattgtcacgaaccacactttcattgatggtccaagtggaattcattttcttaaaagcttctcggactttttccaaatctttggaggcaatggcctgctctaaggtttcaaaacgaggacttatactcatctgctttcaaaaagcattctagtccatctccgattaccgatggactttatcacctccttctccagtccttgtatgacatcttgaagttgattcatgacatcttccaaagttcgaaaggctttattcttaaatccacgtttacgaatctctttccacacttgttcaatgggttcatctctggtgtgtatggaggaataaaggtaaaatcaatattagtcggaatatttaaggtacttgatttatgccatatagcattgtccataacgagtaaaaggataagcttgtgaaagctcttctaaaaaggcgttcatccacactcctttttataaacctgaaataaggcatcaattgtaacaaattctcctgcctctgtagccttcaaatgacgggcaagaaaggctttctcttcctcaactgtcatatatgcatggttacgaccaccacgtgtttcttgaaggagagagtcgagtccgaactcctcatatttttttacgtttcgccaaatcgttgtttgattacagtctaaaagctctataatctctttataagatttgcccatcagacgaaatatagtagattgaaactagaatagtacacctctacttctaaaacattgttagaaatcgatttgtcctgttcttgtttcattttactatagaacgatttgaaggcgtttataatatttagctgtacgagagtcttttaaaagtgttttgatggtttggatttcttctttagttgatttcatattactattatataatgctttttgattttagtctggtataaatattgctttcctccaaaatggtcatagttttactggcaaatctaacatatcacggataaattaacaagtgatttctgaattgctaaacattttcttttcttatagcatactttaagattttgtctttgagaaagatatttccaagaaaaacgttcgttttttgg

SEQ ID NO: 235 - DNA, 1766 bp; double-stranded, linear
ctagatatagctataattttatttataacaagaggatagaaatgaccgaattagaaagaaaaaatcgaaaaattagctaagaaatattctgataacttaaacatcaaagttcaagagagagttcgtgaaatggcaaatgataataagagccattatttgatatacagagttttaggtatttcatttgaagaaggagaaaatatcgatttgtatcaaaataaaggtcgttttttatacaaatatgctggttcatttttagaagaagctgcagtactatgctttaacgaaaaatttggtacagaaaatacttaaaaagttaacattcctaattctgaaagtacaaaacctaagacttttgaaattgattgtttagtcggagaaaaacacgcatacgaaataaaatggtgggatgcaactacagatggagaccatataactaaagaacacactagaataaaagttattcataacaaaggatatataccaattcggttaatgttctactatccaaatagaactcaagctataaaaattcagcaaactttagaaacattgtataacggtattggagggaaatattattatggagattctgcctgggaacatttaagagcagtgaccggtattgatttacttagtattctaacagatattgcaaataaaaaaacaggggtaaaatcaaaatgacagtattaaaaggagataacttagaaatattaaaaactattgaatcctcaagtattgatttaatctatatggaccctcctttctttacacagaaaacccaaaaattatctaataacaaaaatattatgtattcattcgaagatacgtggacttcgattgaggattacaaagaatttttgtctgtaagattagaagaatgcaaaagagtgctaaaaaatagtggcagtattttcgttcattgtgataaaattgcaaatcatcatattagattaattttagataatatctttggagtagatatgtttcaaagcgaaattatatggaactataaacggtggtctaattcaaaaaagggattattgaacaatcatcaaaacatttacttttattcaaagtcaaaagattttaaatttaatacaatttttacagagtattcttctactacaaatatcgaccaaatactagtggaacgaaaacgagatggaaactctaaaactatatataaggttgataataatggtaactatattctagcaaaagagaaaaatggagttcccctttcagatgtttggaatataccatttcttaatccaaaagctaaagaaagagtaggttatcctacacaaaaacctattctgttattagaacaaattataaagattgctactgataaaaatgatatagttttagacccgttctgtggaagtggaactactttagtagcctccaagattttgaatagaaattatatggggattgatttatctgaggaagctatcaatataactcagcaacgtctggaaaatgttataaaaacaagttcaaatttattgaataaaggaatcgaagcatatagaaccaaaactgaggaagaggaaaacattcttaaattattacaggcaaaaattgttcaaagaaataaaggaattgatggttttttacctaaacattttcaaaaaaaaccgatacctataaaaattcaaaaaaataatgaatgtctgaatgagagtatctctttattacagaatgctataaactccaaaaaacttgattttggagtagttataaaaactcattcg

SEQ ID NO: 236 - DNA, 748 bp; double-stranded, linear
ccgaaaatcaaattcaaaccacgtcaacgtcgccttgccgtactcaagtacagcctgcggctagtttcctagtttgctctttgattttcattgagtattaaactaaattaaataatattagcgcggagaatttctaattcttccttggtcaagcgacgccattcccctcgttctaggttctcatctaatactaaagttcccatagtcaatcgttgcaagtccaccacttccttgccacagtagcccaccatacgcttgatctgatgaaacttcccttctgcaatggtcacacggatttggctttgattcttttctgtatctatggatacaagctccagtatagcgggttgacaggtaaagtctttgagaggaataccctcagcaaatgtctccacatcttcttgggtcatgattcccttgacttgtgccagataagtcttgtccacatgacgcttgggcgaaagaagaacatgagccagctgaccatcattggtcaagagcaaaagaccatgcgtgtcaatatccaagcgtcctactgggaaaacttccttactccgcgccaagtcatccaacaagtccagaacggttctgtgcttgggatcctcagtcgctgagataactcctttgggcttgttcatcatgtagtagacaaactcttcatactccaacacttgcccatcaaagcgaatctcatctattttttcatcaatctgcaatttagctgatttttctttttgaccatttacag

SEQ ID NO: 237 - DNA, 1449 bp; double-stranded, linear
aaaagattacattgcaacaattgaaaattatccaaaggaaggcattaccttccgtgatattagtcctttgatggctgatggaaatgcttatagctacgctgttcgtgaaatcgttcagtatgctactgacaagaaagtcgacatgatcgtgggacctgaagctcgtggatttatcgtgggttgtccagttgcctttgagttgggaattggttttgcgcctgttcgtaagccaggtaaattgccacgcgaagttatttctgctgactatgaaaaagagtacggtgtcgataccttgactatgcacgcggatgccattaagccaggtcaacgtgttcttattgtagatgaccttttggcgacaggtggaactgttaaggcaactatcgagatgattgaaaaacttggtggtgttatggcaggttgtgccttccttgttgaattggatgaattgaacggccgtgaaaaaattggtgactacgactacaaagttcttatgcattattaatgaaaacagtccctagggctgttttctctacactaggatataaaaatagactataactagttagagaaaaactataattgaaaactatatcttcttgcagtataataaaaggactaagtgtttgagatttgtcttcaaacatatgcaattattcctgaaagagtacagttaggagagggttatgccgattcgaattgataaaaaattgccagctgttgagattttacggacagagaatatctttgtcatggatgatcaacgtgctgcccaccaagatatccgtcctttgaagattttaattttaaatctcatgccacagaaaatggtcacagagacccagttgttgcgccacttggctaatacacccctacaactggatattgattttctctatatggagagccaccgttctaaaacaactcgttcagagcacatggagaccttctataaaacttttcctgaagtcaaggatgagtattttgatgggatgatcatcacgggtgctccagttgagcatttaccatttgaggaagtggactattgggaggaatttagacagatgcttgagtggtctaagactcatgtctattcgacccttcatatctgttggggggctcaggctgggctttatctgcgctatggtgtagaaaaataccagatggacagtaagctatcaggtatttatcctcaggacaccctaaaagagggtcaccttctatttagaggctttgatgatagctatgtatcccctcattcacggcacacggagatttctaaggaagaggtcttaaacaagaccaatctcgagattttatcagaaggacctcaggttggggtttctattwtggccagtcgtgatttacgagaaatttatagttttggtcatttggagtatgaccgtgatactttggcaaaagagtattttcgagatcgtgatgcaggtt

SEQ ID NO: 238 - DNA, 904 bp; double-stranded, linear
tacccgcttctttcaagagttggagcagggcttgtttgcgatcttttgtcatagttcttccttttaacggcgttttcgaagcactttatagacagctagtgctaatgtatagtctaccatactatggataattgtaccaaatccaactagtacaaatagaacataaaacatattttctacattggtaccagaagttgcgtaaaaaacgacacaggccaatacttcagcaagggcatgaacaacagccaaaacaaagttgaaaatccaggaagattttggtttatctagggtatcggggaatttttgtaggtaaagagctcctaaagcaccaaaagatatatgggaaaaagcccgaaaaacgataaccatgggatagccagccatcaaaaatccaaaactagaggctaggatgacaaaaactgccatcaagggcgacaagaacatggctataaaaatagcgatgtggctccccaaagtataggaagcaggtggaatgacaatcttgaaaggcataacaattggaatcaaaatcgcaatagccgttaaaagggctgtcattgtcataaattgtgtctttttccgtgtattcacaagaatctcctttttaactgcatatacactagtatggtacaataaaccagacaataaagcaagaatttacttgggtttatagatcattttttagttaaaagttatagtagattgaaactagaatagtccacctctacttctaaaacattgttagaaatcgatttggctgtcctgatcgatttgtcctgttcttatttcgttttactatagtaaagatttcattaaaaagaaactgtatagagcaaaatctccaccttcaggtttggaaagcggagattgtttnttattttttccagggtttgtagtcgtggga

SEQ ID NO: 239 - DNA, 946 bp; double-stranded, linear
cactcaaacatgacttatatcaagacggatggacttcaagacgatgccaatcgcttgaatcgtaacattcagtttggtgttcgtgaatttgcaatgggaacaatcttgaacgggatggcccttcatggtggacttcgtgtatacggtggaactttcttcgtcttctctgactatgtgaaggcagctgtccgcttgtcagccttacaaggacttcctgtgacttatgtctttacccatgattcaatcgcagttggggaagatggtccgactcatgaaccagttgagcatttagcaggtcttcgtgctatgccaaatctaaatgttttccgtccagcagatgcgcgtgaaacgcaagcagcttggtaccttgcagtgacaagtgagaaaacaccaactgcccttgtcttgacacgtcaaaatttgactgttgaagatggaacagacttcgacaaggttgctaaaggtgcttatgttgtatatgaaaatgcagccgactttgataccatcttgattgcgacaggttcagaggttaatcttgctgtctcagctgctaaagaattggctagtcaaggcgaaaaaatccgcgtagtcagcatgccatctacagatgtctttgataaacaagatgcagcttacaaggaagaaattcttccaaatgcagtccgccgtcgtgttgcagtcgaaatgggtgcaagtcaaaactggtacaaatatgttggtctcgatggtgccgttctaggtattgatacttcggagcctctgccccagcaccaaaagtattggcagaatatggctttactgtagaaaatcttgtaaaagttgttcgaaacttgaaataatcctaaaaatcagggcgtaagctctggtttttcttaccagaaaagtaaggtacaatcttgtaaaagtagctgaaatttgatatagtagtcctatgtaaaagacaaag

SEQ ID NO: 240 - DNA, 2764 bp; double-stranded, linear
cggggctccctagttcttagggagctatttttgttttttcaagaagttatcttcttgtattttatactcaatgaaaatcaaagagcaagctaggaaactagccgtasstgctcaaaacactgttttgaggttgtagataagactgacaaagtcaggaacacatatctacggcaaggcgacgttgacgcggtttgaagagattttcgaagagtattagttgtgaatctggtgcagtcgtcccagattattcttattagtagggtcttgttttctatatcccctcgtagttaacaagaccttgagcattttagaaagaggaatctatgtctacgaaatatatttttgtaactggtggtgtggtatcgtccattgggaaagggattgtggcagcgagtctaggccgtctcttgaaaaatcgtggtctcaaagtaaccattcaaaagtttgacccttatatcaatattgatccgggaaccatgagtccttaccagcacggggaagtttttgtgacagatgacggagctgagacagatttggacttgggtcactatgaacgtttcatcgatatcaatctcaacaaatattccaacgtgacaactgggaaaatttacagtgaagttcttcgtaaagaacgccgtggagaataccttggggcaactgttcaagtcattcctcatatcacagatgctttgaaagaaaaaatcaagcgtgccgctctaacgaccgactctgatgtcattatcacagaggttggtggaacagtaggagatatcgagtccttgccattcctagaggctcttcgtcagatgaaggcagatgtgggtgcggataatgtcatgtatatccatacaaccttgcttccttacctcaaggctgctggtgaaatgaaaaccaaaccaacccaacactctgtcaaagaattgcgtggcttgggaatccaaccaaatatgttggttattcgtacagaagagccagctggtcaaggaattaaaaataaactggcccagttctgtgatgtggcaccagaagccgttatcgaatcgttggatgttgaacacctttaccaaattccactgaacttgcaggcacaagggatggaccaaattgtttgtgatcatttgaaattagacgcaccagcagcggatatgacagaatggtcagccatggtggacaaggtcatgaacctcaagaaacaagttaagatttcccttgttggtaagtatgtggagttgcaagatgcctatatctcagtggtcgaagccttgaaacactctggctatgtcaatgatgcagaagttaaaatcaattgggtcaatgccaatgatgtgacagcagagaatgtagcagaactcttgtctgatgcggacgggatcatcgtaccaggtggttttggtcaacgtggtacagaagggaaaatccaagccatccgctatgcgcgtgaaaatgatgttccaatgttgggagtctgcttgggaatgcagttgacatgtatcgagtttgctcgtcacgttttaggtcttgaaggtgccaattctgcagagcttgcaccagaaacaaaataccctatcattgatatcatgcgtgatcagattgatattgaggatatgggtggaacccttcgtttgggactttatccgtctaagttgaaacgtggctctaaggctgctgctgcttatcacaatcaagaagtggtgcaacgccgtcaccgtcaccgttatgagtttaataatgccttccgtgagcagtttgaggcagcaggttttgtcttttcaggagtttctccagacaatcgtttggtagaaatcgtggaaattcctgaaaataaattctttgtagcttgtcagtatcaccctgaactgtcaagccgtccaaaccgaccagaagaactctacactgcctttgttactgcagcagttgagaacagcaattagcaaaatcagaacctttgagaaaaatctcagaggttttttgcatacgatgatattgcagtatatctgaggtaggggtcctctgtatgtacctgctaccgttgaaatcaatagcgactccctcttgccctgtgctagtgaatggatttatcagtatattgaaatgaaataaaatttgaacaaattaattcggaaagccaaatcaatttctagcaaagttttaggaactggattgtatagtgaattgaaataagatgtgaacatctctatcaggaaagtcaaattaatttatagaaatattttagcagtcaagatgtactgttatagattcaatacattatacttttttaatttaatccactatagtaaaatgaaataataacaggacaaatcgatcaggacagtcaaatcgatttctaacaatgttttagaaatagaggtgtactattctagtttcaatatactatcccaaatcattcatacctctctcaactagatgtaacttacaaaacccctgacctcatgagccactttcttcctcctcatgaggtcagttttactttctgctgttccagtatcgtttttcctcgctagatttcctcaaaagggcagactcctcccttggtgcgtcacacgattttttcatctcgactgttctttaatgcatcattaacgacgcttttcttctaggtggttcataaggaacaggaagattcaggttgacttttctaatcctagaataaagtgctgaaaacaattcggaataggcatagagactagacaatttgaggagctgcttgcgtcctgttcgaacacattttcccaccacgtgaaga

SEQ ID NO: 241 - DNA, 1682 bp; double-stranded, linear
ccgtttttttcattgttcagtactacaacttacgttgtagcgccctgcacattggttcgtcttgttcagttttcaaaggtctttgtcacttgcttctctcaagcgacaactatattagtatatcacaactgctttcgcttgtcaacacttttttgaagatttttaagtttttttaaactttttttcatcaagtggtcctgacgcaacataccatagtccgtacgggattcgaacccgtgttaccgccgtgaaaaggcggtgtcttaaccccttgaccaacggacctgagttgttattttcaactcttactattatacagtcttttcaaactttgtcaactacttttttaaactttttttattaattttacaacagcttcagttcgagctgtatgtgggaacatatcgaccgactggatataatgaagatcatagacttctactaagcgtaccaaatcacgagccaaggtcgaaacattacaagaaatataaaccattttttctggtacataagtaagaatagtatctaataacttatcatccagacctgtacgtggtgggtcaacaatcaaagcatctgctcggtagccttccttgtaccaacgaggaataatctcttctgccgttccagcttcataatgagtattgtcaaatcccattcttttagcatttcgcttggcatcttcaatagcttctggaataatatccatacctctgagtgtttttactttctttgcaaaggcaaatccaatcgttccaactccacaataagcgtcaatcaaatggtcttctttatcaacatccagcgcttttactgcttcgctatagaggacttctgtttgctcaggatttagttgataaaaagctcgaggggatagtgaaaattcataattgagtacaccttcttgaatactctcttgcccccagataatctctgtcttttcaccatatatctcactggttttagctgtatttgtattaacagctactgtcacaacttctgggaaatctttaaccaactcttttaccaattgagttaaattaagctggcggtttgtaacaataataatctgaacctgtccggtctttctcgcgcgtcggaccataatagtacggacacctagaacttttctctcatccgtgattggaatctggtgataagtaagtaattctgctaagcgattagcaatcacttgggtttccttatcttgtaccaggcagtctttcaactctactaaatagtgagagttttgtgcatataagcccgccttgacctgatttttaaattttcgagtctgaaattgtaacttagctctgtaatattttggttcctgcattccaatagttggacgaatttcataattttcatatcctgcaggagcaaattttttcagcgcttgatgaagtaagtccgtcttgaactccagctgcttatcataatgcaggtgcatgatttggcagcctccgcattcattataaatagtacaagatggcacaattcgaaatttagacttcttgttgaccttcagtaattttgcttcaacaaagttgcgtctaatagaagtaatctgacaatagatatcttcgcctttgagagctcctggtacaaagactaatgttttttggtaaaagccgattccctcaccgttaattcccatgcgcttgatttttaatggtattttt

SEQ ID NO: 242 - DNA, 2524 bp; double-stranded, linear
ttaactttggtcaattctttaaagtcatcctctgtaagcatgtctaaccattgatgtttccctttattgctaaaatcaccaattccgactacagctatatctaaatctttccaactatttttcaaattttcaaaatatcttgattgcaaaataccatctgctaacaatttattttcttgcacaatcgttgcattcataaatgtacactctccatgaaattttctagacatttcataaatcagtgtattcacatggtatttagcgtgtatgtgactaggaccacctgctagaggatagaagtgaacatttcggacacttttactgtgaattaaatctactaaattacttaaacttttcccccaagaaaagccaattttcatattatcatcaattagattcctaaggacgcctgctgcaacttgagaaattctttcagataaaattgttggagtatcatcaaattcatttggaataatttctaaactttccaaactgtatttttcttttacataattttccaacttaaacatattggtatcaaaattctctatttcaattttaacaattcctacattccttgcttctgttaacattctactaatagaggttctataaattcctaattttgctgctatttgtgactgatttaagttttcaatataatacagataagcaattttagaaagcagtttattcctatcttgattcatacacttaacctcttacgaaactaccttaaccattatcccagcattttctaatgtagctatattttgtttagaaagtttttcgtctgttattacttcatagacttgacttaaagcaaatcttcttactgtacctcttttatcaaatttacttgagtcagttaggacaatgactttatccgacactgctgaaatatattgaactacctcactgcgcattaaatcttttccggtaaagcccatctctttatcgtaaccatctgtcccaacaaaagcttgacacacatgaaaagtctgtatcatttcttttaataaaggtcctacagtcacctgtgaatctttctgaaactcaccaccaagaacaataacacgacatgaatcataagctctcacaaaatttgctataaaaaacgaatttgttacaatcgtaacatttcttttttgcttgcaaatttcctcagcaagtaaagcacaggtcgatccagattctatcattattgtttcattatctgacaccaattttactgcttcctgaacaatttttctcttagtttcataattaattgacaaacgtacatttaagtcatctccactatttaatacagcatatccatgctctctgtgtaataaaccttttgactctaatttatctaaatcttttctaatcgttactttcgatacatttaatttttccgataatgtattaacgtcgatcttttcatattctgatactaatttaataatttgttccaatcttttcattttacacctccgttttattctaccaaaataaaaagcaaaaaacaacaaattaacctttcgttcgtaattgtttttctttcgtttttgtgataggatagacttatgaagaggaggaactcttatggaaatatctaaaggaattatttttaatattcaacacttttcaattcatgacggtccgggtattcgtacaactgtttttttaaaaggatgtcctctgcgctgtccatggtgttctaatcctgaatctcaaagaatgaaacctgaaaaaatgaaagatgctcaacgagagaaattcaccttagtcggtgaagaaaagactgtagaagaaattattacagaggtattaaaagacaaagaattttacgaagaatccggtggaggtttaactttatcaggaggtgaaatatttgctcagtttgaatttgctaaagccatcttaaaatcagctaaagaacatcacatacacactgccattgaaactactgcctttgttgatcatgaaaaatttattgatttaattcaatatgtggattttatctacacagacctaaaacattataattctataaaacataaaaaagtgactggggtttttaatcaaatgattattaaaaacattcattatgctttttcacaaaataaaactatcgttttaagaatcccagttattcctaattttaacaatagtttagaggatgcagaaaaattcgctactctatttaactcattaaatatcgaccaagttcaactactcccttttcatcaatttggtgaaaacaaatatcgtttattaaatcggaaatatgaaatggatggaatcaacgcacttcatccwgaagatcttattgattatcaaaaggtatttctgaaccaccatattaattgttatttctagtttatttccttgaaatgctctagctatttgcagataacaagcatctataatacatacttaacttttcaaaaggtttagctaaaaaattttagccaaaccttttctattttaccttgctctagaatttttaaactgctatacttatcacaaaaaaacg

SEQ ID NO: 243 - DNA, 2359 bp; double-stranded, linear
cgtgcttgggggcttgtggtcaaaaggaaagtcagacaggaaaggggatgaaaattgtgaccagtttttatcctatctacgctatggttaaggaagtatctggtgacttgaatgatgttcggatgattcagtcaagtagtggtattcactcctttgaaccttcggcaaatgatatcgcagccatctatgatgcagatgtctttgtttaccattctcatacactcgaatcttgggcaggaagtctggatccaaatctaaaaaaatccaaagtgaaggtcttagaggcttctgagggaatgaccttggaacgtgtccctggactagaggatgtggaagcaggggatggagttgatgaaaaaacgctctatgaccctcacacatggctagatcctgaaaaagctggagaagaagcccaaattatcgctgataaactttcagaggtggatagtgagcataaagagacttatcaaaaaaatgcgcaagcctttatcaaaaaagctcaggaattgactaagaaattccaaccaaaatttgaaaaagcgactcagaaaacatttgtaacacaacatacagccttttcttatctagcgaagagatttgggcttaatcaacttggtattgcaggtatctctcctgaacaagaaccaagtccacgacaactaacagaaattcaggaatttgttaagacctataaggttaaaacgatttttacagaaagtaacgcttcttcaaaagtagctgaaactcttgtcaaatcaacaggtgtgggtcttaaaactctgaatcctttagagtcagacccacaaaatgacaagacctatttagaaaatcttgaagaaaatatgagtattctagcagaagaattaaagtgaggaaagaatgaaaattaataaaaaatatctagcaggttcagtggcagtccttgccctaagtgtttgttcctatgagcttggacgttaccaagctggtcaggataagaaagagtctaatcgagttgcttatatagatggtgatcaggctggtcaaaaggcagaaaacttgacaccagatgaagtcagtaagagggaggggatcaacgccgaacaaattgttatcaagattacggatcaaggttatgtgacctctcatggagaccattatcattactataatggcaaggttccttatgatgccatcatcagtgaagagctcctcatgaaagatccgaattatcagttgaaggattcagacattgtcaatgaaatcaagggtggttatgtcattaaggtaaacggtaaatactatgtttaccttaaggatgcagctcatgcggataatattcggacaaaagaagagattaaacgtcagaagcaggaacgcagtcataatcataactcaagagcagataatgctgttgctgcagccagagcccaaggacgttatacaacggatgatgggtatatcttcaatgcatctgatatcattgaggacacgggtgatgcttatatcgttcctcacggcgaccattaccattacattcctaagaatgagttatcagctagcgagttagctgctgcagaagcctattggaatgggaagcagggatctcgtccttcttcaagttctagttataatgcaaatccagctcaaccaagattgtcagagaaccacaatctgactgtcactccaacttatcatcaaaatcaaggggaaaacatttcaagccttttacgtgaattgtatgctaaacccttatcagaacgccatgtggaatctgatggccttattttcgacccagcgcaaatcacaagtcgaaccgccagaggtgtagctgtccctcatggtaaccattaccactttatcccttatgaacaaatgtctgaattggaaaaacgaattgctcgtattattccccttcgttatcgttcaaaccattgggtaccagattcaagaccagaagaaccaagtccacaaccgactccagaacctagtccaagtccgcaaccagctccaagcaatccaattgatgagaaattggtcaaagaagctgttcgaaaagtaggcgatggttatgtctttgaggagaatggagtttctcgttatatcccagccaaggatctttcagcagaaacagcagcaggcattgatagcaaactggccaagcaggaaagtttatctcataagctaggaactaagaaaactgacctcccatctagtgatcgagaattttacaataaggcttatgacttactagcaagaattcaccaagatttacttgataataaaggtcgacaagttgattttgaggctttggataacctgttggaacgactcaaggatgtctcaagtgataaagtcaagttagtggaagatattcttg

SEQ ID NO: 244 - DNA, 1052 bp; double-stranded, linear
ttctttctgctataatcgtataaaatacttactttaggagttcttatgaaagttgttaaatttggaggtagttctcttgcctctgctagtcaattagaaaaagttttaaacatcgtcaaaagcgattcagagcgtcgttttgtagtcgtttctgcgcctggtaaacgcaatgctgaagatactaaggttacggatgccctgattaaatactaccgcgactatgttgcgggtaacgatattagcaagaaccaaagctggattatcgaccgctatgctgctatggttagtgaattgggactaaaaccagctgtgctagaaaaaatttctaaaagcattcacgccttggccactcttcctattgaagaaaatgaatttctctacgatactttcctagcagccggtgaaaataacaatgccaaattgattgctgcctactttaaccaaaatggtatcgatgcacgctatatgcaccctagagaagctgggattgtggtcacaagtgaacctggtcacgctcgcatcattccatcaagttatgacaagattgaagaattgacaaacaccaatgaagtccttgtcattcctggtttctttggtgtcactaaggaaaatcaaatctgtactttctcacgtggaggttctgatattacaggttctatcattgctgctggtgtcaaagctgacctctatgaaaactttacggacgttgatggtatctttgcagcccaccctggtattatccaccaaccacactcgattcctgagttgacctaccgtgaaatgcgcgagttggcctatgcaggcttctcagtccttcatgacgaggctcttcttcctgcctaccgtggaaaaattcctctggttatcaagaataccaacaaccctgaccatccaggtactcgtatcgttctaaaacacagtaatgatgaatttccagttgtgggaattgctggtgactcaggctttgtcagcattaacatgtcgaaatacctcatgaaccgtgaggttggatttggccgcaaggttctgcaaatcctggaagaacttaacat

SEQ ID NO: 245 - DNA, 855 bp; double-stranded, linear
ccctcgaaaactaagccgatgaagtcagaacacttcaatcctgttcgtgactggtgggaaaatcgtgaagagattctggaaggtaagttctacaaatctaaatcatttacacctagtgaattggctgagttgaattataatttagaccagtgtgactttccaaaagaggaagaggaaatcttaaatccctttgagttgattcagaattatcaagcggaaagagcaactttaaatcataagattgataatgtattagctgatattttgcagttgttggaggacaaataatgacaccagaacaacttaaagcaagtattctccaaagagcgatggaagggaaattagtgccgcaaaatcccaatgacgaacctgcaagtgaattattaaagagaattaaagctgaaaaagaaaaacttatcagtgaaggaaaaatcaaacgagataaaaaggaaactgagatatttcgtggtgatgatgggaaacattatgggaagtttgctgatggaagcactcaagaaattgatgttccttatgatattcctgatacttgggagtgggtgaggataaaatcaatttattggaattttgggcaaaataagccagagaaatcctttaggtatatagatacgtctagtattgatagaaaaaagaacataatcaactacaaaaatctacaatatctttcacctgaacaagcgccttcccgtgctagaaaattagtttcgcagaatagtgtcttattttcaacagttagaccatatctaaaaaatattgctgtagttagagaacttaaagagtatttgatagctagtacagcatttaatgttttgggatactttacttaacgaaacatat

SEQ ID NO: 246 - DNA, 660 bp; double-stranded, linear
tttaggaaggctatccgtaattttacaaaggatttagatattacagaggaacatttagatattatcaaaagagagatgtttggcgaatttttcagtagcatgaactctcttgaatttattgcaacgcaatatgatgcttttgaaaatggtgagataatttttgatttgccgaaaattttacaggaaattactttagaggatgtccttgatgctggacatcatttaatagatgatggtgacatagttgattttacaatattcccatcgtagtaacctattataatagacactagaaagaagggatgacaagtatgagaaaaaaaacaattggagaggttttacgattagctagaatcaatcagggattgagtttagatgaattgcagaaaaagacagaaatccagttagatatgttggaagcaatggaagcagacgatttcgatcaacttccaagtcctttttacacgcgttctttcttgaaaaaatatgcatgggctgttgagttagatgaccaaattgttttggatgcttatgattctgggagtatgattacttatgaggaagtagatgttgatgaagatgagttgacaggtcgtagacgttcaagtaagaaaaagaagaaaaaaacatcatttttacctttattttattttatcctgg

SEQ ID NO: 247 - DNA, 1805 bp; double-stranded, linear
ccggttgcacaggatcgtgcatagtcaactcttcaagtatagcatatctcctattttcttacaagtaataacacctaaaatgaagctttttcttttacttttttctgccaagaggcaaaaagcatgctgaggtaaaaaacgctcatcataataggaacaccaagaatggtcttttcatgatagaaaatcgtcaaataggctgaaaagacaacgccaaggacaaaactactaagcaggctaacaaatatgaatccttcacgcaaaaaaggagtgtgcttggttcggaaataatctccaaaagccagcatggtccgtttgatattccctgtcataaaagcgttattataggcaatacccgacacttctccaaaagcagttgtcaccagtcccatacagaaggccaagggcggcactagatagatattatccacagtttgcggcacaaaagcaataatgattgataagattgccaagggaatcaaggacagaataggttttttcacaattctcaatttttccttataaatcgttaataaaaagactcccatcataaacgctagcaaggtgagaaccttgtccctaacatccgaaacattatttttaattaattctactgaaagaaagacaacatttccagtttgtccagctacaagggtattcccgcgaacaataaaagtgtaagcatccacatatccagcacaaaacgtcaaaaaaagtgctaaccttttagactgacgtgatatttttcttataggtaataacctcattttacctcccattgtattttctcttagaaatattgtaccattttctttctaaaaaatcgtaggctaccatttagattttactattagcataaaaataataatagacaactatttatccaaaaatagatagatgtaacatgtttgcaaacaaagcatacgaacctttagtaaaatcatttccatgaaactagaatagagccctcttagcaaaaatcattattttaatttatttctaatcactccttgacataaataactctcaccaataaaagactatgtcttaaaaaaatggtataataaaatcaatacttgggcttgatggctatgctactaataacaattaggagagaaaatcaggcacttgttaacaacaaggattatccccttgagatgaaaggaactttagaaatcttatgatgaacatgcaaaacatgatgcgtcaagcacaaaaacttcaaaaacaaatggaacaaagccaagctgaacttgctgctatgcaatttgttggcaaatctgctcaagatcttgtccaagcgaccttaactggcgataagaaagttgtcagcattgatttcaatccagctgtcgttgacccagaggaccttgagactctttctgatatgaccgttcaagccatcaactctgctcttgaacaaatcgatgaaactaccaagaaaaaactgggtgctttcgctgggaaattacctttctaaaaacaaggagctagaacaatgcttgtcgataacaaaggctaagaaaggtgcaaaaatgactctataatatttgtagtgggtaaatcccctatggatattatggagcctatttttgtgtagaaaaaagtcccatatgacctataatgaaaagcgacaaaacaactcattagaaagaatcatatggaacaattacattttatcacaaaattactagacattaaagaccctaatatccagattttagacatcgtcaataaggatacacacaaggwaatcatcgccaaactggrctatgaagctccatcttgtcctgagtgcggaagtc

SEQ ID NO: 248 - DNA, 2516 bp; double-stranded, linear
ctgcatctagtttgtttctccctacagttttagctagacagattggagattatgatttaacgtcgccgcgttggggttcggatacaactagtgagcttgagaaagaaaactcctctgctggaattaataataatgacagcactggtggcggtaaaaggttaaatacctctattcgtagcgcctatagtgggtcagatattaccccggtatattcattggggtctggctctaggattgtcatgtactataatggaggtggtgacaattatattggttctggtactagattagctatggcgccacaatttggaaatcatgtaagaattcatacttcaggttcttggaatccagattcttattaacttacttgtcagagtaagccttaaagatggttgattgtgggtgtagcatgaaaaaagaatgctacaccctatttttattataaggaggagtaaggatggaatttttcatttgtaatcttgtacgagtcgttcaatcacctcgattttatatgtctttatttttgacccttctttgcatgagtttaggaaatttccttgctttcaatggtatttataaaattgaaggtttatcgattttttttgccgcttcttctattcgaggattttcaccgattagcctagtagctgcacttatctgtacactgccctattctagtcagataatagaggatgctgagagtcattttctaacagcacaattgtgtcgaatttctaaaaagaagtatctggctattgtgggtagtactgtaattatttcttcttttctagtcttttttctcccctatttattattattaggaattaatcttttagtgactccttatcaggaaatttatattggagattatagtggtgccttaaaagaattatttgattccaatcagtttctctatagtcttgtaacgactctctggtatggagtttggggcgctgtgttctctatttttggactagctagtgctttgctagtgaagaaaaaaataggagctattttcatcccagttgcctatatgatggttggtggtattttttgggctattttagggctatcttacttagaacctgtgacaacgctagctttgggatatcagaaagatatcagtctttccttagttagtgctcatcttgcttttattttatttgttagttgtttggttgtttatggtacattttttctacattcagaggactatgtataatgaaacaatttgttcaattttataaaaaagatttcttagcagtattggtttattttatattactgctatcctgtgttttatctagtacagtatatttattgcgctgtcgccaatattcaatccatccaaatgtattagaatggatcttagttttacttcaagatatgacgactggagtatattgctttccgttcacatatatattgttctttttttatttgatgaataactattttaataggttggagtgtcgcattcgtctgaaatcaattaagcactttaccagttttagtttcaaattagcagctcttagtacggggatttggacggcgactttatttttattgatttttctaattgcatttagtaatggttttagcttctctttggagataaaggaggttgattttttaagagaattttatggtataagtattgcaaacaatgctagtttctttataggattttttttctcttatatagcatactatttctttttatccttacttactattagcagtttttcttggtttaaaaaatcaaacatgagcttagtatttctgtttacttttttatttgtagaatccttattctggatttatcagttggacaatgggataattggattattgccaatttttcagtatatggtaaattccaatccgtatgcattgatttattggcttacattactatctatcataattccattgactgtattttctgttcatagaaactggaggagagtgtaaaagttggaaatgggaaagttaagtagtcacatgtggaggttgaatcagataatctataccaagtacttttggggttatgttcttttttggatattgatttgtttaggattatggtattggttagaaggaaatgatagacttgttatagaaattttaaaagggcctaatctgagtcaaaactcttttttagtcttatctatatggttgcttcattggtttattattcatacattttttctagcagttgtatatcgtagaagagcatccgatttctttatggaagtgattcgattttcttctattaagctctggattaggtatcagatttggacctgttttctttatggactcattttaatcatggtaaaagttctagtgattcaatttatgttacagttaccaaactgggatataggagttttgtttatagttgattctttgaatgcttgtgtgttagtcttgttttgctttatgttatacgcactaggagcgaatgtacaaatgaactttgcttgcgttagtttctttttactcatgattgg

SEQ ID NO: 249 - DNA, 1364 bp; double-stranded, linear
cggtgtttttttgtaaattttctagcacttgtatggtaaaatagatacaggtgttcattaaactagactaaaaacctatttaagcaggcaaaatgaagaaataccaacaattatttaagcaaatccaagaaaccattcaaaacgagacttacgctgtcggagatttccttcctagcgagcacgaccttatggagcaatatcaagtgagtcgtgataccgtccgaaagccctgtctctcctccaagaggaaggattgatcaaaaagataagagggcaaggttctcaagtcgtcaaagaagaaaccgtcaatttccctgtatccaacctaaccagctaccaagaactagttaaagaacttggactgcgctctaaaaccaacgtggtcagtctggacaagattattattgataaaaaatcctcactgataaccggtttcccagagtttcggatggtttggaaggtggtccgccagcgtgtggtggatgatctggtatccgttctggatacggactatctggatatggaactcatcccaaatctcactcgccaaattgctgagcagtctatctattcttatatagaaaatggcctcaaactccttattgattatgctcagaaggaaatcaccattgaccactcaagcgaccgagacaagattctcatggacattggcaaagacccttatgtcgtttcgattaaatcaaaagtctatctccaagacggacgccaatttcagtttaccgaaagtcgccataagttagagaaatttagatttgtagattttgcaaaacgcaagaaataaaagactgagacaccagatctcagcctttttcggctctataatatttgtagtgggtaacccccctatggatattatggagcctattttgtgtagaaaaaaagtcccatatgacctataatgaaaagcgacaaaacaactcattagaaagattcatatggaacaattacattttatcacaaaactgctcgatattaaagacccaaacatcaagattctagacatcatcaatatggatacccacaaagaaattatcgctaagctggattatgaggctccatcttgccctgattgtggaagtctaatgaagaaatatgactttcaaaaaccgtctaagatcccttacctcgaaacaactggtatgcctactagaattctccttagaaagcgtcgtttcaagtgctatcattgttctaaaatgatggtcgctgaaacttctatcgtcaagaagaatcatcaaattcctcgtattatcaaccaaaaaattgcgcaaaagttgattgagaagatttctatgaccgatattgctcatcagctggccatttcaacttcaactgtcattcgg

SEQ ID NO: 250 - DNA, 1227 bp; double-stranded, linear
ccatgaagaccgcttggaattggaatggcacaagtctttgttgaatggtctattcccattgacaatcggtggaggaattggacaatctcgtatggccatgttcctacttcgcaagagacacatcggagaagtgcaaacaagtgtttggcctcaagaagtccgcgatacttacgaaaatattttgtagagaatcgaaccgcaaggttcggttttctttctctttttgtctataatttggtataataaacagtatgaaaatcgtatcaggaatctatgggggacgtcccctcaagacactagaaggcaagacgacaagacctacttcggataaggttaggggagccatttttaacatgattggtccctactttgaagtgggacgagtcttggacctttatgcaggtagtggtggtttatctatcgaagcagtatcgcgtggcatgtccagtgctgttttggtggagcgagaccgtaagctcagaccatcgtggctgaaaatatccagatgaccaaggaagttggaaaatttcaactcctcaagatggatgcagaaagggcattggaacaggtatctggggaatttgacctcgttttcttagaccctccctatgccaaggaacaaatcgtagcagatattgaaaaaatggctgagagagagcttttttctgaagatgttatggttgtgtgcgagacggataaagccgttgaacttccagaagaaattgcctgtctgggtatctggaaggaaaagatttatggaattagtaaggtgacagtctatgtcagataagattggcttattcacaggctcatttgatccgatgacaaatgggcatctggatatcattgaacgggcgagcagactttttgataagctttatgtgggtattttttttaatccccacaaacaaggatttctccctcttgaaaatcgtaaacgggggttagaaaaggctgtgaaacatttgggaaatgttaaagtcgtgtcttctcatgataaattggtggtcgatgtcgcaaaaagactgggggctacttgcctagtgcgaggtttgagaaatgcgtcggatttgcaatatgaagccagttttgattactacaatcatcagctgtcttctgatatagagactatttatttacatagtcgacctgaacatctctatatcagttcatcaggcgttagagagcttttgaagtttggtcaggatattgcctgctatgttcccg

SEQ ID NO: 251 - DNA, 3652 bp; double-stranded, linear
ccggtcaagttaaaaacgctatttcttcccattttatttattttttaggagtggtaacgtatcaaaatagcccaagcgttctcacccgtgtgagtttgaataatggaacccgtttccaaaacagaaattggcttttcaacataagcttgtaagctttctttcatctcttttgcccaatcatcactaccagaatatgaaattccaatctctgctacagcacgttcagaaagcgatgttatcaactcatctaaccattttttaaatgttttagttccacgacctttaaccattggctgcaattcatggtctttcatttgcatgacagcacggatattgagaagagagctcaacaagccagttacacggctaattcgtccacctttgacaagattttccaaagttgaaacaccaatataaagctctgtatggtttttaacctcttctacatgagataaaattgcctccatatctttaccttcttgagctaacttcgcagcctcaacaacttggaatttcagggcttggtcagtgaaggaactatcaacaacagtcacatctgcagtagataggctagcaccttggcgtgctgcttctaccgtacccgaaagagcatgggacatatgaatagcaagaatctggccaccatctttgcataggtcttcaaaaatctcagcaaagacacctacaggtggctgacttgttttcggaagattcttactttcttgcatcaactgaagaaatttaccttcttctttcaaatccgcatcagaataaacaacattatcaatcattacagataatggaacaattgtaatatctaattgctttactagttcaggttcaatagtaacagatgaatcggttacaatcttaatttttgtcatagtatcaatctttctattttaggattcagattggtttccttacttctaattatatcaaaaaaaagattaaaaatcctaatggagtcaatcaaattttccgtaaaatttgatataatcaacttataagaaaagaggtgtcctatgattaaaaaaatttaccccatttttaccattttactaggtgctgctatttatgcttttggactgacttattttgtagttccccatcatctctttgaaggaggggcgacaggcattaccctcatcaccttttatctttttaaaatccctgtttccctcatgaacctgctgattaatattccccttttcatcctagcttggaagatttttggagccaaatccctctattctagtttactaggaaccttagctttgtccggctggttagctttttttgagcatattccccttcatattgatcttcaaggtgatttactaatcacagcccttatagcgggaatcctattgggaattggccttggaattatttttaatgctggaggtacaactggcggaactgatattctagctcgtattctcaacaaatacactcatatatccataggaaaactgctctttatcttagatttttgtattctcatgttgattctcctaatcttcaaggatttgagattggtttcctacacgcttttgtttgattttattgtttctcgtgttattgatttgattggtgaaggaggatatgccggcaaaggctttatgattatcacaaaacgtcctgaccaacttgctaaggcgattaatgatgacctcggaagaggtgttacttttatttctggtcaaggctactatagtaaagaaaatttgaaaatcatctactgtattgtcggaagaaatgaaattgtgaaaacgaaggaaatgattcatcgaatcgatcctcaagcctttataactattacagaagcccatgaaatcctaggagaaggcttcacctttgaaaaagaataaaaagaggtaatgtcgtgacctcaaaagttagactaaatcatctatcttttgggttacagacaacctcttttttattttatttactcaagctcttaagaccaattccgagttacttcttcatcagcctttaactgatccactaattggtcaactgagtcaaatttggtcatatctcgaatgcgatcaagccaataaaccatgacggtttccccataaatatcttgattaaaatcaaaaatattgacttcaaaacgtgcttcttctccatcaaaggtcacatttttcccgacactagccatagcacgatacttctgtctttgaatctcaacatcaacaacataaacgccatctgctggcatataagtacggtctaaaagcactaaattcgctgtcggataaccaattgtacgaccacgagcattaccatgaaccaccatacctcttgatggaagcggtgcccccaaaagttttcctgcttctttcacatttccatctaaaatagcttgacggatacgagttgaactaatctttcctttctcatcttctacaggtggaacaatgataacttctccatcaaagtaattctttaaatcttctgctgtttttttgtcagaaccaaatgtataatcaaaacctgcaacaataattttggcattcatagccttgatataagttgcaaagaattcttgtgcagtgagactagcgaattgactactaaaatcaaggagatataattcttctacaccttcgcgctttaattttctttcacgttcagcagggttcaaaatatgcaaaaacaaatctggatgataaggctctaaagcgatctttggagattcattaaaggtcataacgacgataggcaacaaatcctttctcgcagccttgttggcaacacgaaataattcttgatgccccttatgtatgccatcaaaatagccgagaacaacgactgaatcagatggtgtgccaatatctttttggttttttataggaatagtaataatcataaaataattatatcatagcgatagctatttctggaacagaaaatctgaaatgttgtttttttcacatgaagtgtacctgttttcaaaaagcactttattctatcgttgcttaactatgaactttgcaatattcttctcaaaaacttgtaggacatcttcaaaattttgcaaggagtgattagacttgttcggtaaccataaagtgtcatactatgcttatgtatgaaaaagcaatgcaactaactcctgagaactttaaattactaattggtgccgaaaaggtagaatttagaatcgaggtacacctatggctgtaaaatttacaaaatgagacaacttgggcaagatgtttgaagaatttcctaaactccctgatttgaagcaagtcactttccctaatgacaaagaaaaaagccaaaacagcaaagaaaaactagatgactgctttccaacaactcccatctagtgtgcttcagactgggctatttttctctccatctgttagcttggattctcagaccgtttcagctaaagaatatcttttcccttatcagaaggaacggctcaagccattcagacaagtgaagggacgacaagccaatatttgaaaccagatagcagttcttatagtcaattgaaataaaatctgaagaaatcgagtaggaaactcatatcaatgtttaacagtgttctattccagattcatactcaatgawaattaaagtgcaaactaggaagttagccgcaggtgatactttgggtacggca

SEQ ID NO: 252 - DNA, 743 bp; double-stranded, linear
gtaccgtggtgccaaagtacagcaaggttggctttttgacaaacaataccaatcttggttttacatcaaagaaaatggaaactatgctgataaagaatggattttcgagaatggtcactattattatctaaaatccggtggctacatggcagccaatgaatggatttgggataaggaatcttggttttatctcaaatttgatgggaaaatggctgaaaaagaatgggtctacgattctcatagtcaagcttggtactacttcaaatccggtggttacatgacagccaatgaatggatttgggataaggaatcttggttttatctcaaatctgatgggaaaatagctgaaaaagaatgggtctacgattctcatagtcaagcttggtactacttcaaatccggtggttacatgacagccaatgaatggatttgggataaggaatcttggttttacctcaaatctgatgggaaaatagctgaaaaagaatgggtctacgattctcatagtcaagcttggtactacttcaaatctggtggctacatggcgaaaaatgagacagtagatggttatcagcttggaagcgatggtaaatggcttggaggaaaaactacaaatgaaaatgctgcttactatcaagtagtgcctgttacagccaatgtttatgattcagatggtgaaaagctttcctatatatcgcaaagtagtgtcgtatggctagataaggatagaaaaagtgatgaca

SEQ ID NO: 253 - DNA, 4010 bp; double-stranded, linear
ttttggttgatgatacgagggatttggtgattcttcttgacgatagaagtttcagcgaccatcatttttgaacagtgatagcacttgaatcgacgctttctaaggagaattctagtaggcataccagtcgtttcaagataaggaattttagaaggtttttgaaagtcatatttcttcaattggtttccgcactcagggcaagatggggcgtcgtagtccagtttggcgatgatttccttgtgtgtatccttattgatgatgtctaaaatctggatattagggtctttaatgtctagtaattttgtgataaaatgtaattgttccatatgattctttctaatgagttgttttgtcgcttttcattataggtcatatgggactttttttctacaataaaataggctccataatatctatagtggatttacccactacaaatattatagaaccgaattaatttaattagagagccaactttctaatatagtaatcgcgtcataacaaggtatctatcattcatggagttcctcctgtatactattagtaaagtaaaactattggaggatattttaatgccacaacctattgttcctgtagagattccacaatctcgtcgttttgattctaaaaagagaaatgatattctgcttaaaattcgtattggcaagcttgaagtaagtttttttcaatctctcaatctcgaaatggtagaacagcttttggataaagtgttgctctatgacaattcatctatctagcctagggcaggtctatctcgtatgtgggaaaacggatatgaggcaaggcattgattcattggcttatctggttaaaacccactttgaattagatcctttctccggtcaagtttttctcttttgtggtggacgtaaagaccgctttaaagccctttactgggatggtcaaggattttggctactatataaacgctttgagaacggaaaactgacttggcccagtacagaaaaggatgtcaaagctctcacacctgaacaagtagattggcttatgaagggcttttctatcactccaaaaataaatttatcagaaagtcgtgatttctattgaaatgaggactttctttttagttataataaagttaggaaataaggagaggaagcccatggaagaagattgaaaatcattcaacaacagagtgctacaattgatagtctcaccaatgaacttgcccttcttcgtgaacaagtggcttatctaacgcaaaagctctatggaaaatcctctgagaaaagtgtttgcccatctggacaactcagtctttttgaagaggaacaaaatatggaagaagactctgacttacccagttgaaagagaagaaatcacctataaacgtaagaaagctaaagggaaacgtcaagctcttcttgcccaatttgattcagaagaagttcatcatcaagtagaagagagcatttgccctgattgtcagggagatctaaaagagattggagcaacccttcaacgacaagaattagtctttattcctgcgcaattaaaacgaatagatcatatccaacacgcttataagtgccaagcatgcagtgataaaaatccgagtgataaaatcgtgaaagctcctattcctaaagcccctttggcgcatagccttggctcagcttctattatcgctcacaccatccatcagaagtttaatctgaaggtacccaattatcgccaagaagaagattgggctaagatgggtttaccaatcacacgtaaggaaattgctaattggcatatcaaggcgagtcaatactatttggagcccctttataatcttttacgagaaaagttgttagaacaagctcttcttcatgcggatgaaacctcttatcgggttctagagagtgatagtcagttgccttactattggacttttttgtctgggaaagctgagaatcaagcaatcacgctgtaccaccatgatcagcgtcggagtggtttagtagtacaagaattcctaggagattattctggctatgttcattgtgacatgttgcggcagtaacttaggactttagtcctctagttctgcctatgcgatagcagtccaaggtttaggagtaaggcgacgctaagcttggtaaactgcgaacagctagaagcttatcgtcaactggaagaagctgcacttgttggatgttgggcgcatgtgagaaggaagttttttgaagtgccccccaagcaagcagataaatcatccttaggagctaaaggtttagcttattgtgatcagttattttccttggaaagagactgggaggctttgccagctgatgaacgactacagaaacgtcaagaacatctccagcccctaatggaagacttctttgcttggtgccgccgtcagtcagttttagcaggttcaaaactaggaagggcaattgaatacagcctcaagtatgaagaaacctttaagactattttgaaagacggacatctggtcctttccaataatctagctgaacgcgccattaaatcattggttatgggacggagtaaaagagtccagtggactcttttagcctgagctcagtttaaaaaagcgagggtggttattttctcaaagttttgaaggagctaaagcaagagctattgttatgagcttgttggaaacagctaaacgtcatcaattatagtgcgttgaatctataacagtacgcatcgactgctaaaacatttctataaatcaattttcctttcctaatcgatttgttcatatcttatttcaatccattataaatagcgagaaatatctatcctatcttctagaatgtcttccaaacgaggaaactctcgtaaacaaagaggttttagaggcctatttaccgtggactaaagttgtacaagaaaagtgcaaataagaaatctccagattaggaactatccgtgagttctctagtctggagatttttcaatagacttcgttattggacggttacaatttattatatgaaaatcccatattattctccaattctatattttacctttctaaatgtatagattaactacctaattatagcatataacgcagattcctttcaatcgtatgatttactgcattaaattaagtaaaaaaataaaggcagtccgaagactgccgatatttatctctcatctctttaattatggtaagtaaataaataatttccctaaagatatggaaattattaatactataaatacatattataaagtttataaatactgtaaaaatcctgaagttaattttctaataaatatcaatatgtgttagtatcttttaaatttttagacaatttactagttctatagacatgtttaacagactctattttacaattcaaaaatttcatctgccacttcatttaaaaattctatatcatgggaaacaataaaaattattttatccatggttttatacttattaatcagttcagatatttttatcatattggaataatccataccacttgaaggttcgtcaaaaaagacaaatggagaattcttgcacataacagatgctattgcaagcctttgcttttgccctcctgataaactcatcggatgcctttcaataaattcgtccaggcataaatcttttaacccaaatcattcatacctctctcaactagatgtaacttacaaaacccctgacctcatgagccactttcttcctcctcatgaggtcagttttactttctgctgttccagtatcgtttttcctcgctagatttcctcaaaagggcagactcctcccttggttcgtcacacgattttttcatctcgactgttctttaatgcatcattaacgacgcttttcttctaggtggttcataaggaacaggaagattcaggttgacttttctaatcctagaataaagtgctgaaaacaattcggaataggcatagagactagacaatttgaggagctgcttgcgtcctgttcgaacacattttcccaccacgtgaagaaaaagatggcg

SEQ ID NO: 254 - DNA, 2789 bp; double-stranded, linear
atgcatccgtttgtcaagcctaaattgtaatttttttcaatttaaaacagaaaaacccaggaaaatgacataaaaatatcattcctaggcctatttatgctatttctctctgaaaaatatgagtattcagtcggtcaaatgaagctgaacgaactcattttccctcgcctaattcaatgattcgatgacattgttgggctacataagcatcgtgggtcacgataatgactgttttcccctctcgattcatctctaagagaaacttcaagaccaaatctctattttcaggatccagagaacctgtcggttcatcggctaaaatcagctggctgggttttaagatggctctagcaactgcaattcgttgttgttcgcccccagacaactcggagaccctttgatgcaaagtagctgataaacctactctctctaaaatctcttccacctttttgagcttgtctttcttaggcaatttcacatatttcagcgccacatgagattgtactcgaccgtttcatcatcaatcagggcaaaattttgaaacagataagagatatgttcacggattattgtttgcgacttagcagaattaaccgctagatttgtctgaccaaaaatctcataccgtccgctataatcaccatctatcaaacccaataaatttaacaaggtcgacttcccactaccactcttaccaacaatagctaccaaatccccctgatcaatcctgagagataagttatccaaaatcacttttcccccaatggttttggtaatatttttcaactcaatcataagatgccccctttcaataactctactagacttcttttctccatcctagaagctaagcctagcacaaatagtatatccagacatgtaaaacctgcaaacagtagaagtggtaagaacgcatgggcaaagaaaatcaagactagaagagggaaactatagcccagcaagagcagaacgaggagaggacggtagcgatcgaccagtttccaccccataaacttcttggtaatgatatccctgcgcttcaataagaaagttgttactagtaagaagtaggaaatcatcatgctaaggagaccaaacaaagcaaagagtaggttaaaattccgaacagcatctcgataagaatccactttctcttgttgaatggcttgaatagatgaaaattttaaataatttccatctgacaatttctcaactaactctgtaatctctttttgatgttgaaccgtattttcaattttaatcggattatttaagccagttgttgacagggaggctttctcatcccacatcatatcagaatcattgaccaagctaataattggattggagagattttcctttcgcttatcactatatgggaaaaatgaccaatctccttcataataggcaatctcgacatccatctcctctatcgttcgtttttgctgctcttcatacttcatcgaatgaaaggcaattaacttccccaagagctgatttttatcttcttcacctttcgtacttgctggcatcaaaataacttttttaataccggtatttggtagcttgaatcccttgctctttagaaaattgcgattggcatagtaaacatccaccgtatctgttaactgatattgctgaatctgttctgattggacaaaattttttacaggaagactgctactctgcacatagcccgcctgcgttttttctaccaaatcctgataaaatcgatagaaataatctgtagatttccctgaccctgctagctcttcttgccacagattatcattgagtttgaaggtttctaaggtcaggtaattaccttgacttacccactgttgctgataagcaagttctttgttttcttgttctaaacttctgcccaccccaatcagtaaggccgtcagtaaaatagttgtccctattttcatcacataattgaagataagaccaaatttgaaagatgaaaaacctttcagcagagagctgattgtcattttttggattaagaggtaagtcaaccaactgataaagagataaagctgcaacagcaaaaaatgagacaaccacagcataggaaacaaatcttttggcttataatcaagcaagaaaaacacgcctagattgatcacaagagccccacctaggaggaggtaaaggttgccttttacaacatcagctaaaacagccctatcttgaaaaccaagtaatttttgtaccccaactcttttcatctccatcatcggttgatacactgtcactaacacaagaagcaaaatagccaagacaaaaacaatggcagataaaagcaaatctcgatttatgacttccactgcacttttgtaggtcggctctagcaaggtagcctggtctatcttgaaaaaatcgctccatttctgtacaatcctatccttgtccatctcttgtgtagaagttatcgtatagcgaccatttaaactacgagatgtatccttgatataggtttgaaaagtcataagctgaataggtttggcttttagaaaggtcggaatcgtaccaagtttattggaaatttctttattactatagactccttcaccatctgtggtaaaatcaagagaagaaatcccaaactcttggtaggggaaggtatctttatcaaaaacaccagacttgaccacctcatcaccactgtctgttttgatgatggagactttatactcctttgatacatcctcaaaaaatcgaagaacagacgctgcaggttcgttaatatctttcaaatacaaatccaaagaatctacagg

SEQ ID NO: 255 - DNA, 2495 bp; double-stranded, linear
ctgcgaattttattaaagataatgtgttaattacagcggctcacaactactacagacatgactatgggaaagaagcggatgatatttatgttcttccggctgttagtccaagtcaagaaccatttggaaagatcaaagtaaaggaagttcgttatttgaaggaatttagaaatttaaattctaaggatgcaagggaatatgacttggctttattaattctagaagagcccattggtgcaaaattagggactttgggtcttcctactagtcaaaaaaatttgacaggaataactgtgactatcacaggctatccatcatataattttaaaattcatcaaatgtatacagataagaaacaagttttaagtgatgatggcatgttcttggattaccaagttgatactttagaggggtctagtggatctacagtttatgatgctagtcaccgtgtagtaggagtgcatactttaggagatggagctaatcaaattaacagtgcagttaaattaaatgaacgaaatttgccatttatttawtcggttcttaaaggttactctcttgaaggatggaagaaaataaatggtagttggtaccattatagacaacatgataaacaaacgggttggcaggagataaatgatacctggtattatttagacagttccggtaagatgcttacagattggcaaaaagtccatggaaaatggtattatctcaattcaaatggagcaatggttacaggtagccaaactatcgatggtaaagtttataacttcgcttcatctggtgagtggatttaatgttggaggatatataaaatgaagcttttgaaaaaaatgatgcaaatcgcactagccacatttttcttcggtttgttagcgacaaatacagtatttgcagatgattctgaaggatggcagtttgtccaagaaaatggtagaacctactacaaaaagggggatctaaaagaaacctactggagagtgatagatgggaagtactattattttgatcctttatccggagagatggttgtcggctggcaatatatacctgctccacacaagggggttacgattggtccttctccaagaatagagattgctcttagaccagattggttttattttggtcaagatggtgtattacaagaatttgttggcaagcaagttttagaagcaaaaactgctacgaataccaacaaacatcatggggaagaatatgatagccaagcagagaaacgagtctattattttgaagatcagcgtagttatcatactttaaaaactggttggatttatgaagagggtcattggtattatttacagaaggatggtggctttgattcgcgcatcaacagattgacggttggagagctagcacgtggttgggttaaggattaccctcttacgtatgatgaagagaagctaaaagcagctccatggtactatctaaatccagcaactggcattatgcaaacaggttggcaatatctaggtaatagatggtactacctccattcgtcaggagctatggcaactggctggtataaggaaggctcaacttggtactatctagatgctgaaaatggtgatatgagaactggctggcaaaaccttgggaacaaatggtactatctccgttcatcaggagctatggcaactggttggtatcaggaaagttcgacttggtactatctaaatgcaagtaatggagatatgaaaacaggctggttccaagtcaatggtaactggtactatgcctatgattcaggtgctttagctgttaataccacagtaggtggttactacttaaactataatggtgaatgggttaagtaatgaaggctaattgtaaactgtgatggatacttaactttgtataataggtggataaaagtcttcacaatcaaaaaacgcatagtatcaaggtttttctgtactgccctcaaacagttagacaattaatttatccgaaggatttagttctgtattgcacagggctaagtccttttagttttaccttaattcgtttattgttgtagtaatcaatatagtctataatggcttgttccaattgcttaagcgactgaaacgacttctcataaccgtaaaacatttccgatttcagaatcccaaagaaggactccatcatactattgtctgggctgtttcccttacgtgacatggatgcttgaattcccttactctctaggaaccgatgataagaatcgtgttggtattgccagccttggtcactatggagaatcgtattctcgtagtgcttctctgtgaatgcctgttccaacattgtttgtacttgttctaagttgggtgaagttgaaagattataggcgataatttcgctattaaagccatctaaaactggtgataagtaaagcttttgagtacttgctggaatggcaaattctgtcacatctgtgtagcacttttccattgttttagagccttcaaattggccttgaatgagattcg

SEQ ID NO: 256 - DNA, 870 bp; double-stranded, linear
taccaccgtattcatccagcaagattgccatttgtctttgggtatttcgcagttcttttagcaagtcatccacaaaaatagtttcaggtacaaaaagtggatcttgtaaaattctcttccaaacaatattgtcaaaaccgtccacaaagcctgccttaaggagactcttggtgtgaatgattccaattacattgtccttatccccatcataaaccgggatacgagaataattttgttttaaaatactttggataatggcttgactatcatcctgaatatccaccataaaggcatccgttcgaggaaccataacctctcgtgccatcagttcatcgagcgaaaagacaccttgtagcatctcaatctcatcagcatccaatgtttcttcactatttgtcagcatataggcaatttcatcacgggtcatcttttcatccgcatcatcgaatgacataggagtcaaatggctcaagaaattggtcgaagcagctaaaagccaaacaaaaggactgactagttttccgatcccaatgataatcggcgctgtacgaattgccaaggcatcctttagattaagagcgattctcttaggatataattccccaaaaacgatggaaatataggtcaaaaatgccaaggatagaaaagttgccacggcttgtgctgtttcgccattcccaagccaagaggcaatcacacgtcctagagtatcagttaaactcgcccctgataagattgtaatcagggtgattcctacctggatggttgataaaaagtggttaggattttctagtaccttcagcaggcggatgtagcgtctgtctccttcttccgccttttgttcaactcgggcacgattaagagaaacgg

SEQ ID NO: 257 - DNA, 1245 bp; double-stranded, linear
cgttcccagaagcccgcattctcatcgccaatgtcgtgattgatttggccctttctccaaaatccaactcagcctatgtagctatggataaggcacttgctgacctcaaaacatcagggcacttgcctattccgcgacacctgcgtgatgggcactacagtggaagcaaggaactggggaatgcccaagactatctctatccacacaactatcctggaaattgggtcaagcaagactatctgccagaaaaaattcgtaatcatcactatttccaagcagaagatactggtaaatatgaacgggctttggctcaaagaaaggaagctatcgaccgtttgcgaaaaatctgaaatccttttcaaaaaattgcactttcctcttgattttttttgaaaaagtggtatcatataaatatagaaacgctgtggtgtacgacttcacacttaagtgttgaccgactattttttgtattattagggaaacaaaagtcttctaacagcatgtaggccgtctcacacggaaacagcttcagttagagcgagttgcccacctgcttaattgcgcgggttcaatacaaaccgtgaagtttcggcaccaatacagcttttttctttgcctccttagctcagctggcagagcagcggactcttaatccgtgggtcacaggttcgatccctgtagggggcatataaatacaacaggaaaagccttataatatagggctttttttgctttccttttaaaaattgtcgtgcaatttgccgtgtttttacaacaaacttttcacagccataaactcctcactaattttttcctccaaggtatgcccataaacgtcaatcaacatggagatatctttatgtcctaaaatttggctctttgtcaactgtagtgggttgaagtcagctaagctcgagaaaggacaaattttgtcctttcttttttgatattcagagcgataaaaatccgttttttgaagttttcaaagttccgaaaaccaaaggcattgcgcttgataagtttgatgagattattggtcgcttccaatttggcgttagaatagtgtagttgaagggcgttgacgattttctctttgtcctttagaaaggttttaaagacagtctgaaaaagaggaggaacctgctttagattgtcctcaatgagtccgaaaaatttctccggtgccttattctgaaagtgaaacagcaagagttgatagagctgatagtgatgtttcaagtcttg

SEQ ID NO: 258 - DNA, 1684 bp; double-stranded, linear
atgcctatgtaactccacatatgacccatagccactggattaaaaaagatagtttgtctgaagctgagagagcggcacccaggcttatgctaaagagaaaggtttgacccctccttcgacagaccatcaggattcaggaaatactgaggcaaaaggagcagaagctatctacaaccgcgtgaaagcagctaagaaggtgccacttgatcgtatgccttacaatcttcaatatactgtagaagtcaaaaacggtagtttaatcatacctcattatgaccattaccataacatcaaatttgagtggtttgacgaaggcctttatgaggcacctaaggggtatactcttgaggatcttttggcgactgtcaagtactatgtcgaacatccaaacgaacgtccgcattcagataatggttttggtaacgctagcgaccatgttcaaagaaacaaaaatggtcaagctgataccaatcaaacggaaaaaccaagcgaggagaaacctcagacagaaaaacctgaggaagaaacccctcgagaagagaaaccgcaaagcgagaaaccagagtctccaaaaccaacagaggaaccagaagaatcaccagaggaatcagaagaacctcaggtcgagactgaaaaggttgaagaaaaactgagagaggctgaagatttacttggaaaaatccaggatccaattatcaagtccaatgccaaagagactctcacaggattaaaaaataatttactatttggcacccaggacaacaatactattatggcagaagctgaaaaactattggctttattaaaggagagtaagtaaaggtagcagcattttctaactcctaaaaacaggataggagaacgggaaaacgaaaaatgagagcagaatgtgagttctagttctcatttttttcatgaaaatgtgcaaaatatagtagattgaaactagaatagtatacctctacttctaaaacattgttagaaatcgatttgactgtcctgttcttatttcattttactatatcttaacagatagtgtaaataaagataaactatttactggctaattaatcagttaaacactagttaaggagtaatgatgaaaaaaagaacaatactattattgatggccagtctgttagctcttgtcttaggagcatgtggtttcttggacatattgatcctggatcattctcatcaggattactctttactgctattttagaaactggggtggtttgatggaaagtattggtcttgttatcgtttcacattccaaacacattgcagaaggtgttgttgaactgattagtaaagtagctaaagatgttccgattacttatgtaagaggaaccgagggcggaggaattggaacgagttttgaacaagtagatagggttgtttccgaaaatccagcagatactttacttgccttttttgacctaggttctgctaaaatgaacttaaaaatggtgactgatttcagtgataaaagtatcatcatcaacagggttccaattgtagaaggtgcctataatgcagctgctcttcttcaggctggtgcagaactgtcagttattcaaacacagttagcggagcttgaaatcaataaataaggaattttactataactctttttatagataagctattgattatctcaactataataatgttaagtnaa

SEQ ID NO: 259 - DNA, 970 bp; double-stranded, linear
aggagtggaganatatgaagacacaaattttcacattattgaaaatcgttgctgagattattattattttgccatttctaactaatctataagttctttatattgctgaaaacgcaattcaaaaagggctattaattgtggattttctaatacctgcagagattggataaagcgttcaatctctttttgattgcttccctttgtttgaagaaagacactcatcttctttaaaaattgccacgatactttttcaaaaacatcatacggtcgtaacatcctctccaactcggcttcgaagattgggatgtaggagaaaagttttcgctccatgagttctgataagatatttaagagtccttgcttcatatacaatcgattgtgtactaactctttaaattctttggatttttcgagtaaggaggttgataaaaaaatcagatcttgattgctcaagaagggcatggtattgcaaaagagatagagttcaaaccaggtccaagactcgatagcatagagataggtggtcaaaaactcgctatcctcctctgctagtgggtagcttttatttagtgaatggatggcatctttaatcacgatggcattcaaacgacgataggtctgcgccatctgttcttgatcgacttcctccaatagctgctctaaagcagctatatcctgatgggcaaagcgattcacaacctttcgaccgattcgcatatgtggagattcttgatagttgttgagcttgtgcccaaactcatcaaaggtcacatttataccttggatagctagaatcaacttatccgcagacagcatagactgccctagttcaaacttggacaactgagaagctgttagaccctcacaagccacatctgactgcttgagctttctcgccaaacgtaattccttgtaaaattcccccagttccattctctcaatcatctgaccacctcctagcttttgcagg

SEQ ID NO: 260 - DNA, 2996 bp; double-stranded, linear
gttgaccacgggtaaaactaccctaactgcagctatcacaactgttttggcacgtcgcttgccttcatcagttaaccaacctaaagactatgcgtctatcgatgctgctccagaagaacgcgaacgcggtatcactatcaacactgcgcacgttgagtacgaaactgaaaaacgtcactacgctcacatcgacgctccaggacacgcggactacgttaaaaacatgatcactggtgctgctcaaatggacggagctatccttgtagtagcttcaactgacggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagcacttaaagctcttgaaggtgactctaaatacgaagacatcgttatggaattgatgaacacagttgatgagtatatcccagaaccagaacgtgacactgacaaaccattgcttcttccagtcgaggacgtattctcaatcactggacgtggtacagttgcttcaggacgtatcgaccgtggtatcgttaaagtcaacgacgaaatcgaaatcgttggtatcaaagaagaaactcaaaaagcagttgttactggtgttgaaatgttccgtaaacaacttgacgaaggtcttgctggagataacgtaggtgtccttcttcgtggtgttcaacgtgatgaaatcgaacgtggacaagttatcgctaaaccaggttcaatcaacccacacactaaattcaaaggtgaagtctacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgattcacccaatcgccgtagaacaaggtactacattctctatccgtgagggtggacgtactgttggttcaggtatggttacagaaatcgaagcttaattcgatttagttcccagaagaacaattatttaagttagacactaaaagaatcttgcttggcaaggttctttttttagatattgaactaatactcaatgaaaatcaaagagcaaactataatatattgaaactagaatagtacacatctacttctaaaacattgttagaaatcgatttgactgtcctgatcgatttgtcttgttcttatttcattttactatagaaagttagctacagactgctcaaaacattgtttttaggttgtagatagaactgacgaagtcagtaacatctatacgacaaggcgaagctgacgcggtttgaagagattttcgaagagtataatactagactaaaatcaaaaagcattatacaatagtaatatgaaatcaattaaagaagaaatccaaaccatcaaaacacttttaaaagactctcgtacagctaaatatcataaacgccttcaaatcgttctatttcgtctgatgggcaaatcttataaagagattatagaacttttatagtggtttgaaataagatgtgaacaactctatcaggaaagtcaaactaatttatagaaatattttagcagccaaggtgtactgttatagattcaatacactttagactgtaatcaaacaacgatttggcgaaatgtaaaaaatatgaggagttcggactcgactctctccttcaagaaacacgtggtggtcgtaaccatgcttatatgacggttgagcaagagaaagtctttcttgcccgccatttgaaggctacagaggcaggagaatttgttacaattgatgccttatttcaggcttataaaaaggagttaggtcgttcctacacacgtgatgccttctatcaactgttgaagcgccatggttggcgaaatattacgccacgtccagaacatcctaagaaagcagatgctcaaaccattgtcgcgtctaaaaataaagtctcaattcaagaagacaagtgaactgcaccccaaaagttagacagaaaaaatctaacttttggggtgtttttattatgaaattaacttatgatgataaagttcagatctatgaacttagaaaacaaggatatagcttagagaagctttcaaataaatttgggataaacaattctaatcttaggtacatgattaaattgattgatcgttacggaatagagttcgtcaaaaaaggaaaaaatcgttactattctcctgatttaaaacaagaaatgattcataaagtctgacatgaaggctggactaaagatagagtttctcttgaatactgtctcccaagtcgtacgatacttcttaactggctagcacaatacaggaaaaacgggtatactattgttgagaaaacaagagggagagtacctgagagcggagaatgccatcctaaaaaagttaagagaactccgattgaaggaggaaaaagagaaagaagaaagacagaaattattcaagaattaatgactgagttttcgttagatattcttctaaaagccattaaactagctcgtttgacctactactatcacttgaaacagctagataaaccagataaggaccaagagcttaaagctgaaattcaatccatttttatcgaacacaagggaaattatgcttatcgtcggatttatttagaactaagaaatcgtggttatctggtaaatcataaaagagttcaaggcttgataaaagtactcaatttacaagctaaaatgcgacagaaacgaaaatattcttctcataaaggagacgttggcaagaaggcagagaatctcattcaaggacaatttgaaggctctaaaacaatggaaaagtgctacacagatgtgacagaatttgccg

SEQ ID NO: 261 - DNA, 837 bp; double-stranded, linear
cttatcaactcccgacatggctctcagaccaatccaaatccctaaaaaaatcagaacaaggatggtggtcaagatcaaactctcgaaatataaagaaaatagttgcagtagcatgatttctctcatttctatcttttttaaagagtaaactcagctagtccaactaactgagttttcctttatctattatatcaaatataagtccgtttgtaactagcgaagaattcttttgtccgctcttctttaggggtgtggataatctcatccggagttccagactcgatgattttccccttatctaagaagagaattttatccgcaacttgggctacaaaggacatgtcatgactgaccaaaatcatggtctgacctgacttagcagcatctgcaatagacttttctacttcaccgaccaattctgggtcaagggctgaagttggttcgtctaagagcaaaacatctggtttcatagcaagcgcacgcgctagggcaacccgttgcttctgtccacctgataaatggcgaggataatggttttcacggtccgaaagcccaaccttagccaactcttccttggcaatcttagtcgcttcttggtcagataatttcttgacaacaaccaagccttctttcacattatcaagtgctgttcggcgttcaaacaaattaaactgttggaaaaccatagacaacttacgacgtagggcaaggatttcttcttgagtgattttagaaaaatcaactgaaaaaccatcaatctgaatagagccactgtcaggtgtttctagataattgagactgcgagaaaggttgattttcagctctgaagaccaatca

SEQ ID NO: 262 - DNA, 868 bp; double-stranded, linear
ccgaacaaaatgggctaattagattatagtaagaaaggtaagttaaaaatgagaattgcaattggatgtgaccacatcgtaactgatgaaaaaatggcggtttcagaatttttgaaatcaaaaggatatgaagtcattgactttggtacctatgaccatacacggactcactacccaatctttggtaaaaaagtaggggaagctgtaactagcggtcaagctgatcttggagtatgtatctgtggtactggtgttggtatcaacaacgctgtaaataaagttccaggtgttcgttctgccttggttcgtgatatgacaacagccctttatgctaaagaacaattgaacgctaacgttattggttttggtggtaaaattactggtgaattgcttatgtgtgatatcatcgaagctttcatccatgctgaatacaaaccaactgaagaaaacaaaaaattgattgcgaaaattgaacatgttgaaagtcacaatgctcaacaaacagacgcaaacttctttacagaattccttgagaaatgggatcgtggagaataccacgactaagaggtgacctatgattttaacagtcacaatgaacccatccatcgatatttcctatcccttggatgagttgaagattgatactgtcaatcgtgtggtggatgtaaccaaaacggctggtggtaagggactcaatgttacccgagtactttcagaatttggcgattctgttcttgctactggtttagtgggtggcaaacttggtgagtttttggttgaacatatcgataatcaagtaaagaaagatttcttctcaattaagggagaaactcgtaactgtatcgctattctccacggagacaaccaa

SEQ ID NO: 263 - DNA, 3744 bp; double-stranded, linear
ccgttcaaagtcttcataagactcgaaagtcacagttctttcgttcttgctggcatctatataggtaatttcaatcatgtttaaaactcctttgtttaatgctaactttattttactccttataaaagagaatgtcaagaaaaatgattgcgcacgcaactttttttaaaatcatcttaaatcaagaaatccaaacctgcttccaagctttcttcgacagtcttttgtagcgaggccagtgtcttttgcccatcatttgtcaggcagataaaactagagcgtctatcttgatggcaacacatgcgactgagtagaccgcaatttttagcttccaagcgagccaccatcctagaaactgcgctcgggctcagatgaagcttatctggcaggtcaatctggcgtagagatttttcttcagccaagtccagatagtagagcaggtagaactctttcaaggtcagactttgctcgctctgttgggcaatggtctcttccaagagactttcaatttctttctgacgccgattgaagtcaaaccatttttccaaataggtcatagtgtctcctttctttttagagtcataaatagaagaaagtccattaacgggcagtctctgcgtcacaagatgattgcgcatgcaataattatactacttttcaagaatgctggcaagctctgttttttagtggttttatttttgtgtgaataatgggggaatcctattgtttcaatttctaactccttatcacattcgaattcagattttatttcatttctctatctatagttgcttagtttaaaataagcatggtctaataaagctatgcatatagtactgattttaaacaaggagcattagattccattaaaggagggcacagacatgtcgaggcggccaaagtttttgatgtcggcgtcagaactctcttcacgtgggaaaagaaagacgtaaacaagggaacttagagcggaaaaagcgagtcgtcaaaaagcgtaagatccctttagaagaattgaaagcctttgtagaggctcatccagacgcttttttacgggaaattgcggcccgttttgattgtgctttgccctccgtatgggcagttttaaagcagattaaggtcattttaaaaaagacgaccagttttagggaacaaaagcctgagaaagtttctgagtttcttgatattttggataacctaaaagatttaccagtcctatatattgacgaaacgggaatcgaccgctacctctatcgtccttatgcaggggctcctagaggggagaaagtctatggcaagattagcggacggcgttttgagcggactaatgaggtggagcaaaaactcaatggtagttttctaatcagatatattgattcacaaattagagaatgaaagaataattatgcataaaaataggaatataaaccaaaaattagctgatttatactcatttgcgtgtctttataaaaaacttatcttataatatatatatatatatatacaaaatagtaaaatgctttttttttttagcaaaaatacctcaagtttcttgctattttgggttccctattctataattatagtatggtaatttatttatatccatacatgaaaataatactcgaaaggaaatttcaaaatattttttagacgtcagaagggtgaatatagagaaacagaccgagtaactcggttcaaattaatcaaatcagggaagcattggctacgggcctcgacttctctttttggcttgtttaaggtcttgcgaggtggtgttgatactactcaggtcatgaccgaaacggtagaagataaagtaagtcattcaattactgggcttgatatcctcaaggggatagttgctgcgggagctgtcataagtggaaccgttgcaactcaaacgaaggtatttacaaatgagtcagcagtacttgaaaaaactgtagagaaaacggatgctttggcaacaaatgatacagtagttctaggtacgatatctacaagtaattcagcgagttcaactagtttgtcagcttcagagtcggcaagtacatctgcatctgagtcagcctcaaccagcgcttcgacctcagcaagtacaagtgcatcagaatcagcaagtacatcggcttcgacaagtatttctgcatcatctactgtggtaggttcacaaacagctgccgctacagaagcaactgctaagaaggtcgaagaagatcgtaagaaaccagctagtgattatgtagcatcagttacaaatgtcaatctccaatcttatgctaagcgacgcaagcgttcagtggattccatcgagcaattgctggcttctataaaaaatgctgctgttttttctggcaatacgattgtaaatggcgcccctgcaattaatgcaagtctaaacattgctaaaagtgagacaaaagtttatacaggtgaaggtgtagattcggtatatcgtgttccaatttactataaattgaaagtgacaaatgatggttcaaaattgacctttacctatacggttacgtatgtgaatcctaaaacaaatgatcttggtaatatatcaagtatgcgtcctggatattctatctataattcaggtacttcaacacaaacaatgttaacccttggcagtgatcttggtaaaccttcaggtgtaaagaactacattactgacaaaaatggtagacaggttctatcctataatacatctacaatgacgacgcagggtagtgggtatacttggggaaatggtgcccaaatgaatggtttctttgctaagaaaggatatggattaacatcatcttggactgtaccaattactggaacggatacatcctttacatttaccccttacgctgctagaacagatagaattggaattaactacttcaatggtggaggaaaggtagttgaatctagcacgaccagtcagtcactttcacagtctaagtcactctcagtaagtgctagtcaaagcgcctcagcttcagcatcaacaagtgcgtcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcaaccagtgcttcggcttcagcaagtaccagtgcttcagcttcagcatcaaccagcgcctcggcctcagcaagcacctcagcttctgaatcggcctcaaccagcgcctcggcctcagcaagcacctcagcttctgaatcggcctcaaccagcgcctcagcctcagcatcaacgagtgcttcggcttcagcaagcacaagcgcctcgggttcagcatcaacgagtacgtcagcttcagcgtcaaccagtgcttcagcctcagcatcaacaagtgcgtcagctcagcaagtatctcagcgtctgaatcggcatcaacgagtgcgtctgagtcagcatcaacgagtacgtcagcctcagcaagcacctcagcttctgaatcggcctcaaccagtgcgtcacctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcggcttcagcatcaaccagtgcctcggcttcagcgtcaaacagtg

SEQ ID NO: 264 - DNA, 795 bp; double-stranded, linear
cgataaagaggccttgagtaatctcaatttgcagattgaaaatggagagattatgggcttgattggtcataatggggctggaaaatcgaccactataaaatccctagtcagtatcatttcacccagcagtggtcgtattttggtagacggtcaggagttatcggaaaatcgcttggctattaaacgaaagattggctacgtagcagactcgcctgacttatttttacgcttaacggccaatgaattttgggaattgatcgcctcatcctatgatctgagtagatctgacttggaggctagtctagctaggctattgaacgtttttgattttgctgaaaatcgctatcaggttattgaaactctttctcacggaatgcgtcagaaagtctttgtcatcggagcactcttgtctgatcccgatatttgggtcttggatgaacccttgactggtttggatccccaggctgcctttgatttgaaacagatgatgaaggaacatgcacaaaaagggaagacagtcttgttttcaactcatgtcctagaggtggcagagcaagtctgtgatcggattgccattttgaaaaaggggcatttgatttattgtggtagtgtagaggacttgagaaaagattacccagaccagtctttggaaagtatctaccttagtcttgctggtagaaaagaggaggttgcggatgcgtctcaaggtcattaaaaaattagttgatatcaatatcctttattcatctcaagaagctaatctggctaatctacgaaagaagcaggctaagaatc

SEQ ID NO: 265 - DNA, 2231 bp; double-stranded, linear
tggtaatgtgcttggcagcwtccttgacactgctactaccatttcccatagcgaccgacataccaacgccagccagcatttcaagatcattatctgagtcaccaaaagccatgacttggttgaggtcaaagccatattctttcccaactcggcgaatgccttctaatttagaatttccctgattgatgacatccgatgcaaaaggattgctacgtgtcaatttcaagtcttcaaaatcagctgccgccttctcagattcttctggtgtcatcagcatcaaaacttggtagataggctgattcatcaggtgaagcaggtcctcttccttttggggaacaaccttgctgaccatgcgattaaaagactgactcaccgtccgagttaaaacagagggaacgaagcgactaattcgttgggaaaaagaacccagaccaaaggacatgattttagaacccaacatggcatccttggtccctagagcaatctccgtgccctcttttttagcatagctaattagatggcgcaaatgtaacttggaaatagggctcgtgaacaagactctgtctttactaaagatatactggccattataggttaccgcaaaatccagatccaaatcgtccatcaattccttaacaaaaaaaggtcctcgccctgtcgctacgccaactagtaccccttgttctttgacaatcttaatcgcatccttagtggatttcaaaacactcttgcgattgttgaccaaggttccatcgatatcaaaaaaaacagctttgacttccatcctatcccaatctccccttttgtgatacaatgattataccacatttcagaaagagtgagtaaatcatgcctaagaaaatccttgttttacatacgggtggaactatttccatgcaggccgatgcttctggcgctgttgtgacgagttcagataatcccatgaaccatgtgtccaacccacttgaaggaatccaagtccacgccttggacttttttaaccttccaagtccccatatcaaacccaaacatatgctggtcctctaccagaaaattaaagaggaagcagataactacgatggagtggtgatcacacacggaaccgatactttagaggaaacagcctatttccttgataccatggaagttccccatatgcctatcgttctaacaggagccatgcgtactccaatgagctcggtagtgatggtgtttataattacctaagtgctttacgagtggccagcgatgacagggctgctgacaaaggagttttggtcgttatgaacgatgaaatccacgctgccaagtatgtcaccaaaacacatacgactaatgtcagcaccttccagactccaacacatggcccccttggtctcatcatgaaacaggaaatcctctacttcaaaacagctgaacctcgtgttcgctttgaccttgatcacatacaaggtttagtccctatcatctcggcttatgctggtatgacagatgagctgattgatatgctggatttagaacacttggacggtttgattatccaagccttcggagctggtaatattcccaaagaaacggctcaaaaattagaaagccttctgcaaaaaggaattccagtcgctctggtatcacgatgctttaacggtattgccgagcctgtttatgcataccagggtgggggcgtacagttgcaaaaagcaggcgttttctttgttaaagaactcaacgcccaaaaagctcgcttgaaactcctcatcgccctcaatgccggactaacaggacaggctttgaaagactatatggaaggctaatactcttcgaaaatctctgcaaaccacgtcacgtcgccttaccgtatgtatggtactgacttcgtcagtttcatctacaacctcaaaaacatgttttgagctgacttcgtcagttctatctacaacctcaaaaacatgttttgagctgacttcgtcagttctatctacaacctcaaaaacatgttttgagctgacttcgtcagttctatctacaacctcaaaaacatgttttgagctgacttcgtcagttctatctacaacctcaaaaacatgttttgagctgacttcgtcagttctatctacaacctcaaaaacatgttttgagctgacttcgtcagktctatctacaacctcaaaaacatgttttgagctgacttcgttagtttcatctacaacctcaaaaacatgttttgagctgac

SEQ ID NO: 266 - DNA, 1310 bp; double-stranded, linear
gagtcaaaggctccgaggttgactttttacaaggggacaggtgaatattatctagacctgtcagaaattctcttctttgaaacagaagggagcaagatctacgctcataaccagaaggaagcttatgaggttcgcctcaagctctatgagttggagtctatcttgcctcgctattttaatcgagtttccaagtcaacgatcgcaaacatccgtcagatttactcagtggacaagtccttttcaggaacgggcaccatttccttttatcagacgcacaaggaggttcatgtctcacggcattaccaatccctcctaaaagaaaatctaagaaacatgaggtaaaaaacatgaaaaagaaagcatttggtattgttttattggttttagcagcttggatcttgctgcaagggaattttggaattccttctttggatggtaaaatatggcctttactaggtattgttttttttgcttataagtccattgagtccatccttagacgtcatctcacttcggcagtttttacaggtttactggcgctcatcattgcaaattacgcttatgacttgttaccagttaccaatcattctcttatttgggctagcatcttggtggtacttggtgttggttatctgacgcattcaagtaagttctggaatgaaaaaaaatggtggtacaatgggaaaaaaacagtcgtcacggataaggaagtcgcttttggtagcgggaccttctataagcaagatcaagatctcgtagatgaccaagtggaagtcgcttttggggatgctaaaatctactatgataatgcagagatgctaggtgattttgcaactttaaatattgaagtggccttcgggaatgcaaccgtctatgttccacaacactggcgtgtagatttgaaagtagaaacctcctttggtgcagctaaggctgacgctcctgtagccccaaccagcaaaaccttgattatccgtggagatgtggcttttgggaagttggaaattgtctacgttaaataaaaaaatcttcacttcaaccatcaaaatagacgtactaagagtaggaaattgatgccttgctctgatttcagttctatggttgttagactttaaaaaatgaaatgctgcctttaaaagttgtatatttttcgatattttggcttttacgtttgatgtatctatgtactacagcgtagatgatgtagtgtcaaatgcttttaaaaaacggatgatattggacagtttttttgcctttaattgctcaggaaccatgaaagtcagtacctgggtttatgacaagggagaatg

SEQ ID NO: 267 - DNA, 5922 bp; double-stranded, linear
actctgatttgattggaacgacagtcggtgccattgcagttacttcaaacgtaacgacttatgttgagtctgctgctggtatcggtgcaggtggacgtactggtttgacagccttggttgtagctatctgttttgcgatttcaagcttctttagcccacttctagcgatcgtaccaacagcggctacagctccaatcttgattatcgttgggattatgatgcttggtagcttgaaaaatatccattgggatgatatgtctgaagcagttcctgccttcttcacatctatctttatgggattcagctactctatcactcaagggattgcagttggtttcttgacttacactttgactaagcttgttaaaggtcaagttaaagatgttcatgtcatgatttggattttggatgccttgtttatccttaactacatcagcatggccttataatagaatgacccagggggatttccccccttttttaatacaaggagataggtgatgaaagagaaaaatatgtggaaagaattgttgaatcgtgcaggctggattttggtctttttacttgccgtccttttatatcaggttcccctagtggttacctctattttgactttaaaagaagtagccctgctacagtcagggctgatagttgctggcctttcaattgtggttctggctctatttattatgggagctcgtaaaaccaagttagctagttttaatttttctttttttagagctaaagatttggcacgtttgggcttgagttatctagttattgtcgggtcaaatatacttggttccattttattgcaactgtcaaatgagacgacaacagctaaccagtctcagattaatgatatggttcaaaatagttcgttgatttccagtttcttcttgctagccttgcttgctccgatttgtgaggaaatcttgtgtcgtgggattgttcctaaaaagattttccgaggcaaggagaacttgggatttgtagtcggtacgattgtgtttgctttattgcatcaaccaagtaatttaccttctttattgatttatggaggtatgtcgacagttctatcttggacagcctacaagacccaacgtttggaaatgtcgatcttgcttcacatgattgttaatgggattgctttctgtttgttggctcttgtggtgattatgagtcggacattaggaatttctgtttaaaagtttttatgtaggaaccgacctctttctaccagggaaagatgaatgcaatcgtgtccatctttttctttttatggtaaaatagaaaaataatatgatgaaaatccttgagggagtgaccgatatgtcaagtaaagccaatcatgcaaagacagttatttgcggaattatcaatgtaaccccagactccttttcggacggtggtcaattttttgctcttgagcaggcgctccagcaggctcgtaaattgatagcagaaggagccagtatgctagatatcggcggagaatcgactcggccgggaagtagctatgttgagatagaagaggaaatccagcgtgttgttccagtgatcaaagcgattcgcaaggaaagtgatgtcctcatctctattgatacttggaagagtcaagtagcagaggctgctttggctgctggtgccgatctagtcaatgatatcactggtcttatgggtgatgagaaaatggcttatgtggtagctgaagcgagagcgaaagtggtcatcatgtttaacccagttatggctcgacctcagcatcctagttcgcttatcttccctcattttggttttggtcaaacctttacagaaaaagagttagctgactttgaaacattgccaatcgaagacttgatggtggctttctttgaacgagcactagcgagagcggcagaagctggtattgcaccagaaaatatcctgttggatccaggaattggctttggtctgaccaagaaagaaaatctgcttcttttacgggacctggataaactacatcagaagggctatccaatctttctcggagtgtcgcgcaagcgatttgtcatcaatatcctagaggagaatggttttgaagtcaatcctgagacagagcttggtttccgaaatcgggacacggcttcggctcatgtaactagtatcgctgcgagacagggtgtagaagtggtgcgcgtgcatgacgtagctagtcacaggatggcagttgaaattgcctctgccattcgtctggctgatgaagcggaaaatttagatttaaaacaatataaataagatgaaagaaattgaaaacaatcagtggattgctaactaccggacggatcaaccgcattttggcttggaacgaatggtggaactgttagctttgcgtggcaatccccatctcaaactcaaggtcctccatatcggagggactaacggcaagggctcgactattgcttttttgaaaaagatgctagaaaagctagggttgagagttggcgtgtttagctcgccctatctcattcattacacagaccagattagcatcaatggggaatcgatctcagaagcgaggctagaagctctcatggcagactatcagtctttgctggagggagaagcggtcgccaatttacagggcacaaccgagtttgagattatcacagccctggcctatgactactttgcctcagagcaagtagatgtggccatcatggaagttggcatgggtggacttttggatagtaccaatgtctgtcagcccattttgacaggaattacaactattggcttggatcatgtggctctacttggtgacaccttggaggtcatagcagagcagaaggcaggtattatcaaacaagggatgcccttggtaacagggcgtattgctccagaagccttggctgtgattgaccgcattgcggaagggaaagatgcgccgagacttgcctacgggacagattatcaggttcgtcatcaagaaagtgtggtgacaggggaagtctttgactatacaagtgctgtcagacaaggtcgcttccagactagcctgcttggtttgtaccaaatagagaatgctgggatggccatagctttacttgatactttttgtcaagaagatggtcgagagctagcaagcaatgattttcttggtcaagccttggaagaaacaagttggccagggcgtttggaaatcgtgtcaagagatcccttgatgattttggatggagcccacaatccccatgctatcaaggccttgttggtaaccttgcaagaacgttttgcggattatcataaggaaatcctcttcacttgtatcaaaaccaaggccttggaggatatgttggacttgctgggagccatgccagttaccgagcttactctaacacattttgcggatagtcgggcgacggatgaaaacgtgctgaaagaggcagctaagtctagaaatctcagctaccaagattggcatgattttctagagcagaatttgacagataaaaaagaagagaaacaaacagttaggattgtcacaggttccttgtatttcttgagccaagtgagggcctatctgatggagaggaagaacgagaatggatacacaaaagattgaagcggctgtaaaaatgattatcgaggctgtaggagaggacgctaatcgcgagggcttgcaggaaacacctgctcgtgtagcccgtatgtatcaagagattttttcaggtcttggtcaaacagcagaggaacatttgtcaaaatcctttgaaattattgacgataatatggtggtagaaaaggatatctttttccataccatgtgtgaacaccacttcttgccattttatggtagagcgcacattgcctacattccagatggtcgtgtggcaggcttgtctaagctagcccgtacggttgaagtttattcgaaaaaaccacaaattcaagaacgtttgaatatcgaagtggccgatgccttgatggactatctaggtgctaaaggagcctttgttgtcattgaggcggaacatatgtgtatgagtatgcgtggtgttagaaaaccaggcactgcaaccttgacgacagtagctcgtggtctatttgaaacagataaggatctccgtgaccaagcttatcgtttaatggggctataaaaagaatccgcttcaagcggatttttctagaaaggaatcattatggatcaactgcagattaaggatttggaaatgtttgcctatcatggtctttttcctagtgagaaagaattggggcagaaatttgtcgtttcagccatcctatcctatgatatgaccaaggcagctacagacttggatttaacagcctctgtccattacggagaattgtgtcagcagtggacgacttggtttcaggaaacgagtgaagatttgattgaaacggtagcctataaactggtggaacgtacctttgagttttatcctcttgtccaagaaatgaagttggaactgaaaaaaccttgggcaccggtgcatttgtcactagatacttgctcggtaaccattcatcgccgcaagcaacgagcctttatcgccctaggaagcaatatgggagataaacaagcaaacttgaagcaagccattgacaaactgcgagctcgtggcatccatattctcaaagagtccagtgtcttagcgacggagccttggggtggagtggagcaggatagctttgccaatcaagtggttgaggtggaaacctggctaccagcacaagacttgttagaaaccttgttagccattgagtcagagctgggacgggtgagagaagtgcattggggacctcgtttgattgatttggacttgctctttgtggaggaccagatcctttatacagacgacctcatattgcctcatccttacatagcggaacgcctttttgtccttgagtcttacaggaaattgcgcctcattttatccatccgatattaaaacaaccgatccgcaacttgtatgatgctttgaaaaaatagaaaaactctagttttcagttacttgcaactgaaggctagagtttttatactcttcgaaaatctcttcaaaccacgtcagcgtcgccttaccgtactcaagtacagcttgcggctagcttcctagtttgctctttgattttcattgagtattaaaataggtcattttcttctgggaggaggatagtttctctaccgtccatgtctaaaaccagtactcttgggggataacgagggtcgaaaggatggttaaagtcaaaatcaatggctgtagggaggtgttgacttgaaaagtggaaggtaatctttccttggttattaagcaattgaaactcgagttcttcttccaattcaaagacattttttaagaaatggtcgatgatataccaaaaagagtcaatgatgtcatcaggcaagctggtaacaataccaaaactagcagatcgcatgtgggtattggtaaaagccatatctctgtcccctttcttttcccttatcatacagcaaataggattaaaaatcaagaaaaggtgattttttgaaaaggattttagttacagggagaaatagggaaaaaattcctaaaaatctaccgaagttaataggtaaattcccaaattaacttgattatataactttcagttactttgagaagttaccgaaaaatatttttcatatctattgacttttaggggtaaaatttggtatgatagtaggcggtattgtttaccccatttgaaaggccccggaaccttccaaatacttttcgatgggaaggaacacccatcaccgtaaacaaaaatcgaactatatataggagaaatcatgaacaaaacaacatttatggctaaaccaggccaagttgaacgtaaatggtacgtagttgacgcaactgatgtaccacttggacgtctttctgcagtagttgctagcgt

SEQ ID NO: 268 - DNA, 1988 bp; double-stranded, linear
taactatctacgatgagctgttgtgattctcattagttcccctttcccaagaggcataggggtgcgcataatagatgtgctcctcagaaaatatatcaaacaagcgattgaattccgttccattatctgccgtgatggaaagaatcttgtgttgttttaagatgagttttagagcctgattgaccacctcagcacttttatttggaatcaatcggatgatctgatgtctactctttcgatccgtcaagacaatcaagcagtagtttttcgatctcgtaagtagaaccgtatcaatctcataatgcccattctccaagcgaagattgatagcttcaggccgctgttcgatggattgaccagcaggtttaaagttggtgctagcctgtttcttaagcgcttttccttttctagggtaaagcaaatcctgcttgcttaaccccaattttccatgatgaatccaatagtaaatggttgaaattcccacgttaacccctttagccataaccatcatttcaggcgaaaatttttggttatgatagtggagaatcttttcctttagttccttggtcaagcttgatttcttgaccgagcgcttgcgattgttttcataagactgttgagcgtagtcggcagaataaacctctttgaagcgcccttttccaagacattgtcggactgtcccacgcttgatttcagtgtgatagtttgaggagcttttccaagtagagaggcaatttctctatttgattttccttcttttttccatctttcgattaagcgacggctatcgattgtcaaatgtttggcttttgtagtataattgtcttgcatctctgtgcctttcttgtgtttgtggttgaacaacaagtataacacagaggtgctttcttatgcctacaagagctttcattatttccattttcttttggatttcactctattctgaaaaacttgtgtatatttactgaagctagcaagtcttacctgtaaatttaatgaaagcaacacaaaatccgagaggggaatctcggattaatagatagagagtttttagtttaaataaattgtttaaaatatcaacaacatcacttcttttcttaacctgataagtcttgattcctaattttggggctacgattatattgtcctcaatatcgtctagaaagacacaatttctaggttataactggtatttatcgatagttactcatatacatcagtccacctccatacttatgtgcgagcctctctttgtattatacctccatactcaccttacagattcttttggtaataatatctttgcctaatgtagagacagtcttgcaaagaaaaaacttccttgtagccatgtttctgataaaagtccggtgcctggaactggtaagtattgacaaaggcaaaacaacaatttcgattcttagcttcactttctgcctgttgcaatagttttgaaccgattccttgccctcgcagttcctcttttacaaacaaatactcgatttctagccaatttccaaaagtctctgctatcaaacctgccaggagattgcccttttcatcttcgacataaagattaagtggctcactttcagcctcttctctttttgaacggttataaacacgaatcagattccctatttcttgcgatttatgtgattccttattttccaatctaaagtatagtgaaatgaaataaaacatgcgcaaatcgattaaggaatttaatctaatttctaacaatgtcttagaaatcaaagtgtactattttaacttcaatgcactatacatctaatactcaataaaaatcaaagagcaaactaggaaactagccgcaggttgctcaaaacactgttttgaggttgtagatagaactgacgaagtcagctcaaaacatagttttgaggttgtagatgaaactgacgaagtcggctcaaaacatggttttgaggttgtagatgaaactgacgaagtcagctcaaaacagg

SEQ ID NO: 269 - DNA, 709 bp; double-stranded, linear
ccggatatttgttttatgtaattttcttgcaagtttcttcttagtagcttgtcagtcaggttctaatggttctcagtctgctgtggatgctatcaaacaaaaagggaaattagttgtggcaaccagtcctgactatgcaccctttgaatttcaatcattggttgatggaaagaaccaggtagtcggtgcagacatcgacatggctcaggctatcgctgatgaacttggggttaagttggaaatctcaagcatgagttttgacaatgttttgaccagtcttcaaactggtaaggctgacctagcagttgcaggaattagtgctactgacgagagaaaagaagtctttgatttttcaatcccatactatgaaaacaagattagtttcttggttcgtaaggctgatgtggaaaaatacaaggatttaactagcctagaaagtgctaatattgcagcccaaaaagggactgttccagaatcaatggtcaaggaacaattgccaaaagttcaattaacttccctaactaatatgggtgaagcagtcaatgaattgcaggctggaaaaatagatgctgttcatatggatgagcctgttgcacttagttatgctgctaaaaacgctggcttagctgtcgcaactgtcagcttgaagatgaaggacggcgacgccaatgccgytgctcttagaaaatagtgatgatttgaaagaagt

SEQ ID NO: 270 - DNA, 1680 bp; double-stranded, linear
tataaaatgttaagttaaatgatttcaaaattcagaaagggattgctttatgcagttcctttttattttaacaggagtgaaactatagtgtttctaaattgtgaatcaatcaaaactgattgtgatggggctattctagctttagaaaccttcaaaaattaaaatttaaggcaatcaattacttggaagagtatgaaagcatttagtttataggaattctaggtctagaattacatatatatatttatgaagacggggtgttcgatagttagtattgttctattctgaaagatttgagctgtcagttgtatagaaagtgttcgaatttttttaagtgattaaattagttaattgtatgaggtgctttatgatataatgttcttaatgaattttcagaaaggaaaacctcaaattgttctacaaatttctactcttcgacctcgaccacactcttcttgattttgatgctgctgaggatgtggctttgacccaacttctaaaagaagaaggagttgcggatattcaggcttataaagattattacgttcctatgaacaaggctctctggaaagacttggagctgaagaaaatcagtaaacaagagctggttaacacgcgcttttctcgtttatttgctcattttggacaggaaaaagacggtagttttcttgcccagcgttaccaattttacctcgcccagcagggacaaacactatcgggcgctcatgatctcttggacagcctcattgagcgtgattataacttgtatgctgcgacaaatggcattactgccattcagacaggacgtttggctcaatctggtctagcaccttatttcaatcaagtctttatctcagaacagttgcaaactcaaaagccggatgctcttttttatgaaaagattggccagcaaattgctggatttagtaaagaaaagacgctgatgattggagattctctaaccgccgacattcaaggtggcaataatgcggggattgacactatctggtataatcctcatcacctcgaaaatcacacacaagcccagccgacttacgaagtctattcttaccaagacttgctggattgtttagataaaaatattcttgaaaagatcacattttaaaggagacgagctaatgactacaaaaaagctaatattactattgaagagtacattgaaatgtctgaagttgattttaatgaagctgttaattatgaatttacatctgacacttgtcaattagcaaatagtatttatcaatctctttttaagttttttgataagaaaaatttctctggcgatttaatttttacttggaaatctccatcattagtcaaagaaggggattatattgggagaagggattcacaagtagataatcttagagtaataggaaatatatttccgaattatcttactaatcgaaaatatagcctcaatatgaatcgtaatggctgtatgggagattttcctcatgacttttttgatatatacctagatcatgtagcaaaatatgcctacgaacaaaaagttaataatattaaagagtattatcctttaaaaagagcgattttacaccaagagaatgcattgtattttcgatttttttctaattttgacgactttttagaaaaaaattatttaaagactatatggcaagtttctaaagaaactcc

SEQ ID NO: 271 - DNA, 598 bp; double-stranded, linear
agctcggtacgtagtatntgtggtgcataaatgagtgaaaagaggatagagaggatgaggccgataagaacaccggtagctgcatcgtgaaatacttgttttttcatagttctaatttctccttgatggtttttagataacggcgtgaagagtaggtgaagctttcgtttttcaagaaaatttctaccagaccgtttggcgtgagcttgaggtgagagatggaatcgatattgatgatttctgattgggaaatttggataaaattggttggcaagagtttaagaacctgatagagtcgcaaatcaatgctgtaggtctgactcgcggtttctgctagaaccttccgattctcgatatagaagcgctgaatcttgccaatctcaactagatagacctgatcatcgatttttcctttgattttttctctttggtccagattttctgcgaactcgatgactttctggactttttcggtttcttgaggtgcttggacaatcagcttttcctcctcgtaagtctcactaatctgtagttctactttcatagttttctctccttttcagttatacaaggttgtgatcacttcctgtatatccgg

SEQ ID NO: 272 - DNA, 1099 bp; double-stranded, linear
ccagcaaatcaataactgcaattgctataaaatggattctatagagttttttcatgacaagacctccctcttttatctaacttcattctactccaaaagaatgggagttacaactaaaatgataaaaatagcagaagggagattctcttaagttggctagtattctttatttgagtttccttctattatctaacttcttcatcattccagacaaataaagctccgattgcattgaggatataaaagatgtatttaccgatattggcgaagtttccttgaataccagcttttgtcagctgaacgaaattgtaaatcaaccaaaagccccactgagttgttagttttaatgcattcaaagcattggcaatgagggacagtgcaaaggcaatagttgttacgtaggcaaggagattcatcttgcccccatatccgatatagttggtcacaaaggcaaagaggaaggcgatgatggaaatgatgatggccgccaattttacctgtttttggctcatttggttgggtctgccttcttgcgaagcttcccacttctttatagcaaaggtataaatgaggaaggtgacgggataggtaatgatggccgccttatttccaaggatataatcaatagcaccggacaaaatggtattaacaataccaaagtaatttccccatttgcttaatttccccgtgaaacgagtggacaacatggaaatcccaacgttggttacggaaatcaatccaaagggtacaagagctgtccatgatccccagtctacaaatttatcgaggtgtgagttgaggtaaccagatgcaatcgcaatcccaacgaccaaagcaaccccgaagaggtcaaactatttagatgtagcaaaaatttttagtgattttttcataggttaaactacctttctttttttcaaatattctcccaccaaatgaaagtaaaataaaatgatagaaataaaaccctgaaaataaaggttctataatatttgtagtgggtaaatccactatagatattatggagcctattttattgtagaaaaaaagtcccatatgacctataatgaaaagcgacaaaacaactcattagaaagat

SEQ ID NO: 273 - DNA, 2723 bp; double-stranded, linear
ctgggattcacgtgaaaaggaagcccagagagtagccaggtgtactgctagaacagtgagtgaaattgaatattaccatagagagtcaacccagatagctcaggctttagttgaaaatcaagctcgtatcgagggaatctataaatactttagccttagcatgccagactatttttactggcaattagagcggaaagcttcgccttatatatcagtctctctgtatgaaaatgttgatgacctctatgttcgaaatgattttgtaactggggtggccattgcttttcaagattacaaggaagtctatgtttctactaaagacaaacgtaggkkagaaaaaatcagggctgaggatttcaaaccagcaggaaatagttttgccattccagtgtcagatccagtgtcagatcaagacttaggagtgatttacatctccttggatcctgctgttttataccatgccattgataatactagaggtcatactccgatggcagtaacagtgacctcaccttttgatacggagatttttcatatgggtgagacagttgataaggagagtgaaaattggctagttggcttaacttctcatggatatcaggttcaggtggcagttcctaaaaactttgttttacaaggaacagtgactagctctgctttgattgtgggtttgagccttctctttattgtcattctttatctgactttgaggcagacttttgctaattaccaaaagcaggtagtggatttagtagaatccattcaagtcattgctcaaggcgaagaggggcgtcggattgacatttccgagaaagatcaggaattactcctaatcgcggagacgaccaatgatatgttggatcgattggaaaagaatatccatgatatttaccagttagagcttagtcaaaaagatgccaatatgcgagccttgcaggcgcaaatcaatcctcattttatgtataatacgctggagttcttgcgcatgtatgcagttatgcagagtcaagatgagttggcagatatcatttatgaattcagtagtctcttgcgtaacaatatttccgacgaaagagagaccctcctcaaacaggaattagaattttgccgtaaatacagctatctctgcatggttcgctatcccaagtccattgcctatggtttcaagatagatccagagttagagaatatgaagattcccaagtttaccttgcaaccgctggtagaaaactatttcgcgcatggtgttgaccacaggcggacagataatgtgattagcatcaaggctcttaaacaggatggttttgtggaaattttggtggtcgataatggtagaggaatgtcggctgaaaagttggcaaatatccgagaaaaattaagtcagagatattttgaacaccaagccagctacagtgatcaaaggcagtctatcgggattgtcaatgtacacgagcgttttgtgctctattttggagaccgctatgccattactatagagtctgcagagcaagccggtgttcagtatcgtattacaattcaagatgagtagaaagggagaaaatgtataaagtattattagtagatgatgagtacatggtgacagaaggtctgaagcgtttgattccctttgataagtgggatatggaggtcgtcgcaacagccagtcatgccgatgaagctctagaatatgttcaggaaaatcctgtcgatgtcatcatttccgatgtcaatatgccagacaaaacagggcttgatatgattcgggagatgaaagagatcttaccagatgctgcctatatcctgctctcaggttatcaggagtttgattatgtaaaaagagcaatgaaccttagtgtggtggactatttggtcaagcctgttgataaggtagagctgggaaatctgctggagaagattgcaggtcagctcggcgagagagggaagaaaagtcagactcttagtcaagaattagacgaggctggatttgttagttatttaggggataaggagaattggtggataggtctatccaaggaaaaacaaggttccttcaccattccctactatgtcttgggtcaagactggcagattttcatttctggccaccccctagatggtttagtcgttacaccttttgaagctccttatcaagaacactttgaacgctggaagctgaatgctgagaaaaccctcttttacggttctgtaaatctgcagcagtctgagagtctctttgcctattacgaaccgatttatagggttatcattcagggaaatctcaatcaaatcgtagaagagttaaatctcttggagaaggtagttcttgaaaatacacctcgtgtttcgattactaaacagctttttatccagtttgtcatggatgttttccatttatttgaacatctcaaagctgatgatatgacggacattgtcaaaaccattcatgctattcaatccttcgatgaattggtttcttatatcaaggaaactctgatcagctttttcggtcaataccgtatgaatgaaaatgtggtcagtgtgctggaagtcattggtcgtgattaccaaaaagagctttccctcaaggatatcagtaaggccctctttatcaatcctgtctatctagggcagttgattaagcgtgaaaccgattcgacctttgcagagttactaaacaaacaacgtattaaggctgcccagcagctcttgctttcaactagtga

SEQ ID NO: 274 - DNA, 836 bp; double-stranded, linear
ccgcagtttttttaaaccgtatataagtatagcatagtcaaaaaaagaatgcaagatttttgcaaacttttttaaaatttttcgtaatttttcttttaaagttctactgtcaggacttgaccttgcttaacaacctgttctccggcgatataaacatcatctacatcactagatttaactgcataaaccaggtgagacagcatattttcctgaggttggagatgaattttcccttgtggttgaatgaccagaaaatctgcttgcttgccgacttccagacttcctatctgattttccattccaaggaccttagccccttcgattgtcagtaccttgagagctgtttcgattggaaactggctggcatccccacttttcatcttctgaagaagagctgcagtccttccttcctcaaacatatctagattgttattggaagcaaccgagtcagtcgcaattccgactgctactcccgctttttggagctggataattggagcaattcctgatgccagtttgaggttactgataggattgtgggcgatagcnacttgagaagatgccaagcgttcaatttctctctcgtttaattcgaccccgtgagcaaatacggacggatgatctaaataacccagttcttcaagaaaagcaagggggcgtttgccgtatcgtttgaggataattcctgactcctccttggtctccgccacatggacatggagcggaatatttagctcttttgccatttccaaactcgcttccagcaagtctctactgcagctatacggagaatgaggtgctaccataaccttgaaatttggatttttatattttaa

SEQ ID NO: 275 - DNA, 2335 bp; double-stranded, linear
attttatttcactttttaggtggtctggggctattcttatatagcntcaagaccatgggagacggtttacaacaagctgctggagatcgcctgggtttttacattgacaaatatactagtaatcctttgtttggagttctggttggtattgggatgactgctctaattcagtctagttctggtgtaacagttatcacagtcggcctggtcagtgccggtctcttaaccttacgtcaggctatcgggattgtcatgggtgctaatattgggacaactgtcacatcctttctcatcggttttaaattaggtaactatgccctacctatgctctttatcggtgccgtctgtcttttttttacgaaaaatcggacagtcaataatatcggacgcatcctctttggtgtcggtggtatcttttttgccctcaatctcatgagcggcgcaatggctccactcaaggatttacaggtctttaaggactatatgattgagctaagtaagaatcctgttttgggtgtctttgtcggtactggcttgaccttgctaattcaagcttcttcggctaccattgggattttacaaaacctctacgccggcaatctaattgatctacagggagctttgccagttctatttggtgacaatatcgggacaaccattacagccatcattgcctctttaggggctaatattgcagctaaacgggtagcaggagctcatgttgccttcaacgttatcggaacagttgtctgcgttatttttctagttccttttactgtcctgattcattggtttgaagctacgctaaatctagcaccggaaatgaccatcgcctttgctcacggaacctttaatattaccaacaccattgtccaatttccatttatcggagctctggcttactttgtaaccaagattattcctggagaggacgaggttgtcaaatacgaacccttatatcttgatgaacatttcatcaaacaggccccatctatcgctctaggaaatgctaagaaagagctcttgcacttaggaaactacgctgctaaagcctttgacctttcctataagtacatcattgacttggatgaaaaagttgctgaaaaagggcataaaaccgaagaagcaattaacaccatcgatgagcaattaacacgttatctcattgccctttcaagcgaagctctcagccaaaaagaaagtgaagtgcttaccaatatccttgattcctcccgtgatttggaacggattggagaccacacggaggctctactcaatctgactgactatcttcaacggaaaaatgttgaattttctgatgccgccttgaaagaattagaggaagtttaccgccaaactagtgactttatcaaagatgctctggatagtgtggaaaacaatgatattgaaaaagcacgcagtcttgtagaacgtcatgaagcaatcaataagatagaacgtgttctcagaaaaacccacatcaaacgcctcaacaaaggcgaatgttcaacacaagctggggtcaactttatcgacatcatctcacactacactcgtgtatcagaccacgctatgaaccttgctgaaaaggtttttgcagaacaaatctaagaaccaagaagctatccatcataattggatggctttttactttttcctaagcaagactaggatgaatgaaactgaaagagtattctgcagatatatagtccccaattattcaccccaaatctaaaaaccatccagaatccttgccttagcttagatcctggatggtttcttttttcacccaatgggtgttttttactagacaaaaaagagtttcccctttatggtataagtgtagaaaaaaacacaaaaagaaaggaaactcacatgaacagtttaccaaatcatcacttccaaaacaagtctttttaccaactatctttcgatggaggtcatttaacccagtatggtggtcttatcttttttcaggaacttttttcccagttgaaactaaaagagcggatttctaagtatttagtaacgaatgaccaacgccgctactgtcgttattcggattcagatatccttgtccagttcctctttcaactgttaacaggttatggaacggactatgcttgtaaagaattgtcagctgatgcctactttccaaaattgttggaaggagggcagcttgcttcacagccaaccttatcccgttttctttccagaactgacgaggaaacagtccatagtttgcgatgcctcaaccttgaatggkcgaattctttttacagtttcaccagctaaaccaactcattgtagatatcgattctacccatttcacaac

SEQ ID NO: 276 - DNA, 752 bp; double-stranded, linear
cggattcactgttgttgactaatcaataacacagtagaaaatctcacagcagtctattagttgcttttcatactaggcaagtgactgaggcttgtacttgggtacagcaagggagcttaaggccgtagaagagaaaaatagtagactgaaaacccgcaagacttcatcatttcgagaagtgacgtgggagatgaaaatcgattgaaccacttacaaggagaatagaaaatggctaaaaaaagcaaacaacttcgtgctgctcttgagaaaatcgacagcacaaaagcatacagtgtagaagaagctgtagcacttgcaaaagaaactaactttgcaaaatttgatgcaactgtagaagttgcttacaacttgaacatcgacgttaaaaaagctgaccaacaaatccgtggagcaatggtattgccaaacggtactggtaaaacttcacgtgttcttgttttcgcacgtggtgcaaaagctgaagaagcaaaagctgctggtgcagactttgttggtgaagatgaccttgttgctaaaatcaacgacggttggttggacttcgacgtagttatcgctacacctgatatgatggctcttgttggacgtcttggacgtgtccttggaccacgtaacttgatgccaaaccctaaaactggtactgtaacaatggatgttggcaaagcggttgaagagtctaaaggtggtaaaatcacttaccgtgctgaccgtgcaggtaacgttcaagcaatcat

SEQ ID NO: 277 - DNA, 2643 bp; double-stranded, linear
gtcaacattgatttcaaggctgtttgctttctatctcccctttttcataatgtataataaaatgaaataataacaggacgaattgatcgggacagtcaaatcgatttctaacaatgttttagaagtagaggtgtactattctagtttcaatctactatattttcgtacaggtgcttcaaccatttgaacgatttcaaatccttctttttggtaaagattctgagctctttgatttgcctcgaagacatttagagaaatactgtctatatctctattttcaaatgctaaactaacaaatttccttaaagccttgctacctaagccttgctcctgtttctgggggttgataaaaaatctcccgatatgaagattgctgtcttctagcctgattttctggataaatcccacaaactcttgttcatcaaagattgaaaagactccttccaaggcttgaagtgtcagtagaaaaggaatccttggtcccatccattgttcttgaaaggatttgcctagggagttggaccactggcatacaaattgagcgttttctgtgctcaccttttcttcaaaacgaattgtcatcttttcctcaccaccttatctatgtttctccattatactatttctcccattttttacgaatagataagtatgattgatttttatttttttctcgtcgggagcattctagcttcctttcttggtttggtcattgaccgttttccagagcaatccattatcagttcagccagtcactgcgattcctgtcagactcccttgcgtcccttagatttgattccgattctctcacaggtcttcaatcgctttcgctgtcgctactgcaaagttcgctatcctgtctggtatgccctctttgaattaagcttaggactcctctttctgctttactcttggggatggctctccttggggcaagtcgtcctaatcaccgctggtttgaccttgggtatctacgactttcaccatcaggaatatcccttactggtctggatgactttccagctaatcctaatagcttcctctggctggaatctggtcatggtctccttcctcatacttggaattttggctcattttatcgatatccgcatgggtgcaggggatttcctctttttagcttcttgtgctctcgtctttagcgtaacggagttactgatcttgattcagttcgcttctgcgacgggtatcctggcctttctcctgcaaaagaaaaaggaaagacttcctttcgtgcctttcctcttacttgctacttgtttgattatttttggtaagctactgcttgtctgataaaatccaatttctgccatatatccttcatgaaattatttcacagttaaattataaattatttcttttgtacaaagggatgatgttatcaaatcgatctgttcttctatcttcttgatactgatcaaaaaatttcatttcgactgaaaatatttcgcttataaactgtaaacgaatactttgtttagacattatagtcgctagactgactagatgattactcaaaacgacgtccagaatactctttactttgcttggttttttaacaaaaatttgatcatccaagggttcaatcattttgtaacctttttgcgcaatttgacgataaaagtaagaatgttgctttggagtcaataatcctaacttaaaagctcgatactctaaagcctgtatcgaaacattcaaatccgacttcaataaaatataactatcaggattgctgacacgcttgccaaccctctcttcaaatttgactaaaaactcttcttttggcaataaaaaacatgatgcaaaataatttgcttcttgctccaaacgatcgccatcttcattcatatctttatatttatgtaaaagaatatgtcctagctcatgagctaagtcaaaatttcgacgtacagatgatttattcgttcctaacacaatataaggtcttcccaattttgaccatgcgctataagcatcagcttggccattaattaatcgttccacgatatagatgcctgaacgttctaatttataaagcaaatcatgattatcttttgaaatacctaatttttccctggcataaagagccaattcctcaatggattctcccttatgataagattcactcactacattacttaggtcatgaattataatattaggtataattacaaaactttcaaaataatcaatcaaactatctaccttatgtaaatacatagtttgaatatctattgttttccgtgttgctaggtctgcatttctaaaggcaattacagaagaatcaaatcgaatgctctcttcttcctgttcaaaataagttaaatcaacatgaaattggttggccaaatgcattttggttgataatttaggtttcgtttcgttggactcaaactgccaaatggcttgttccgttaaattaattctctgagctaattctgctctacttaaaccatttaacagccgtaattctttcaatacccgaccattaaacatttacatactccttactacttttgaccttcttgtttttctattcttggaataatttcaaaatcttctgtttccgataattctgaaaaattaggaatatcttgatatttagcttcttcgaaatggtacggg

SEQ ID NO: 278 - DNA, 582 bp; double-stranded, linear
tgaccagtggcaaaatggctatccaaatgcagatgttattatcgatgatatcatctcagggcaagcctacgtagccttggaagagggagaactgctagcctatgctgctgtgaccaagagtccagaggaggcctatgaagctatttatgagggaaactggcaagctggagagtcagagtatctagtctttcaccgtattgctgtggcagcagatgtgcagggaaaaggagttgctcaaaccttcttagagggcttgattgaaggttttgattatcttgattttcgctcagatacgcatgctgaaaacaaggttatgcaacatatttttgaaaaacttggttttaaacaagtcggtaagatgccagtagatggcgaacgcttggcctatcaaaaattaaagaaataatgcaaaagaagtatgtaaaaatcctctactcctcaccaattggtattctatcacttgtagctgatgaccattatttgtatggaatttgggttcaggagcagaagcattttgagaggggactaggagatgaaacgatagaagaagttgtwagtcatcctattttagacccagttatt

SEQ ID NO: 279 - DNA, 554 bp; double-stranded, linear
cccaagctactaagagactaaaacttgctagagaagcaagagaaagtgtgaatctttttaatttcatgatgaatttcctttctgctaccaatttagagaaattttctctaaccagcaattcccctagtataacaagttcaaaaaatggagtcaatttatctgctcacggtccagcaggtagccccgtacttctgagataaaatagagagaccctgtaacgaacagcaagtcttgagcgtctgccctttcttcaaaatcgctgataaattctcggtaagaagaaactatatcgtaacctgtcacatccctttcgtccaaagccccctgatagtcaaagccggtcaccttgagttccacctgaggcaatttttcagtcagataacccaacatcccttgataatccttacgtttcaaggatccaaagaggatttgaggtcgatagccttcctgctctttttctttgataaactcagccaagcgagtcaaggcagggaggttatgagcaccatccaaataaatctgtgggcgaatacgctccaagcgascagcccaat

SEQ ID NO: 280 - DNA, 766 bp; double-stranded, linear
ccggtttttcaaatgaatttcttggttgtggctaaaaaatatgctacactatcaatatgaaaattttaatcccaacagcaaaagaaatgaacacagacttcccaagtatcgaggcaattcctttaaaaccagaaagtcaggccgtgcttgatgccttggctctctattctgccagtcaattggagagtttctacaaggtatcagctgagaaagcggcggaagaatttcaaaatatccaagctttgaaaaggcaaactgctcaacactatccagccttgaaactttttgatgggcttatgtaccgcaacattaagagagataagctgaccgaggcggaacaagattatcttgaaaatcatgttttcattacctcggctttgtacggtgttgttccagtcttgtcacccatggctcctcaccgtttggattttttgatgaaattaaaagtcgctggtaagactttgaagagccattggaaggcagcctatgatgaaactctgaagaaggaagaagtgattttctctctcttgtcatcagagtttgagactgtattttctaaggaaatcagagcaaagatggtgaccttcaaattcatggaggatagaggcggtcagctgaagattcactcaactatctccaagaaagcgcgcggggcctttctaacagctttaatagaaaatcaagtacaaactgtgggggaagcacgtcgcttgaactttgctggatttgtttaccgagaagatttgtcacaaccacagggggatgg

SEQ ID NO: 281 - DNA, 901 bp; double-stranded, linear
ccggccacggttccatccaacttcacaggtgtgcacttgattgtgtatgtaattgtcactaacggtagaatttcacctatccctcctatctgctcgcagtacccgcagactttctgaaagaagaagataacctacttatccgttgctatgattatactaaagtttctacttttttgcaaatagatttttaaatttttggctaattgtctgaatcagggtcggaagtttgacgaccttgtcattgcctagtttttcgcgtgcaattttgagaatggcacctgagtcttttgaagcaaagaggaattttcctttgtctgtaaagacttcgaagtggcggctgattttgcgtccagtgacattggctccaatctgattgatatggctccaaggaatctggataaattgttcgacattgacatctgggtaaaattccaaagcctgatctccgacaaggaatttcccaactttcccagcgatagagaggtaggaagtgcctgtcgtactgaggagtactgttttgttaagtgattgggccatgcttagtcttccttactttctccaaaaaaggcattgtagagggctttaattgctgctttctcttggtctttattgacaacaaacataatagaaacttcactagaaccttgagacatcatctggatgttgattttgttttcagatagagcgcgtgtcgcagtagcagtcactccgatatggctcttcattttttcaccaacaatcataatgatagaaaggtcgtgttcgatttctgcatgatctactttagccttttgaaccaactgacgcaggatttcttcttccttgatgggagttagttggcgagaacggagaatgatagaaagawcgtcgatacctgttggcatatgttcccaaccgatgt

SEQ ID NO: 282 - DNA, 1765 bp; double-stranded, linear
ccctgttacgtggataatagggtaagactgctcaggatttcctaacaaatccaccgcttgctgcattcgacccaaacctgatcgaaaattcaaaccaatccgactatggagccattcttctacttcaaacatacacatctccttgacaaaagtccaatcaattatcgcattaaagtatggttactaataaaaacaaggccaggattttcgtcccgacctcttacctggttagctaataactagctactatgaatgtgaatatgggctaaaaacatccactggacgttccaactcttccccatttctgggagttggggtaaaaatgttcactggacgttccaactcttccccatttctgggagttgggctgatacagtctcccagactgtatcactcctccataaagctgttgaagacttcttcaatcatgttccattcgtcttctgagtcttctgggattggttgcaattcgccttctgttccatcttcgttttcgatgaatgagtaagcttggatttcaacttgtccgtcttcgtcttcttctgcgttaactggtactagaagaacatagtttttaccaaattcttcttttccatcaattgtcaaaaggatttcaaacaaggtttcatttccttgctcatctactagtgtgattagttcacgttcttcgtggtcgtggttatgatcgtgtgacatagcctcgcctttatattaaaattttctatctaaataattttgtaaaatcagctgagctgctaacttatcaatgactttcttgcgcttattgcgactgatatctgcttgttcaatcaacatgcgctcagcagccactgttgtcaagcgttcatcctgatagtctactggtaaaccaaaaaactcttctagctttgctccgtagcttgactagcttctacgcgcggtccacttgtattgttcatgtttttaggcaagcccactacaaatcgttccaccttgtaagtatcaaccaattccttaacgcggtcaaaaccaaattggccttgttcttcatttatctggatgatttcaagcccttgagctgtaaaaccaagcggatcgctaatcgccacccctaccgtttttgaaccgacgtccaatcccataattctcataggttatagatcgactccttgtcctttgaggtagtagcgaaccaattcctcaacgatttcatcacgctcatacttacggatttgatttcgtgcattattataacgaggaacgtaggcagggtctccactcaatacgtaacctacgatttggttaattgggttgtaacccttatcgttcaacgaagcataaacatctgtcaaagtttcgctaatttcttttttattggaatcgtccaatttaaaacgtactgtttcttcagtaaatcccattctaacaccctctttccttagaatagtaccattatagcataattccttaccttctacaattcaggcagtctatttatttggattttctattgttctgtcgcgccatttgccaatctatctgaaatatatttgcttggttcatttttcaaaagattttccaaaccaatattcttcagatgttccaactgggaagccttcttgacatccagaacttgaaaatcaaaactagtcgttgtttgaagttccgttgcgctcaatagttttgtttcaagtttgaaacctgccaatttacgagcttcaatgatagacttatccttctcctccgcttcaagaagagctttttgagtttcctccactccatgttg

SEQ ID NO: 283 - DNA, 1346 bp; double-stranded, linear
cttatccattcactttcttgtctgttattctataaatcttactcctaagtataccacatttgcccctagatgtgaacgagagaaacgctctagacattgccaagaaggaaaaaaaagggtacaatgtaacaaaatcaagggaggtctggaatgaagaaacaaagcaagtacaaagaggtcgtttcctatctgaaaaatggtatcgagtctggacgatttccgacgggtagtcgcctgccttctatccgtcaactgagccttgactttcactgcagcaaggacaccattcaacgagccctgctggaattacggcacgaacaatacctctatgccaagcctcagagtggctactatgtattagaacaagggcaacatcaagacctagaaatcgaggttaccgacgaacatgccagtgcctatgacgatttccgactctgtgtcaatgaaaccttgattggccgagaaaactacctcttcaactactatgacaatcaagaaggattagaagacctaagacagtccattcacaaactcctctttgagcaagctctctactgcaaggctaaccaactagtactgacttctggaacccaacaagccttgtttatcctctctcaaatatcctttcctagacaagccaaggaaatcttggtggaacagccaacctaccatcggatgaatcgcctcttgattgcacaggggctggactatcaaacgattgaacgaggcattgatgggattgacttggaggagctggaaggccacttcaaaacaggaaaaattaagtttttctacaccattccccgatttcactatcccctgggacattcctattctgagcaagacaaacgatctattcttaacttagctgccaagtatgatgtctatatcgtagaggacgattatctgggtgatttggactccaagaagggccaaaccttccactatcttgatacagaggagcgtgtcatttatatcaagtccttctcgaccagcctttttcctgcccttcgtattacagcactcattcttccaaatgctatcaaagaagcatttgtggcctacaaaaatatcctagactacgacagcaacctcattatgcaaaaggccctgtcactctatattgacagtcaattgtttgaaaaaaatcgtttggctcgcttgaccaatcatgaatcttaccaaaaacaaatcgaggaaaggataactaaaacaccttgtccccttcctcattattccctacacgatggyttattgctagacctgagacagtatcctaaaatcgccagtctcaaacacagtcaactgggcttggacttctttgaagaggcctatttaagcacctg

SEQ ID NO: 284 - DNA, 900 bp; double-stranded, linear
ctatattcagaatatgccaaaaattcggaatggtataaatttgcggagggttcatttgacatatttagaaaactcccccaaagaattaattttaagaaagatttttctagaattttggccccctttattattaatttgcttaaattaatcaataattatctagagaataaagaatacgagtggattgacaagaatggaaatattttttcctctctagtattttatttagaagatttaatctatccttggattgttaaacctttggttttagagataaattcattgcgtgaaaaaggtttacttgaaggggaatcggagcagcaacggtacaaatattttataacattgtttgacaaggaagagaatatattaaatttttataacaaatatcccgttttactgaggcaaatatcggagtcttgtcttcggttctatacttattttatagaaattttatcaaatttagaaaatgattttagtgtgctagaagaagaattagggctaagggggaaattaaatgatataaaatttggaaagggtgatacacacagccaaggaaaaactgttttgatactcttctttgatgacgcgaaaattgtttacaagcctaaaaatttaataatcaataactcactaaatactattgctgagtatatccgaaaggttgatgaaaaaattaggataagaatacctcgaactattgcttattcggatcacagctatgaagaatttattgattatctacctctagagcaaaagaaaaatttacctgaatattattataattttggtgtgcttttagcatttatatatttatttaatgggagtgatatacattttgaaaatttaatttcctatggagatatgcctgtaataatagactttgaaacaatgttacgg

SEQ ID NO: 285 - DNA, 862 bp; double-stranded, linear
ttatttagcagaggcagttttaaatgtgaaggatttggtcagtcaaacagttttttatcagcagattattggtttagaaatcctatctcaaacggatacagaggtcgttctgggacttggaggaaaagccttggtacacttgattcaagcacaagagggtggagaagtaagggaacattatggtctttaccatctggctattcttttgccgacacgaaaggctttggcggatgtcttgaagcacctgacggatttacagattcctcttgttggcggtgcagatcacggttacagtgaggccctttacttagaggacttggagggaaatggcattgaactctatcgagataagccagtttccacatgggatattcgagaagatggacgtattatcggggtgactgaagtccttgcggctcaggatatctatgagttgggggaaagagtagagccttttatcctagcagagggtacgagaatggggcatattcatctttctgtcaaggatagtcgaaagtccagacagttttatcaaacggtgttagggctcgaggataaattcagtgtgcctagtgctagttggatcgcagctggggactaccatcatcatttagcagtcaacgaatggggaggaaaaggtctggatccgcgtaaacaagtcctaccaggtttagcctactatgtcatcgaagtcgcacataaagaagaactgttaacgattgcccaacgagcacaagaagttgacgcaccaatcaaatggatgacatcgatccaattggaaatcacagactcagatggcatcgtgacccgtattcgtttagctagatagatggtatgtgatgaaggtagagcatcaattgta

SEQ ID NO: 286 - DNA, 650 bp; double-stranded, linear
tcgtttacaagatcgctaaaatgcatctcatgatcgcgaccacgaattccaagatagcacgcgctacctcaatcatagatagttcacttttttcttgcccagcaaatacttctaattccaaagcgtttctcctcatttatactactatcgccagagcgaacagactctgacctcattttatcatttactctttattttacgataattttgcggaatagtcaaaggttaagggggagaaagtggcaggattagactaattccaatataaaactcattcctttttctgttgctccattttccacaaatccaagcgacttgaaacacctcctagaagcatgattgtaggtgtagattttcttgactctcaattctttccatccttttactcgagccaattcaatcaaagcacttagaatcttttttccaagtcctcgatgttggtaagcggaattcccaatcacaatggggagattatcctgagatagtgtaatatccccaattggaaaccattctcccttctccttgacttcaatccaaaaaagctcaccatgccgatycarataggaatacatggcttccaaggtcgcttgactgtaaggaagcttcaccccatctacgaggtaaccaagttcacatccgtgataccaagc

SEQ ID NO: 287 - DNA, 1119 bp; double-stranded, linear
gatagcaatccgcttcagaaacttctcgcttacctctaactccgatcgctagtttgggagaagatacttccattctcatactatctgttggctttgcaggctgtaaaaacaacttttctcttgctacttcctgaaaatctgaatcttgcagttctttgctttcaaaatagtcctgtactcgctccacatcaaaattcccagctaaagacagagacatgtttacaggtttgtaaaactttgtaaaattttcttgcaaattagttagattgatttgggaaatggactcctcacttccaactatatcagttgctaaaggtgtaccaggatacaaattcgctaaagttgaaaagaataaacacgaatctggatcatcttggtacatttctcgttcttgctgaataatatcctgctctgtcagaatggaagcttcagtaaagtgtgctgatgttaccaattcatcaagtaaatctaaattttctaaaaaataatccgttgctgaaaaaagatagtttgtttttgtaaagcttgtaaaggcattactatctgcacctagactcgtaaaagccgacatcaaatcactagaatcttctctctcaaataatttatgttcaagaaaatgagcaattcctccaggatattgttttacatctccgtcaacttctgtgacaaacgtatctaccgaaccaaactgtacagtgacactcccgtaaacctctttaaattcctttttaggcaaaagagcaactgtcaatccgttggccaaacgagttcgataaaccatttcttttacagctggatagtatttttcttcaaaaacaacctttgtcattctattccttccataaagtaaatcgcttgtagtttcacattattagctactctacaaatagcatctttgtcaatttgttcaagctttgcaatccaacttttaaagtctgctgaagattttccaaataaggcattttgataagcacgttcaatcaatgaagaatgattatcttgagaaagtaacaacgaccaacgaatcatttccttggtctgatttaactcaaactctgtaaaaaaacctttttttaaatcaagccgttgattattcatcaatttacgagcctggttacg

SEQ ID NO: 288 - DNA, 540 bp; double-stranded, linear
acgccctcgcggggacatgacgaattccccgttcatcacgaaggccgccgaggagtggggggtgccgtccaagtcaaaagcggccccacatcgattcagttccccgacgaacagccctttcccccagcgttcctggctttgcaaccgtttcacaacagcctcgtaaagtaggccggacaaggcagacggactccaaaggagttcttccatctgcaagtgcgcctgcgttatgtgatcccggtcttttgcatgtgtgtggcatgaatgctgttcccaatcccactccagaacattctcctcaaaagtgcgcaacgtcgccctgaatgaatcctgccttgtagtcgtgaccattcctatgaagggtcgcagaggattttccccgagtgcaagcgcatcctccggctcaaatcgggtgcatttcacagtcccgctcaacgctagcccgatccctttttggcatggtgactcaagcgtcctttcaaacaaaagctcctcatccgctccaaccggcccgacgtagacgcgtagaccgaagtcgtc

SEQ ID NO: 289 - DNA, 1949 bp; double-stranded, linear
aaagaattcgaccaattcaaggttgaggcatcgcaaactatggactgttcccccgtcagttctggacagaaaacgggataaggttggctgtgaagcaagctgccctcctaccaacaattttggaaagtaggcatcagctgacaattctttacaagcatagtccgttccataacctgttaacagttgaaagaggaactggacaaggatatctgaatccgaataacgacagtagcggcgttggtcattcgttactaaatacttagaaatccgctcttttagtttcaactgggaaaaaagttcctgaaaaaagataagaccaccatactgggttaaatgacctccatcgaaagatagttggtaaaaagacttgttttggaagtgatgatttggtaaactgttcatgtgagtttcctttctttttgtgtttttttctacacttataccataaaggggaaactcttttttgtctagtaaaaaacacccattgggtgaaaaaagaaaccatccaggatctaagctaaggcaaggattctggatggtttttagatttggggtgaataattggggttttacaatatcaactcccatgatagtcatgagatgactcttcacgaattgacgtgatgactgtccttccttttgcataattacctccgaaacacaaaaaaaggggtagacaatctagtgtctacccccgaaagtttattaaaacaaaaatcctgccaaagaatttttggcaggaaaccaaatcaatttatcagtttctatcaatcgcttatcgctctcaaagactggtaaatagggattccgcaatcaaattgcgatactctattatttaagagtaactgaagctccagcttcttccaatttagctttgatttcttcagcttctgcagttgcaacgccttctttaacaagtgctggtgcaccgtcaacaagttctttagcttctttaagaccaagaccagtgatttcacgtacaactttgataacgccaacttttttgtcgcctgcagatgtcaattcaacgtcgaatgaatctttagcagcaccagcatcagctgcatcagctgcagcaacagctacaggagcagctgcagttacaccaaattcttcttcgatagcttttacaaggtcgttcaattcaaggattgaagcttctttaatttcagcaataatgttttcaatgttcaatgccattgttatttcctccaaataagttttaaattttataatagtttttttcgtagctagkstacgctgtgtagcttaagattaagccgcgtcttctttgctttctgcaaccgctttgactgcaagagcaacgttgcgcactggcgcttgaagtacagaaaggagcatagaaagaagtccttcgcggtttggaagagttgcaagtgcaagaatctcttctttagatgcgacagcgccttcgattgcaccacctttaatttcaagtgcttcagcgtttttagaaaagtcgttcaagattttcgctggtgcgataacatcttcattagaaaatgctactgcagatggtccaacaaatacagatgcaagatcttcaagaccagctttttcagctgcacgacgcaagattgagtttttaataactttatactcaacttcgcttccacgaagctcacgacgaagaactgtatcttgctcaactgtcaaaccacgagcgtctacaacgacgatagatgcagcagctttcattttttcagctatacgtcaactagttccgcttttttagcaataattgcttcactcattagtgtgttcacctccgtaattattttgcttggggaatttttcaaaaagaaaaacgcgcccaatcctagacacgaaagtacaatacgcttctttttacatgatacgttttgtcctcggtaggatatttatgagtcgagctcccctactgtcttaggcagtttttttagatacgg

SEQ ID NO: 290 - DNA, 1023 bp; double-stranded, linear
ggactgtttgatcttatacagtagctgcttgatccaagctttcaccgatagcggctaggcgctcgataacttcagcttgtgtcaattcattttttgaaacatagcggttacgtgggtgaacacggcactcgtgtgagcatccacgaaggtacttgtcttcattttcttctgatgtcaagatacgacggttacagaatggatttccacagttgacataacgttcacatggtgttccatcaaaccagtctttccctacgatagttgggttgacatggttgacatcaacggcaatacgctcgtcaaagacgtacattttcccatcccaaagctcaccttgaacttctgggtctttaccgtaagttgcgattcctccgtgcaattggccgacatctttgtagccttcacggaccatccagcctgagaatttctcacagcgaacgccacctgtacagtaaaccacgacacgcttgtccatgaatttttccttgttatcacggacccattgtggtaactcacggaagttgcgaatatctgggcgaatagctccacggaaatgtcctaggtcgtactcataatcgttacgtgtgtcaaggacaacggtatctttatcaagaagcgcttctttgaactcttttggagacaagtaagcacctgttgtttcaagtgggttgatgtcattgtcaaagtcgttgtcttccaaaccaaggtggacaatttctttcttgtagcgaacaaacatcttcttgaaggcttgttcattttcttcgtcaatcttgaaccagagttcttccattcctggaaggctgtgaacgtagtccatgtatttttgagttgtttcatagtcacctgaaactgttccgttaattccctcgtcagcgactaggatacggcctttaaggncgattgatttacagaaagccaagtggtctgcagcaaattgctctgcattttcaattggagtataaaggtagtaaagtaagacacgaatatcttttgkcawaagatttgtatctctttatctat

SEQ ID NO: 291 - DNA, 3831 bp; double-stranded, linear
actatgaacaagacccagaaaaagtagccttatttcttaagaattttaatagtttaaagcacctagcacctgtttagattgacgaaacaggattcgatacttatttttatcgagaatatggtcgctcattaaaaggtcaattaataagaggcaaagtatctggaagaagatatcagaggatttctttggttgcaggtctaacaaatggtgaattaatcgctccaatgacttacgaagagacgatgacgagcgacttttttgaagcttggtttcagaattttctcttaccaacattaaacacaccatcggttattattatggataatgtaagattccatagaatggggaagctagaacttttatgcgaagagtttgggcataaacttttacctcttcctccctactcgcctgagtacaatcctattgagaaaacatgggctcatatcaaaaagcacctcaaaaaggtattaccaagttgcaataccttttacgaggcttttttatcctgctcttgtttcaattgactatattagaggcgagacatttttcggttctttgtcaactgtagtgggttgaagaaagcgaagatctagaaaggacaaatttcgtcctttcttttttgaagttttcaaagttcctaaaaccaaaggcattgtgcttgataagtttgatgagattattggtggcttccagtttggcgttggaataaggtaattgaagggcgttgacgattttctctttatctttgaggaaggttttaaacaaagtctgaaacagaggtggaaaagcaagagctgatagagattatagtggtgtttaaagtcttcggaatagctcaaaagtttatctagaatttctttattagtcaagtgcatacgaaaagtagggcgataaaatcgtttatcactcagtttctgactatcttgttgaatgagcttccagtagcgcttgatagccttgtattcatgggatttcggatgatggcttgtgttctgctctcaagaacagttatgatattgagtttatcaaagtcctgagcaataaagctcatctccatctcccgattgaaacagtcactccccggactgtttcaacstcctaggacataatctcaggaagacgcgaaaaatcatgctcaaagtgaaaatcattgttcttgcgaatgacagttgaagttgaaatagacaactgatgatcaatgtcggtcatagaagtctttttaattagcttctgagcaatcttttggttgatgatacaaggaatttgatgattcttcttgacgatagaagtctcagcgagctccatttttgagcaatgatagcacttaaaacggccttttctaagaagaattctagtttgaatttttttatactagaaaatcagaaccataatacctatataaaaatattatagttctaataggatttacccaaaagttttaaggcggtctttttagaactttaattgtttgaaatttaggtagcaaatttgtttctattttgtcaacttttcctatttttatcttgttgaggctggtattttaacaattcaggaattgatagtgaatgtgtaaaattttttgttagaataagtttataaaaaagaaaaggagtatttgattatgttacaaaaaatttatgagcagatggctaatttctatgatagtattgaagaagagtatggtcctacatttggtgataattttgactgggaacatgttcattttaaatttttaatttattatttagtgagatatggcattggttgtcgtaaggattttattgtttaccattatcgtgttgcttatcgtttgtatcttgaaaaattggtaatgaatcggggttttatttcttgttgaggtaattttagtaaatttccgaactaatttactcttttatggaaagatgatagtaaatagctagtaatttttctaaatcattttttaatagttggaaatagcaaatctttctattgtttcttcttgataaaaaggcgattttttattataataaattgtaagatataattgcaggtgagagtcctgccatgtatgtgagaaaggaagagcctgatggctcagacaagattatgacttcagttgttgttgtaggtacccaatggggtgatgaaggtaaagggaagattacagacttcctttcagcgaatgcagaagtgattgcacgttaccaaggtggtgataatgctggtcacacgattgtgattgacggtaagaaatttaagttgcacttgattccatctgggattttcttccctgaaaaaatatctgtcattgggaatggtatggttgtaaatcctaaatctcttgtaaaagagttgagctatcttcatgaggaaggtgtaacaactgataacttgcgtatttctgatcgtgcgcatgttattttgccttatcatatcgagttggatcgcttgcaagaagaagctaagggcgacaataagattggtacgacaattaagggaattggtccagcttatatggacaaggctgctcgtgttggaattcgtattgcagatcttttagataaagatattttccgtgagcgtttagaacgtaaccttgctgaaaagaatcgtctttttgaaaaattgtatgacagtaaagcgattgttttcgatgatatttttgaagaatattacgaatatggtcaacaaatcaagaaatacgtgatagatacatctgttatcttgaatgatgcgcttgataatggcaaacgtgtgctttttgaaggtgcacaaggtgttatgctagatatcgaccaaggtacttatccatttgttacgtcatcaaaccctgtagctggtggtgtgacaattggttctggtgtcggtccaagcaagattgacaaggttgtaggtgtatgtaaagcttatacgagtcgtgtaggagatggtcctttcccaactgagttgtttgatgaagtgggagaacgtatccgtgaagtgggtcatgaatatggtacaacaactggtcgtccacgtcgtgtaggttggtttgactcagttgtgatgcgtcatagccgtcgtgtttctggtattactaacctttctttgaactctattgatgttttgagcggtttggatactgtgaaaatctgtgtggcctatgatcttgacggtcaacgtattgactactatccagctagtcttgaacaattgaaacgttgcaagcctatctatgaagagttgccaggttggtcagaagatattaccggagttcgcaatttggaagatcttcctgagaatgcgcgtaactatgttcgtcgtgtgagtgaattggttggcgttcgtatttctactttctcagtaggtcctggtcgtgaacaaacaaatattttagaaagtgtttggtcctaagagatttttaagatttgtttaagataggtcgggtatactatagacggttacaagaagacctcctaacttgttgtaacaaatatcctaaacttttctttttcataataatctccctatagagtcaccgcattcggtggctttttttgtgttgggattcatgatataataataaaatcgataagtaggaaaagagaaaagagatgtattatacgcttgaagaaaaagaagtctttatgagggaggctttgagagaggctgagattgctcttgaacacgatgaaattccaattggttgtgtgattgtcaaagatggggaaatcattggtcgtgggcataatgcgcgtgaggaattacagcgagcggttatgcatgcggaaattatggctatagaggatgcgaacttgagtgaggagagtgcgcttgctggattgcacactttttgtgaccattgaaccg

SEQ ID NO: 292 - DNA, 1441 bp; double-stranded, linear
ccgctgttccaaccgcaacataccatagtccgtacgggattcgaacccgtgttaccgccgtgaaaaggcggatgacttaaccccttgaccaacggacctgagttgttattttcaactcttactattatacagtcttttcaaactttgtcaactactttttctaatttttgtttattttttcaacttatagtaaaaaaagccagaattatactgactcttctatcgctcattaaacttagaagcacgttcttttccccaccaataagggattagttctgcgactttaactgtttttcttatattatagtccatcatgaattctgcatctttattttcagcattaagctctaaaaggaattctctacaagcaccgcaaggcatggctgaacttccaccataaggtggtttgtctcgaaaggctaatactttcttaaccttagtttgtcctgaaaattggtacatattgaagagggccgcccgttctgcgcagagatggaaaacaccacaggttccctccatacagaatcctgtaaatatttgtccatctcctgcttctactgcagctacaacatgattggcataaacaaagtctgatacttcatgtggattgtatagtttctgtgcttcttcgtacatcttttcccagatgtccattattgtatcctctttatttagagatttcttttagcatgttttcgatatgctgaattgatttttcacgtccaagcaagaaaattgtatctggtaattctggcccatgcatttcgcctgaaactgcgatacgaataggcatgaaaagatttttccctttaatacctgtttctttttggactgctttaatttgtgggaagatattttctgtcacaaattcatcatctgtcatcgcttcaagttttgctttgaatgcttcaagaactgttggaactgtttcacccgtcatgacttcgcgctctgcttctgtcaattctgggaaatctgagaagaaaagatctgtcaatgggataatctcatctactgatttcatttgtggtttatagagctcaactaatttttcagccttgtcagtcaaacggcctgcttcctctaagaatggttttgccatttcaaagatggtttcaaggtctgcattcttgatataatcattgctcatccagtctagttttttctgatcaaaggctgctggtgacttgctgaggcggttttcatcaaaaagtttaatgaattcttcacgagagaaaatctcatccccaccacctgggttccaaccaagaagagcaataaagttaaagactgcttctggaaggtaacctttctttcggtaatcttcgataaattgaagtgtattagtatcacgtttagataacttcttaccagtttcagagttgataatcaagtgtcatgtgaccgaactctggagcttcctcaacctaagagcgggtat

SEQ ID NO: 293 - DNA, 4398 bp; double-stranded, linear
cggcttatgtagtggcaatctttctacgtaagcgaaacgaggggagattagaggcgctagaagaaaaaaaagaagaactatacaatcttccagtaaatgatgaagtagaagctgtaaaaaatatgcacttgattggacaaagtcaagtggctttccgtgaatggaatcaaaaatgggtcgatttatctctcaactcttttgccgatattgaaaataatctctttgaagcagaaggctataaccattcatttcgttttctcaaggccagtcatcaaattgaccaaattgagagtcaaattactttgattgaagaagatattgcggcaattcgcaatgctttggcagacttagagaagcaagaatctaaaaatagtggtcgtgttcttcatgctttggatttatttgaggaacttcagcatagagttgctgaaaattcagaacagtatggtcaagccttggatgaaattgaaaaacaattagaaaatatccaatctgaattttcacaatttgtaaccttgaattcatcgggtgaccctgtggaagccgcagtgattttggataatacagaaaatcacattttggccttaagtcatattgtggatcgtgttccagccttggttacgacgctttctacagaattgccagatcaattacaggatttggaagccggttatcgtaaactaattgatgctaattatcattttgttgaaacggatattgaagcgcgtttccacttgctttatgaagcattcaagaaaaaccaagagaatattcgtcagttggaattggataatgccgaatatgagaatggacaggcacaagaggaaatcaatgccttgtatgatatttttactcgagaaattgctgctcagaaagtagtggaaaatctacttgcaactcttccaacttatcttcaacatatgaaagagaataatactttattgggagaagatattgcacgtttgaacaagacctatttacttcctgagacagctgcaagccatgttcgtcgtattcagacagaattagagagttttgaggcagctattgttgaggtaacttcaaatcaagaagaaccaacccaagcttattcagttcttgaagaaaatcttgaggatttacaaactcaactaaaagatattgaagatgagcaaatttcagttagtgagcgcctgacacaaattgagaaagatgatattaatgcacgtcaaaaggccaatgtttatgtcaatcgtctccatactatcaagcgatacatggaaaaacgcaatctgccaggtattccacaaactttcttgaagttattctttacggcaagcaataataccgaggatttaatggttgagttagaacaaaaaatgattaacattgaatctgttacccgagttcttgaaattgcaacgaatgatatggaagctttagaaacggaaacttataatattgtacaatatgcaactttgacagagcaactcttgcaatattctaaccgctatcgctcatttgatgaacgcattcaagaagcatttaacgaagctttagatatttttgaaaaagaatttgattatcacgcttcatttgacaagatttctcaagcattggaagtggcagagcctggtgtaaccaatcgctttgttacctcatatgagaaaacacgtgaaacgattcgtttttaataaaagaaaaagattttattgtgtgaggagcagaatcaaatctttttctatagttgtggggagatttacttcattttctcctgagattgagtttttgcccagccgatttatccactacctcaaaacagtgttttatactcttcgaaaatcttttcaaatcacgtcagcgtcgccttaccgtactcaagtacagcctgaggctagcttcttagtttgctttttgattttcatttagtattaaagtgatttcgccagtcttatctgcagcttcaaatctgtactttgagtaacttggtaaccgtccaataacgaagtctattgaaaaatctccagactagagaactcacggatagttcctaatctggagatttcttatttgcacttttcttgtacaactttagtccacggtaaatagacctctaaaacctctttgtttacgagagtttcctcgtttggaagacattctagaagataggatagatatttctcgctatttatactagactaaaatcaaaaagcattatataatagtgatatgaaatcaactaaagaagaaatccaaaccatcaaaacacttttaaaagactctcgtacagctaaatatcataaacgccttcaaatcgttctatagtaaaatgaaataagaacagtacaaatcgatcaggacagtcaaattgatttctaacaatgttttagaagtagaggtgtactattctagtttcaatctattatatttcgtctgatgggcaaatcttataaagagattatagaacttttatagtagattgaaataagatgtgaacaactctatcaggaaagtcaaattaatttatagaaatattttagcagccaaggtgtactgttatagattcaatacactatagactgtaatcaaacaacgatttggcgaaatgtaaaaaaatatgaggagttcggactcgactctctccttcaagaaacacgtggtggtcgtaaccatgcatatatgacagttgaggaaaagaaagtctttcttgcccgccatttgaaggctgcagaggcaggagaatttgttacaattgatgccttatttcaggcttataaaaaggagttaggtcgttcctacacacgtgatgccttctatcaactgttgaagtgccatggttggcgaaatattatgccacgtccagaacatcctaagaaagcagacgctcaaaccattgtcgcgtctaaaaataaaatctcaattcaagaagaaaagaaagcgctttaaaaccagtagacgttttcgtaaggttcgcttgatgtaccaagatgaggctggtttcggtagaatcagtaaactgggatcttgttgggctccaataggagtaggtccacatatccatagtcactatatacgagaatttcgctattgttatggagctgttgatgcccatacaggcgaatcatttttcttaatagctggtagatgtaatactgagtggatgaacgcctttttagaagagctttcacaagcttatccagatgattatcttttactcgttatggacaatgctatatggcataaatcaagtaccttaaagattccgactaatattggttttacctttattcctccatacacaccagagatgaaccccattgaacaagtgtggaaagagattcgtaaacgtggatttaagaataaagcctttcaaactttggaagatgtcatgaatcaactccaagatgttatacaaggattggagaaggaggtgataaagtccatcgttaatcggagatggactagaatgctttttgaaaacagatgagtataaaaagaaagtcctcatttcaatagaaatcacgactttctgatggatttatagtaaaatgaaataagaacaggacaaatcgatcaggacagtcaaatcgatttctaacaatgttttagaagcagaggtgtactattctagtttcaatctactatatttttggagtgatagaaaagcccttcataagctagtctacttgttcaggtgcgagagctttgacatctttttctgtacttagccaagtcagttttccgttctcaaagcgtttatatagtagccaaaatccttgaccatcccagtaaagggctttaaagcggtctttacgtccaccacaaaagagaaagacttgaccggagaaagaatccaattcaaagtgggttttaactacataggctaatgagtctattccctgcctcatatctgtcttgccacaaacaaggtgaacttgacctaaatcacttagttgaattatcatagtacaatacctttcctccgataattattttttatctagtatactggaagttggggaattaggatagataccttgttatgacgcgcttacgtaacttgtaactagctgcctagtttgatctttgcttcttcattgattagcagtagatttcaaaatgataaaaacgcatagtatcaggtattgaaatgtactgccccaaaagttagacagaaaaaatctaacttttggggtgtttttgttatgaaattaagttatgatgataaagttcagatctatgaacttagaaaacaaggatatagcttagagaagctttcaaataaatttgggataaataattctaatcttaggtatatgattaaattgattgatcgttacggaatagagttcgtcaaaaaaggaaaaaatcgttactattttcctgatttaaaacaagaaatgattaataaagtcttac

SEQ ID NO: 294 - DNA, 718 bp; double-stranded, linear
agatttttagactttgtctttaatcgtttctttttagggatgattgcgacaccttcttttggctattaactttagcaggagggattatccttggtctagcgccggctagtgccaccttgatgagcttatatgcagaacatggttatagctttcgggaatacagtttgaaggaggcttggtctctttacaagcaaaattttgtctcaagcaacctgattttctatagctttttaggtgtgggtctagttttgacctatggtttgtatctcttggtgcaattgcctcatcagaccattgttcatttgattgcgacccttttgaatgtcctagtagttgccctgatctttttggcttatacagtatctttaaaattacaagtttattttgccttgtcctatcgaaatagtctcaaattatccttgattggcatctttatgagtctagcagctgtggctaaggttctccttgggactgtgctacttgtagcaattggttattatatgcctgccctgctattttttgtaggaattgggatgtggcatttctttatcagtgatatgttggaacctgtctatgaaatcatccatgaaaaattggcgtcaaaatagaatgaagcagttttggctacatacgcttctaagaacctatagttcagtgatgatcattatcattgcgagttttgcaatcttactctcttacgctgtctgggattcacgtg

SEQ ID NO: 295 - DNA, 718 bp; double-stranded, linear
tcggtaccaaaattctggatttatactagcaaagatccaagagcaaattatttaacagatttaggtctagttttccctgaatcattaaaagaatttgagagtgaagatagttttgcaaaggaaatttctgcagaagaagcaaataagataaatgatgctgatgtaatcataacttatggtgatgataaaactcttgaagctttacaaaaagatcctcttttaggtaaaataaatgcaattaaaaatggtgccgttgctgtaattccagataatacaccgttagcagcctcatgcactccaacaccactttcaataaactatactattgaagaatacctaaatcttttaggaaatgcatgcaaaaatgcgaaataaaaaacaaataaacctaggcataatttttataatctgcctaggtcttcttattacaatatttttgtcattaaagcttggaacaaaagaaattaatatcagagattttttagcagcttttggaatgggtaatacaaatgatgattttattaaatcaattatatataaragaatacctagaactatttttgcaattttagcaggttctagtcttgccataagcggtgtattgatgcaatcagttactagaaacccaatagctgatccaggtatactcggtataaacacaggagcaagtcttagtgtagtaattggtccttctttttagggaattcatcaagcataa

SEQ ID NO: 296 - DNA, 1436 bp; double-stranded, linear
gaactaatcatttttacaggatgagatttacagcagagagtttgaaggctttatcaaaggtttttcttggcataatgacttttcctcgtttccacttaattttgtgtctactttattataccaagtccacscttaagttagataataaatctaacttaaggaagctagaaggatgagaatccaggtggtcaagagtcccaaacttaagctgatggggacacccagaataatttgctttttgaaggcaaggccacgttcctctatattgggaagtgagagttgaatgagagaaccagctgatgaaaagggtgagatattagtagatagagcgccaataacggtggctgttgtgagtaagtgaatatcaatctgaggattttgagcactgatgatagcaatgatgggaaagagggctggagctacaacggatagggtggaactaaagagtgacatcactccggctatcacacaaaagaacagaggtaaccagaaatgaggaatggttgttgtcatgaggtgccctatcagtgtgactaaacctgacttgaccgctagagacattagtaagctcatgccgcagagcatgataattgtagcccagggaaccttagctaaaatggcttcttgcttccctaatttgagccttaaggcgaggcagaccatgagtattgagacaaagccaatatcaaatgttttttgataagtagctatccaggcgatgtttgggaaaatgagatgcaacaagggaaaaagccaaaccaaaaccatgctgctgatcatgagcaaggtggtttgtctttgaaccttgctgaggagtggtggttggtcaatagtcaaggatgagtttgttcttcccttactatagtgactgtaacaggataataaaagcaagacgatgagtgggtagataatgctgacgataaagatatgattgccaagtgaaaaagcttgctcttcccatcccatttgcttaaacaggccttgaaagacaatgcctgagctactggttatcaaattagcccctcctgaagctccccaattgacggcttgagctccaatcaaagggtgtttgtccgctttttgacagagggtaatcgctagaggacagcaaacggccatagtagtgaaaaatccagcacctaaagcagacaaaagggttgccatcaggtataaaatcatgtagagggcgttagggtgggtgcgtgtgcggtagagaatgtgttgagccaaaacatcaagagtaccgttagttgttgcaacgttataaaagagagagacgctaaaaatggtaaaaaagagtgaggttggccaaaaatgaagaagttctttggggcttaatcccatgagagtggttgcgatgaggtaagaaaaagcaatagccagcaggccaatattgattttggtgcggtaaccaattccaatggctagagcaatgg

SEQ ID NO: 297 - DNA, 1696 bp; double-stranded, linear
ccatttgggaaagaacgtaagagtttgcagggtgagattccagaagaattttcaatgtcagccgttgacatgtctatgattgaccacattccagatatgattgaaaatggtgtggacagtctaaaaatcgaaggacgtatgaagtctattcactacgtatcaacagtaaccaactgctacaaggcggctgtggatgcctatcttgaaagtcctgaaaagtttgaagctatcaaacaagacttggtggacgagatgtggaaggttgcccaacgtgaactggctacaggattttactatggtacaccatctgaaaatgagcagttgtttggtgctcgccgtaaaattcctgagtacaagtttgtcgctgaagtggtttcttatgatgatgcggcacaaacagcaacaattcgtcaacgaaatgtcattaacgaaggggaccaagttgagttttatggtccaggtttccgtcattttgaaacctatattgaagatttgcatgatgccaaaggcaataaaatcgaccgcgctccaaatccaatggaactattgactattaaggtgcctcaacccgttcaatcaggagatatggttcgtgcattaaaagaaggactcatcaatctttataaggaagatggaaccagcgtcacagttcgagcttaagaaaggaaaaggaaatgatagaggcacagggtttcttagtggataagcaaacaagatgcattcattaccatagcaagctggatattattgctttacaatgctatgattgtaaaaagtattatgcttgttatcggtgtcatgattcattagaacatcacccttttgagccgtatcccttatctttgatacaggataagcctattttatgtggtgtttgtctaaaactactaacatataagcaatataaagaaagcttaagttgccccttttgtttttctcgctttaatccaggttgccaaaatcataaggaacgctattttaaatagcaaatcatctagttttgaagtaggagaaaactcaatttcaagagaaaatgaagtaaatcttcccacaataaaacgcataatatcaagattgttcaatacctgatactatgcgtttttaagattttaaagacttttttcctttatctggtattttgactacttgttaaaactgggttaattttcgactgtttaatagttattatgcaaagtctaaaaggttagaattgtcaaaacaatccgtctagagtatgcgtgatgccaaccgtggtggatgttctcagtcatgccgttggaagtacgacctttacgatatgccatttgggaaagaacgtaagagtttgcagggtgagattccagaagaattttcaatgtcagccgttgatatgtctatgattgaccatatctcagatatgattgaaaatggtgtggacagtctaaaaatcgaaggacgtatggagtctattcactatgtatcaacagtaaccaactgctacaaggcggctgtggatgcctatcttgaaagtcctgaaaagtttgaagctatcaaacaagacttggtggacgagatgtggaaggttgcccaacgtgaactggctacaggattttactatggtacaccatctgaaaatgagcagttgtttggtgctcgtcgtaaaatccctgagtacaagtttgtcgctgaagtggtttcttatgatgatgcggcggta

SEQ ID NO: 298 - DNA, 1022 bp; double-stranded, linear
ccgagtttattatggtttcttcggaatttatctcaaagattgaatttgcttgcaataagaaagaaagtctttatagtcaaagcaaatttaagtatgcgattcgttcgatgttcgcaggtgcatttttaaccttcagtactgctgcaggtgcagttggggctgacttgattaataaaattgcaccaggtagtggacgcttcctctttccattcgtttttgcttggggcttggcctacattgtttttttgaatgccgagttggtcacttcaaacatgatgttcttgactgctggtagtttcttaaaaaaaatctcttggagaaaaacagctgagattttactatactgtaccttgttcaaccttatcggagccttgatagcagggtggggctttgctcattcggcagcctatgcgaatctgacacacgatagtttcatctcaggtgttgttgagatgaagttaggccgctcaaatgaattggtcttgcttgaggcgattttggcaaatatttttgtaaatattgcgattctgtcatttattttggtcaaagatggtggtgccaaactttggcttgtgttgtcagctatttacatgtttgtattcttaacaaacgagcacattgcggcgaactttgcttctttcgcgattgtgaaattcagtgttgctgcggattcaattgccaacttcggtgttggaaatatgcttcgccactggggtgtgactttcatcggaaactttatcggaggaggcctcttgatgggtcttccatatgccttcctcaataaaaacgaagatacttatgtagattaagaaaatgagcacgattgagtcgtgcttttttcattttcaaaataaggtaatagctatttcttatatcaaaatatagaaaactgatatttgtaractataactcaaggtgctacaatatccttaataaaataatatggaggtcaccttatgacttgtgattttaaatntgaaactctacaactacatgctggtcaagttgtggctccagctact

SEQ ID NO: 299 - DNA, 663 bp; double-stranded, linear
ccttaagtaatctctgataatattttctttattagcataggggaatatcgatataatggcttcattatgagtggcaggaatatccaatatggcaacttttccaatagataatttaaaactcattaataaagttcctttaggtgaaatgtctattttctttgattttaatgctaatttagaaatagattctctcgcattagttacataaccagatataggcatatctgatatagatacccaaggtatttcagttccccaaaaagtagcttcactgcgtggaggagtttttcctattctgaagttaactaggctagcaaatttaatatatctccatgcttctgggatttcatatataggataagaggttgtttcgtctttgttcccataataagagttatcatctccttgggaaacaatagaaatgtccaaatctttctttttaatcttgccttcttcaaagagtttttgtttttctgctcgtattttttcaagtaaaacttcgactgattcatcatttgggtcttgttcaactaattttccttgcatagcatattgaagaatagatttttttagtttatctggaaattctttatctagctgttctagtctattataactttcagcatattcatctactttttctaaagctgattcgattgcttc

SEQ ID NO: 300 - DNA, 881 bp; double-stranded, linear
cgtcgctgaacatgtcaacagcaaattaaactaaacaaactaaaattatgtgatacttcacataattttctttagaaaatattatcagaagaaagttgagaaaaatggcagaaaaaacatatcctatgacccttgaggaaaaggaaaaacttgaaaaagaattagaagaattgaaattggttcgtcgaccagaagtggtagaacgcattaagattgcccgttcatacggtgacctttcagaaaacagtgagtacgaagcagctaaggatgaacaagcctttgtcgaaggacaaatctctagcttagaaacaaaaatccgctatgctgaaatcgtcaatagcgacgcagttgcccaggacgaagtagcgattggtaaaacagtcaccatccaagaaattggtgaggacgaagaagaagtttatattatcgtaggttcagctggtgcagatgcctttgtaggtaaggtttcaaatgaaagcccaattgggcaggccttgattggcaagaaaacaggtgatacagcaaccattgaaacgcctgttggtagctatgatgtaaaaatcttgaaggttgaaaaaacagcctaaaaacagaaaaaggagtggggaggcgatgtgcttcactcactcctttttccattttgctactcttcgaaaatctcttcaaaccacgtcagcgtcgccttgccgtatgtatggttactgactttgtcagtttcatctacaacctcaaaacagtgttttgagctaacttcgtcagtttcatctacaacctcaaaactatgttttgagctgacttcgtcagtttcatctacaacctcaaaaccatgttttgagccgacttcgtcagtttcatctacaacctcaaaactatgttttgag

SEQ ID NO: 301 - DNA, 949 bp; double-stranded, linear
ccttttttaatacaagttattttgatttaaccggcttgtcttgagctgtctgcaaagctgtggcaatcgtatctgcatacaattttgctcctgcttcgatagtgctactctcactcccgaaatgaacctggtctgttccagcccaaatttctggatgctctttcgcaacttgattccaatctgctatcgtaatgtaaggtgtcttctctgccaattctctcatataggcagcagccttctcaacgatggcataggtctcttttgtcttatctccctcataaggagtcaccaaaatcatatggtgtcccttaggaagatttttcacgatactgtcccagtcatccttgtaattctcaggattatttaccccagtcgcaatgaccaccgtcttaggtaaaaatttattctggctattatttagcatgatttcatttgcggtcttggttgttacgctgacctgcgcgttaatctgtgctccaggaagagctgtctgtagtgctgtatttgcccttaaagccactgagtcaccaattaacatagtgccatcagcaattcccaaactgtttgcatctgcccgttctgccatcaccttggtctggccaatatttgttgcagcttgcttcaagccattgacagtcaagtctgtctcaaacgctcccacttgtggtgccaacaaggtcaccgtgcagacaatgatggtcaagattcctgtacctgctgcaagaattgcgtgaatataaggcaggggacgaasggtttggacaataggtgtgttcttgcctgcaatccaaggttccaatacataaaatgacagactggcaaagccataagaacaaatcagagtcagtaatacagcaagaagatttgatgtcaactgtgagaaaatgatatagaaaggccaatggaaaagataaaccgcatagctagtatccgctaaaaagctgataat

SEQ ID NO: 302 - DNA, 622 bp; double-stranded, linear
aagatatattttttacacagaagtatgcaaaagtaaagagtgcaaaaaatggaattaaagcgaaaataaaagccgtgtacaggcgaccaaaccaacgtacacggctaaggaaaaataacaaaactcaagcaaaggcaaggcgcgtggttttgttaggtatttagcaaggggacaaacccctttgtaaataatctcctcttattttatcaaaattagaggaaaatgacaacttaatttataaaaaggaaaaatggaggatataaatggaaattctgtctaaagaaatacagttacagggcttacaacttcttaaacagactcttgaaactttagttgagctagaaaaacaacgatctagtaagttagatttaatttctcgtaaagaattaatggatctgctaggtataagtgctacaacccttgataactgggaggatcttggtcttaaacgatatcagactccgatggatggagctaagaaagtattctatcgtccgtcagatgtgtatttatttttagcaataaaataggagttatgaaatgaaaattgttactttcaaaccaactaaacaaatagacgatgggttttaactgccaggtattgacattctatttgtctcag

SEQ ID NO: 303 - DNA, 1929 bp; double-stranded, linear
cgctaacttgcaaacaaaagaagaacgcaaactccacaaatcctttacgcagaaactcaatctcatctacttaccttgctgacttggtagagtatgttgcagacaaagacttctcagtaaacgtaatttctaaatcaggtacaacaactgaaccagcgattgctttccgtgtctttaaagaactcttggttaagaaatacggtcaagaagaagctaacaaacgtatctatgcaacaactgaccgccaaaagggtgctgttaaggttgaagcagacgctaacggttggggaacatttgttgttccagatgatatcggtggacgcttctcagtattgacagccgttggtttgctttcaatcgcagcatcaggagctgacataaaagctcttatggaaggtgcgaatgcagctcgcaaagactacacttcagacaaaatctctgaaaacgaagcttaccaatacgcagctgttcgtaacatcctttatcgtaaaggctatgcaactgagatcttggtaaactatgagccatcacttcaatacttctcagaatggtggaaacaattggctggtgaatcagaaggaaaagaccaaaaaggtatctacccaacttcagccaacttctcaactgacttgcactcacttggtcaatttatccaagaaggaactcgtatcatgtttgaaacagttgtccgtgttgacaaacctcgtaaaaacgtgcttattcctactttggaagaagaccttgacggacttggttaccttcaaggaaaagacgttgactttgtaaacaaaaaagcaactgacggtgttcttcttgcccacacagatggtgatgtaccaaacatgtatgtgactcttccagagcaagacgctttcactcttggttacactatctacttcttcgaattggcaattgccctttcaggttacttgaatgctatcaacccatttgaccaaccaggtgttgaagcttataaacgtaacatgtttgcccttcttggaaaaccaggatttgaagaattgagcaaagaacttaacgcacgtctataatagaagaaaagagtggtttgcccactctttttactctctttatccatagaaattggactcagccaagacttgtgatataatatagaaagcaaaaaggcagacgcctagataataggagaaactatgtcaaaagatatccgcgtacgttacgcaccaagtccaacaggactactacacatcggaaatgctcgtacagcattgtttaattacttgtatgcgcgccatcatggtggaacatttctcatccgtatcgaagatactgaccgtaaacgccatgtcgaggatggtgaacgttcacaacttgaaaaccttcgctggttaggcatggattgggatgaaagtccagaatcacatgagaattatcgccagtctgagcgtttggacttgtatcaaaaatatattgaccaactattagctgaaggaaaagcctataaatcttacgttacagaagaagagttggcagctgaacgcgaacgccaagaagtagctggcgaaacaccacgctacatcaatgaataccttggtatgagtgaagaagaaaaagcagcttacatcgcagaacgtgaagcagcagggatcatcccaactgttcgtttggctgtcaatgagtcaggtatctacaagtggcatgatatggtcaaaggcgatatcgaatttgaaggtggcaatatcggtggtgactgggttatccaaaagaaagacggttacccaacttacaactttgccgttgttatcgatgaccacgatatgcaaatctctcatgttatccgtggagatgaccatattgctaatacaccaaaacagcttatggtctatgaagctcttggttgggaagctccagagttcggtcacatgaccttgattatccactctgaaactg

SEQ ID NO: 304 - DNA, 708 bp; double-stranded, linear
aaatttaagaaaaaggagacacatcatgtctaaaaaagtattatttatcgtcggatcactacgtcaaggttctttcaaccaccaaatggcgctcgaagctgagaaagcacttgctggtaaagcggaagttagctaccttgattattcagcccttcctctcttcagccaagatttggaagttccaacacatccagctgtagctgctgctcgtgaagcagttctcgttgcggatgctatctggattttctctccagtctacaacttctctatccctggtacagtgaaaaacttgcttgactggctatctcgtgcccttgacttgtctgatacacgtggcgtttctgcccttcaagacaagtttgtcacagtatcatctgtagccaatgcagggcacgatcaacttttcgctatctacaaagacctcttgccatttatccgtacacaaggcgttggtgatttcactgctgcacgtgttaatgactctgcctgggcasacggaaaattggttcttgaagaaacagtcctaaactcacttgaaaaacaagctcaagacttggtcgaagctatcaagtaactaacactcaataaaaatcaaaaagcaaactakgaagctarccgcaagctactcaagcactgctttgaggttgtagatagaactgacgagtgtnnaacatatatacggtaaggcgacactgacgtggcttgaan

SEQ ID NO: 305 - DNA, 781 bp; double-stranded, linear
cttcttttcttggaaataggtgtataatacgtttattaaatttttgaggagttgtctatgaagaaaagttttatccatcaacaagaagaaatttcctttgtcaaaaacacttttacccagtatttgaaagataagctagaagttgtcgaagttcaaggtcctatcttgagtaaggtcggtgacggaatgcaggacaacctgtctggtgtggaaaatccagtatcggtcaaggttctccaaatccctgatgctacttatgaagtggtgcactcacttgctaaatggaaacgccacaccttggctcgttttggctttggtgaaggagagggtctctttgtccacatgaaagcccttcgtccagatgaggattccttggatgcaacccactctgtttatgttgaccagtgggactgggagaaggttatcccaaatggtaagcgtaacatcgtttatctaaaagaaacagttgagaagatttataaggctattcgcctgactgagctagctgttgaagcccgctatgacatcgagtctatcttgccaaaacaaattacctttatccatacagaagaattggtagaacgctacccagacttgacaccgaaagaacgtgaaaatgcgatttgtaaagaatttggagccgtctttttgattggtatcggtggcgagttgccagatggtaaaccgcacgatggacgtgcaccagactatgatgactggacaagcgagtctgagaatggctacaagggtctaaatggtgatattcttgtctggaatgagt

SEQ ID NO: 306 - DNA, 846 bp; double-stranded, linear
cccgcatcttgtagggttttaacgggcacgattttcatatccgtcttgattgttttagccgcttctagggctgtttggtagttgtttttcgcgtccggatgcgccttttgttcttcttcgctaacagggttatcaggagcaaagaaaatagcagcacctgccctagccgaagctacaaccttcttatcaatacctccaatgtctcccacattaccatcgcggtcaatggtacctgtaccggcaacaatacgaccattacgaagatctgggtgagctatttgagtatagatagctagactaaacatgagaccagcacttggaccgccaataccagctgttgaaaagctaattgggacattgctgattacctctgtacggtcaatcaagccgattccaattccatttttgccattttccaaggtgatgatttttccttctgcagacttggtttgcccatcctcttcataggtgaccttgacggaatcccctaatttttgagaactgacgtaatcaatcaagtctttggaactatcaaaggtctgatcattgactgctgtgactgtatcagagatattgagaatccctttaaaggttgaattatccgtcacattcaaaacataaactccaaagtacttgagttcgatatccttaccagctgtttttagtccttgatacttggccatattttgcgatgtttgcatgtagaattgattgattcgcataaattcaacatcggaagaaccacctgtagtctcctgagcactacgaatatctgtaaaaggtgtcaaccaagcataaatcatatgagctaaagtggcatgttgaacaccaaccgtaacgaattgt

SEQ ID NO: 307 - DNA, 829 bp; double-stranded, linear
gcgatctgcttgggcttttcctattaccttatctaataaataggtacgcagactcataaccatataaagtccaccccccatggcaccgacaagagctacataaaagaagctccacaaacgtccacttggttggaagaaaaatcctaacagccactggatggttcctattaacagaaacatgactagggtcagcaaactgattaaaatggttcgcttcaaaatcaccttgcgcttgacaccagttactttacaaatatcccgatacatcaagacgttaggaatgatgagagcaatggttgttgaaatcaaaggaccataactgtggaagagggcgatggtaggtagttgcaagactagcttggcaatagaaccatagataaaatagagaacggccttgcggttgcggaacatggcctgaagcattggagacaagaccatgtacaagcctaaaataatagactgcaaaactgcaaagacaaataagcccagagccaaactatctggcttaccatagaagaccgtataaagaggttctcctaccataaccactccaaccgttgctggtagcaagaacataaagagtagggtgagactgtcctgaacgagacgagaagctgctttcaagtcccccttgacatagttttccgtcaaaagtggcaaaccaacactcccaatcgaaacccctacagaaatcaaaatcatcgtgattttattaggattggctgagaaataagaaaacatgacaaccaagtcctcattgctgtagttggtaaaccagctcatactattgataaaggtcagctgagtccaaatctggaagagctggatg

SEQ ID NO: 308 - DNA, 464 bp; double-stranded, linear
cgaacatcttgctggctgattcgtctgccgccatcgcagccccgaacacattgcgacccatggcaagcgggctcaatccgcacatgggatccgtgccaaagccccgcgtgtgcatcatttgctcatctagtaacgtatgaggtttgccttcgctgtcgataaaccgatattcaatcgcaccactgctcgttctccgcggaggggaaaccgactgcggtaggatgaactccagagaagagagatcacgacctaccaggtgcggctcgttgaagctgttgccgcttagcagcaggctcgccaccacgcattcccagaactcaacgggggtttgatcggcgttcggttgctgactaataactcggtgcacgggatgcgaagtggccacttctggcacaccgttcttgtcttcgtagagagcaattgggagggtggccagcgtttcggcgatgaggcgcacgcaggcc

SEQ ID NO: 309 - DNA, 982 bp; double-stranded, linear
ccgtctataatggtaatagattttatttggaggtttttatgtcatttctatcaaaaaatggagcaggtatcttggcctgccttctcatttccatcctatcttggtacttaggaggattcttccctgtggttggcgcgcccgtttttgccattttcataggcatgctcctacatccctttctctcgtcctataaacaactggatgctggtttgacctttagttccaagaagttgctccaatatgccgttgtcttgcttggttttggtctcaatatctcgcaggtcttcgcagttggccaatcttcactccctgtcatcctgtccactatctcaatagctctgattattgcctacctcttccagcgtttctttgccctggatacaaaactggctaccttggttggagtaggttcttctatctgtgggggttctgccattgcagcgacaggcccgttattgatgctaaggaaaaggaagtagcccaagccatttccgttatctttttcttcaatgtcttggctgcgctcatctttccaaccctcggcacctggcttcatctatccaatgaaggcttcgccctctttgcagggactgcggtcaacgacacttcctctgtaacggctgccgccagcgcttgggacagtctttaccaaagcaataccctcgagtctgcaaccattgttaaactcacacgtactttggccattatccctatcacgctctttctatcctactggcaaagtcgccaacaagaaaacaagcaaagcctgcaactgaaaaaagtcttcccactttttatcctttactttatccttgcctctctcctcactacactactcacctctctaggtgtgtccagtagtttctttactcctctcaaagaactctctaaattccttattgtcatggacatgagtgctatcggtctcaaaaccaatctggtcgctatggtcaaatccagtggaaaatccattcatcatgga

SEQ ID NO: 310 - DNA, 1939 bp; double-stranded, linear
ctagctgccaatatgattggggtgcagaagcgcgtgattatctttaatcttggcttggttcctgtggtcatgtttaacccagtgcttctgtcctttgaaggatcctatgaggcagaagaaggctgtttgtccttggtaggtgtgagatcaactaagcgttatgaaaccataaggcttgcctatcgtgacagcaagtggcaggaacagaccattaccttgacaggcttcccagctcagatttgccagcatgagctggatcacttggaaggacgaatcatttaggaggaaagcaaatgaaacgaatagtctttgaacttatttttatcgcaacgacctggtatatctttttaccgccccttaacctgaccagctgggaatttctcttcttcctctgtgggcatttgttagttgtggcaatattatttggctttggcaaggggataaaccttgtcaaaacggttcatgtgcgccacggtaaggcggaagctgccttaaatcttgagggtttcaaaatcaatcggttagggaaaattctgttagcttcgattggaggaattcttctcttggcagctttggtttccttggtaacttccagcatgtttcaggctaaaaattatgccaatgtagtcacggttacggaaaaagactttactgaatttcctaagagtgacaccagtaaggttcctatcctagatagaagtactgctgaaaaaattggagaccgctacttgggttccctaaccgataaggtgtcgcaatacgtagcggcagatacctatacccaattgacaattgatgggaaaccttatcgggtcacaccactagaatatgcagaccctatcaaatggtttaacaatcaagccaagggaatcggtgagtatattaaggtggacatggtaactggaaatgcggatttggtggacttgaagacaccaatcaagtattcagactcggagtattttaaccgtgatgtcaaacgtcacctgcgcttgaagtacccgaccaaaatctttaaaactccatcttttgaggtggacgatgagggcaatcctttctatgtagcaacggtttaccaaaagcaatttggacttgctgttcctcgtcctgcttcagtcattatcttggatgctacaaatggagaaaccaaggaatacagcttatcagatgttccagaatgggtggacaggatctatccagcagaggaaaccattgagcaaatcaactacaacggcaagtacaaggacggtttcttgaatgccatgatttccaagaaaaacgtgacccagactaccaatggctataattacttgtctatcggtaatgacatctatctctacacaggtgtgacgtcggctaatgcggatgagagtaatcttggtttcatccttgaaaatatgcgaacaggagaaatcactaagtatagcttggcttctgcgacagaagaatcagcccgtgaatcagcagaaggtgctgttcaggagaaatcctacaaagcaaccttcccaatcctcatcaacctcaatgacaagcctctctacatcatgggcttgaaggacaatgctggcttggtcaaagagtacgccctggtagacgcagtcgagtaccaaaatgttatcgttgctactacagtggaagagatgctcagcaagtatgccaataaaaacgaccttgaaattgacaatgcaacgacagaaagcatcaatggagtagtagcagacctcaaatcagctgttatcaagggagacactgtctacttctttaaagttgatggcaacatctacaaggtcaaggcttcagtatccgatgaccttccttaccttgaaaatggtaaaaccttcgaaggtcaagtaggaaaagacaattatctcaagacctttaagctacggtaaaaataggtttttttcagaaagtatatgttataataaggtaaattaagccg

SEQ ID NO: 311 - DNA, 907 bp; double-stranded, linear
cctgctaatagagagaaagactaggagtagaagtaagccaattaaataatgagaaagtttcataccccgtcctttcatgtagatttggtatcgaaagatatctgcggatataaatgtaacattatttttctaatctgtcaataaaatttctgacaatttaataaatacaacaaggagagagcaacaagactttctcctttgttatcctattctaaaatgtttttaccttaatctgataaaataatatcttcgagggagtagctagccgtccaatcaagatattgtttagcttttgaagcatctgctaggacactggctgggtcactagcacgtcgagcaacaatctcgtgtgggattttttaatttagtaattcttcagcagttttaaagatttctttgatagtatagccttttttagttcctaagttaaagatttgagaagaactgtcttcttgaaataggtagttcattcctttaacatgagcctatgcaaggtccaagacataaatgtaatctcgaatacatgaaccgtcacgtgtatcgtagtcatctccaaatatttttaagctatcattttgtcccaatgcggtcttgttgatatttggaatgatgtgagttggatttttcacacgcagaccgtttgaagcatccatttcagccccagcaacattaaagtaacggaaaataacatatttccagtcgtagcgattggccatccagtaaatcattcgttcgcccatcagttttgtctctgcataagggttgacagggtcgagcagggtatcttcagtcaccggcttgtcaatacagttatttccatagagagaagcagtcgaagagaacatgattttttgaatgccaacttcagataagactttgagaacttggttcataccagcaacgttgg

SEQ ID NO: 312 - DNA, 2170 bp; double-stranded, linear
ccacataaaggtaaatatcttttgtactatcttgggcatccaagaaaagcaattgggcaataacagagttagccatattgtcttcaaccggacctgtcagcataatgatgcggtctttgagaagacgtgagtaaatatcgtaagaacgttctccacggcttgtttgttcaataactacaggaatcattcatttctccttttgagttttaattttgttggtcaaatgactgaagataagactattataatatcttggtcaaaaaaggtcaaatttttgctctgctttcattagacagaaacaaaaacccaacctcctttcgtgactggaaatacttttccaagtcattcttcttttcgatcttattttgtaccgaacaagcggtctccagcatctccaagacctggaacgatataaccgtgttcgttcaaacgttcatccaaggctgctgtaaagatttctacatctggatgagcttcttgaagggcttttacaccctctggagcagatacaaggcagacaaatttgatatttgatgcgccacgttttttaagagaatcaacagccaagattgctgagccacctgttgccaacattgggtctactacaaaaatttgacgttggtcaatgtcctcaggcaatttcaccaagtattcaactggttgaagtgtttcttcatcacggtacataccgatgtggccaactttagcagctggaaccaagttcaagagaccatcaaccatcccgatacctgcacgcaagattgggacgatggccaatttcttacctgccaattgtttttgaactgtttttgtaattggtgtttcgatttccacatcttctagtggaagatcacgaagtacttcataccccatcaacattgcaatctcatctactagctcacgaaaagcttttgtagaagtatctgtacgacgcaagattgacaatttgtgttgaatcagtgggtgattaataacttcaatttttcccatttttggaattccttctttcaatttattcttcttattataccaaaaaacggtttaaaaatctttctaaaccatttatttttgataatttttacattagatcagcctctttaagagctgtctgtactgtctcaagtggtaaatgggtcaattctgtccctttttcttgataaaggtattgggcgtagtcgtccattcggtactggttgatataaaccacgcgcttgcagccgacctgaagcaattgttttgtacagttgagacaaggaaaatgggttacataggctgtaaagcctttgggaacaccacgctcagcaccttgaaggatagcattgacctcagcgtgaagggtgcgaacgcagtggccttcaatgaccaaacattcgtgatcaatacaatgctcagtccctgacaccgaaccattgtaaccagtggaaataaccttattatcttttaccagaatcgcgcccactttagcacgtttacaagtggaacgattcgcaattagtagagcttgggctgcaaaatactcatcccaggccagtcttttttcagtcatctcttttctcctttttctctattttttaaaaaatggtaaacctaaatctgcaatcttttcagctggtaccttcatgccatccttgatccattttagaaggacagagacgatggctgagctccagaaggaatgaagataagagctgacaccttttgatttcccatggtatttttctagaaattcctgcatggcttggacaaagattttttccagatggtaatccaaggccaattgaattactctagcttcctttctggcctcccggaaaaggtgaacccaaaccaaataaaggtctgtctttaaatcgtaatgatgcagctgttccataatattgtggacagttcgtttaaagacgctctctaaaatttcctctttggagtcataattgcgataaaaggccgcacgcgaaacacctgcacgtttgaccaattcagaaatactaatcttggtcagttcctttttttccaagagttgcaagagggctgtttcaatggcttctctggttaataaattggattcttggtttgattttctgagattttcaagagacttttcagagattctacgttcagacataacattttctttctacttgtcacaacagacggatgatgcttttgtttc

SEQ ID NO: 313 - DNA, 539 bp; double-stranded, linear
atctgcacgaatcagggctttctaagtgactatttccaccgaaatattatttatatcaggaggacattcatatgtcacgttatacaggaccatcttggaaacaagctcgtcgtcttggcctttcacttacaggtacaggtaaagaattggcacgtcgtaactacgtaccaggacaacacggaccaaacaaccgttctaaattgtcagaatacggtttgcaattggctgaaaaacaaaaacttcgtttcacttacggtgtaggtgaaaaacaattccgtaacttgttcgtacaagctacaaaaatcaaaggcggaatcctaggtttcaactttatgcttcttttggaacgtcgtttggataacgttgtttaccgtcttggtctcgcgactactcgtcgtcaagctcgtcaattcgtaaaccacggtcacatccttgttgacgggaaacgcgttgatatcccatcatrccgcgtaactccaggtcaagtgatctcagttcgtgaaaratcattgaaagttccagcaatccttgaagcagta

SEQ ID NO: 314 - DNA, 667 bp; double-stranded, linear
ccggttttgctccttctctacggctacgacgtgatgtatctctgatgatatccactgtttctgtagcaggcgtaggtgtttctggacctgcttgttctgcttttttctctgccgtcgtataggaaacagctacccttgttggggtttcattgtattctctttcaagtttcttaggtctaacaggacctggacctggtcttgatccactttcttccgctggagaagaaggtacatcttgacttggatgacttggaacaccaggagtttctctttgaatctcatctgctggagaagctggtacaccttgacttgggtgagtaggcacggtaggagcttttctcataatctcctctaccgttgacaaggaatcagccatgagttcttcagttgaaggttcatttgcaggagtgcgaactactgcctcatcttctttcagaacttcatcatagccttttactttttctaaatctctcagaatctgctctttaaagcgtaatttctcttctgctcttgacttttcactcaaaagtttttcctccttgttgagaatccataatattagagctgagaagtccaaaaaaagcaatctatgatacttttcctaacggattttgtcatttcccagaccatatcataccatgtttcccctgcaaaggttgactgggaa

SEQ ID NO: 315 - DNA, 1483 bp; double-stranded, linear
gggaagccaaggtattttatcggatgaagttgttactagttcttcaccgatggctacaaaagagtcttctaatgcaattactaatgatttagataattcaccaactgttaatcagaatcgttctgctgaaatgattgcctctaattcaaccactaatggtttagataattcgttaagtgttaatagtatcagctctaatggtactattcgttccaattcacaattagacaacagaacagttgaatctacagtaacatctactaatgaaaataagagttataaggaagatgttataagtgacagaattatcaaaaaagaatttgaagatactgctttaagtgtaaaagattatggtgcggtaggtgatgggattcatgatgatcgacaagcaattcaagatgcaatagatgctgcagctcaagggctaggtggaggaaatgtatattttcctgaaggaacttatttagtaaaagaaattgtttttttaaaaagtcatacacacttagaattgaatgagaaagctacaattctaaatggtataaatattaagaatcacccttccattgtttttatgacaggtttatttacggatgatggtgcgcaagtagaatggggcccaacagaagatattagttattctggtggtacgattgatatgaacggtgctttgaatgaagaaggaactaaagcaaaaaatctaccacttataaattcttcaggtgcatttgctattgggaattcaaataacgtaactataaaaaatgtaacattcaaggatagttatcaagggcatgctattcaaattgcaggttcgaaaaatgtattagttgataattctcgttttcttgggcaagccttacccaaaacgatgaaggatgggcaaatcataagtaaggagagcattcagattgaaccattaactagaaaaggttttccttatgccttgaatgatgatgggaaaaaatctgaaaatgtgactattcaaaattcctattttggcaaaagtgataaatctggggaattagtaacagcaattggcacacactatcaaacattgtcgacacagaacccctctaatattaaaattcaaaataatcattttgataacatgatgtatgcaggtgtacgttttacaggattcactgatgtattaatcaaaggaaatcgctttgataagaaagttaaaggagagagtgtacattatcgagaaagcggagcagctttagtaaatgcttatagctataaaaacactaaagacctattagatttaaataaacaggtggttatcgccgaaaatatatttaatattgccgatcctaaaacaaaagcgatacgagttgcaaaagatagtgcagaatwtttaggaaaagtatcagatattactgtaacaaaaaatgtaattaataataattctaaggaaacagaacaaccaaatattgaattattacgagttagtgataatttagtagtctcagagaatagt

SEQ ID NO: 316 - DNA, 2453 bp; double-stranded, linear
cctgaacgcttttttataaatatcataaagccaatctgatttatcaagtgtgtctaagcgacgcgaattaaaattcattgcatactccatcgcttctaaaaaactcatttttgaaaagacgttaaaatcatctaaattctgactccaatataataacaaaaccaatcccataatatcctctggttgattattcaataaatttaagttggtttcataaaaccctggagttccaaatagaggcaactttttttcttcaatttgagtttctttccttagggcatgctcaaagtctataatataaatattatttctattatcaataagtatattattaaatgataaatctctataggaaagattatatttggagtttattatctccatataatcaattaatgttaaaaaccaatcatacgagccactaaccatattatactcgcttaatttatctgcaataataaactcaaattccacaaaatacgaattctttatgtaaaaatcgttaaaaacttttggagtaaattcctccttttccaattctactaatatttctctttcatttattaaacgattcacagaatctctatttgtaaaatcaaccaacgataaatcactagcttcttttaataaagaataaactcgcttttgagtattaaatactttataaactccacctttggcatttttagaaatcacttccaaaataatatattgatcaggaatagtgttatatcttggaatatagtaatcccttattggaacattcacatttgaagggattttcttatctcttttatccttgaaagtgctatcttttacgaactccccatatctgtaatatacaacctcgctaagttgaaatctgaaatctgatggtatgtttacaccctttacacctttatacaatatttctaatttgtgtaacaaacgttgaaactctttattatcttttggataaattgtaatgaatttcccgacttgtgaataaccattaagccctgtattttgcaaagaaagttctttaatgctaaccaaaattttgaaatttatcttcttctctctagaaaatataaaatcaaagaattttttagcaaccaaattagcatttaatattgaagcgctcaggtgtattttaaatcccttagattgggtgatattagacggcaaattatataaccaatgttcatcactaaaattatcactaattttatattctaataataaattatggtatgcgtcttctatttcagtttcatagtccaaatagtttaaatacttttcgtaattcatattaagaaatcttctccataaatttttagaccatcatttaaagccaaacaatttaaagcgtgataataaatgttgataatcaatgtaactttcagtcctctattttgtaattccttcaccaataattttatgctatatctattttctcgaggcaatttataggacttcaagataaaaccataaaagagataagtattataatctgacaatccagtttcagaataattttttagaaaaatatctagtgattctgataattcatccggaataattcttttaacatcgtatttatttttcatatcggccactcttccttaaaaagctcacaataaaattttaaatttctatacaacaatccgagagtagtctcacaatttgaacatttcacatcactcttaatatataaaaaatgaattaatcagaaacctctgactaagatttcctaattaattcactttctatatcatagtaaggaattctattatccctaattgaaaattgaaattttatgttttatatattaacaattatgcggattgtaaatcttgtctaacaaaatggcaagtgctactatgtgccccagaaggcgatgcaacgctattttgaattgaaagagcataatcatccatatcatttaagtcacggattagcaatgcttccttctctcttccgacaattccaaattttctaattaccttttcaggattatcaaaaaattctccaacaacttccatatttccttgaagttcattcaagaaagctttcatttgactactcattatatagctccttttctattactttatttggaatcaaaacttacttgtacattggaaacacctctattctacgctttcatattgctgcatgacactttcaaaatcaaattgctaaaaataattttttaaagcttaatttagatttaattacatatatctcaaaaaattgttttgaaattagtaaattaaaataggtttctgtacttataggaactagttataaaaacttcgcccatcataaaatatctatttaagtaaaacaaaaattttataattttttgatttttaagtgactataatctcctatctataaataccattcgcaggacctggatcaatccctctagccatcttatgaacttgagttcctccagacagtcccgg

SEQ ID NO: 317 - DNA, 1049 bp; double-stranded, linear
ccaatttgaaggctctaaaacaatggaaaagtgctacacagatgtgacagaatttgccattccagcagtactcaaaaactttacttatcaccagttttagatggctttaacagcgaaattattgcttttaatctttcttgttcgcctaatttagaataagtacaaacaatgttggaacaggcattcaaagagaagcactatgagaatacgattctccatagtgaccaaggctggcaataccaacacgattcttatcatcggttcctagagagtaagggaattcaagcatccatgtcacgcaagggcaacagcccagacaacggcatgatggaatctttctttggcattttgaaatcggagatgttttatggttatgagaagaactttagatctttagaaaaccttgaacaagctattgtggactacattgattattacaacaacaagagaattaaggtaaagctaaaaggacttagccctgtgcaatacagaactaaatccttcggataaattaattgtctaacttttggggtgcagtacatttttggtatatataaaatttgtaggagctatatctacaattttatattcccagtttatggatgtaacttactatattcacaatgttatccagtgttttttctctaatatttaaggagtgttctgtttctcgaataaattcttcaaagtttaacccgtcaacttgttcctgaacaagaaaataatcatccacgatataaaattcatcagttaaattagtagtataacttttatcggctaatttttttagcatgtgagcttcattttttatatcatcaagagctgtccattctccttcagcatcataattcacaaaaggtcttgactgcttgatgattactttttgcccgtccgattttctaattgcccgataaacatttcctttatttgatctcttaataattttttccattttgtatttatttattgcagagtccttacttgaaacttcacatgtggtttgaaaataaatccttttttcttcttctgaaaataaatccattttccgg

SEQ ID NO: 318 - DNA, 776 bp; double-stranded, linear
ttagttggttagaatcagaaaatcgccgaagtggttatttatttttgaataaatttaacgaaccaattacagcaagaggagttgctcaacagttaaaaaattatgctgataaatacaaaatgaatcctaaagtaatttaccctcattcttttaggcatttatttgctaagaattttttagcgaagtataatgatattgccttgcttgcagatttgatgggacacgaaagtatagaaactactcgaatttatctaaggaaaacagctactgaacaacaaaatattgtagataaaattgttaattggtaaaaaataacaggtggtcaaactgactacctgctatttttgtgattatggctcttattatgggaatatacctatgaattgggttgttataaaaataaaagatattttttcaataaatacaggtctttcttacaagaagggcgatttaagcattaataataaaggtgttagaattatacgtggtggtaatattaagcctttagaattttctctgttggataatgattactacattgatacacaattcatctcctctgagcaagtttatttaaaacataatcagctaataacacctgtatcaacctctttagaacatattggaaagtttgcaagaatcgagaaagactatgatggtgttgtggctggtggatgtattttccaattaacaccattcgaaagtgcagagatgatgtcaaaatgtctattatgtaacttgtcctctccgttattttataaacaattgaaagcaat

SEQ ID NO: 319 - DNA, 658 bp; double-stranded, linear
tgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccaccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgatgtcgacagcccgcctaatgagcgggcttttttttcctgaggctggacgacctcgcggagttctaccggcagtgcaaatccgtcggcatccaggaaaccagcagcggctatccgcgcatccatgcccccgaactgcaggagtggggaggcacgatggccgctttggtcccggatcaattcgcgcgaccggatcgatcc

SEQ ID NO: 320 - DNA, 1475 bp; double-stranded, linear
ccggcttaatttttagaaaacgtgggcagggaacctttgttctctctcgtggcagctcaaaaagaaaattaatcgttccagaaagagatatccggggactgacaaaaatatctgaagatgctcattctacaattgactcgaggattattcacttcaaattagaatttgcaaatgaatttttagcagaaaaactacaggtcgctttgcagagtccagtttataatatttaccgcctgcgtattattgacggtaaaccttatgttctggaacaaacttatatgagtaccgatgttattccaggtattactgaagatattttacaaaaatcgatttacaattacattgaaggaaagttaggattgcatattgccagtgctacaaaaatcttacgagcttcttctagttcagaaaatgagcaacattacttgcagctccttccaacggaaccggtatttgaagtagaacaagtggcttatttggataacggaactccgtttgagtactcgattagtcgtcatcgctatgatttatttgaatttaattcttttgcattacgacattcctcctaggagaaaatgtgaaaatgaagccaatcttttacagactctagtttaagaaaaatttaaaacagggcaagaaggtcccatctatgcttaaatggtttctcttttctaaataagatggctttaaaagagtgatcgttgtatccatcatgttgaaaaatatcttcgtatagcttatagagtaggtactgaaattgttcacctgatctacttcttatagttatttagttttaaatagtgtttcaaacattcttacactgacgagaagtttttgagtcttttcttgtaacacatatagtatactgtggttagaatagtagactgtgacttctaacaaattgctagaaatgaatttcaatctcccaatttatttgttcatatcttcttttaatatattaaataaattctaaatcataatcatttaaaaaaattttattttttatttttcattacgaataatatagatgaaggggaaagagtatgaaaacagaactgtttcttttgctattagttcaaaaggagaaaaaatgaaagtagaaaatatttcgtatagggtggatcatcgtaaattgtttgataatatttcttttgatacttcgagttcagacgtgacattaattactggtaaaaatggtacaggaaagtcaactttactatagtagattgaaactagaatagtacacatctacttctaaaatattgttagaaatcgatttgactatcctgatctatttgtcctgttcttatttcatttcactatatctcaaattgagtatgacgaagtgcgctcccatgtcctgggaacgcactttcttcatatttttcatattcttgaatccatcgataaagactattgggatgaatttttaaagttgaactaatcatttttacaggatgagatttacagcagag

SEQ ID NO: 321 - DNA, 560 bp; double-stranded, linear
gaaatatatatacttcatcttaatagtgagcaagctaaacttagcatttcatgccctcatatgggatgttctttgactaaataatatgattatcgagatatatctggataaatgaactaataagtctgacgcgtagacttatcaaagtcattggcatacaccactatgaactcgttggtctgttcaaatcccaacacattacctgagaagaaagttgcaatgttgtttttggtgcgggtttgaatttaaaaaatttgttatgtagtacctaatctaaggaattagaacaatgcctctaatttttctttaatacactgaaacattgatgattctggctgtatttttgaaacagctcttctttgctcctggaaaatatcttcagaagttatattctctattcctaacgctacttgagttttttttctaaaatattcttttccgttgccatctttagaaaaatcataaccttccctatctacgctgttacacaaattagctaaaaaaractctggggttgggaaaggaagataagaaacgtatttagcccataatctataaag

SEQ ID NO: 322 - DNA, 643 bp; double-stranded, linear
ccgcccggccaccgctgcctatcctcgggagagggtcacctggagtgaacctagaacgatagacacggtgcggtacgacctcgtactactttcgccgacggcctcgtccgttgtcatccacgaactgatcggacatgggtgcgaacacttcagagaaaaaatcgttggactgcgtgtcgggcctgaggaactacgggtggtggcttttccgaagaacggctccgggtttgatgacgagggtacaccctccgaagagattgtacttgtggagaacggcattgtgaggcacgctgtcagggatcgggcgactggaggaatggcgcctttttccggtttgaccaaagtggcatcacatggtgtcaaacctggctcaagatgtacgcatctcaaggcggaaggggaatcgtcacaggaaggagttaccggagtacccgccgaacgcaccgtttggatagagcatttttctgcagcgaactaccattcaggtcgagcctttttcaggtctggccttgcctgggtaggcagccgagaagaactcttatatcccttaatgcctttcaccatgtcaattgatatctacgaactggccagcttattgtggcatttagacggtcaaacggaacgagcacgtagggtactgtgc

SEQ ID NO: 323 - DNA, 780 bp; double-stranded, linear
ggtacccactcattcttgatgaattgtgaacagttgcccttgggtcgttttgcgagttgaagtcaagaagaggaaaaaaacaaaaaggagaaatactcatggcagtaatttcaatgaaacaacttcttgaggctggtgtacactttggtcaccaaactcgtcgctggaatcctaagatggctaagtacatctttactgaacgtaacggaatccacgttatcgacttgcaacaaactgtaaaatacgctgaccaagcatacgacttcatgcgtgatgcagcagctaacgatgcagttgtattgttcgttggtactaagaaacaagcagctgatgcagttgctgaagaagcagtacgttcaggtcaatacttcatcaaccaccgttggttgggtggaactcttacaaactggggaacaatccaaaaacgtatcgctcgtttgaaagaaattaaacgtatggaagaagatggaactttcgaagttcttcctaagaaagaagttgcacttcttaacaaacaacgtgcgcgtcttgaaaaattcttgggcggtatcgaagatatgcctcgtatcccagatgtgatgtacgtattgacccacataaagagcaaatcgctgttaaagaagctaaaaaattgggaatcccagttgtagcgatggttgacaccaatactgatccagatgatatcgatgtaatcatcccagctaacgatgacgctatccgtgctgttaaattgatcacagctaaattggctgacgctattatcgaaggacgtcaaggtgt

SEQ ID NO: 324 - DNA, 624 bp; double-stranded, linear
cgggaaaaatcagattgtgggttcagatatcgaattagccaaggctatcgcaacaaaactaggtgtcgaattggaactatctcccatgagttttgataatgtactggctagtgttcaatcaggaaaagccgaccttgccatatcaggtgtttctaagacagatgaacggagcaaggtgtttgacttttccattccctactatactgcaaaaaataaactcattgtcaaaaaatctgacttgactacttatcagtctgtaaacgacttggcgcagaaaaaggttggagcgcagaaaggttcgattcaagagacgatggcgaaagatttgctacaaaattcttccctcgtatctctgcctaaaaatgggaatttaatcacagatttaaaatcaggacaagtggatgccgttatctttgaagaacctgtttccaagggatttgtggaaaataatcctgatttagcaatcgcagacctcaattttgaaaaagagcaagatgattcctacgcggtagccatgaaaaaagatagcaagaaattgaaagaggcagttcgataaaaccattcaaaagttgaaggagtctggggaattagacaaactcattgaggaagccttataagcatcca

SEQ ID NO: 325 - DNA, 1237 bp; double-stranded, linear
tcttatgaagccgaagcgtgatttatggcggataggtttggtctgcagaaagtgacaaatctagtgccatcagcgtatatggaatctntggctgagaaacagtcccggggtgaactgacttatgagcaggtttatgaggatgcaacggcttatcatcataccattgatgcgagtacagaggaggcagacttggtttctctacgtattgtagaactattgtctcgaagaggctttagcttcagtcctgcgatcttacttgctattcataaggagttgtttcaagatatatttgaaccctcgattccggtaggtcaatttcgtcagactaatatcacaaagaatgaacctgttttgaatggtgaaagtgttgtgtactctgattactccatgattcaaatgaccttggattatgattttaatcaggaaaaacaagttgcatatgcgacactaacccaggcggatatggttaaaaaaatccagcattttatttcaggaatctggcagattcatccatttcgcgaaggaaacactcggacggtaacggtatttttgattcagtatcttcgtgagtttggttttgatattgataatacaccatttcagcaacattccaagtattttcgtgatgccttagtgttagataatgcaaagattttacagcgacgtcctgagtttttaacagctttttttgaaaatctcttgctcggtggtcaaaatgatttgtcttcagaaaaaatgtatctagatttagacctcgatctttcataatcctaatactgagtaaacattgaattttaggaaaaaatgaagtaaatattctcacaagaaaacgtatatcatcaaagtttggctctttgtcaattgtagtgggttgaagaaaagctaagttcgagaaagggcaaatttcggcctttcctttttgatgttcagagcgataaaaatccggttttttgaagttttcaaagtttcgaaaaccaaaggcattgcgcttgataagtttgatgagattattgggcgcttccagtttggcattagaatagtgtagttgaagggcgttgataaccttttctttatctttgaggaagggtttaaagacagtctgaaaaataggatgaacctgcttaagattgtcctcgataagttcgaaaaatttctccgggtccttattctgaaagtgaaacagcaagagtttgaagagccgatagtgatgtatcaagtcttgtgaatagctcaaaag

SEQ ID NO: 326 - DNA, 461 bp; double-stranded, linear
tttgatttttctgaattagaagagattgaattgcctgcatctctagaatatattggaacaagtgcattttcttttagtcaaaaattgaaaaagctaaccttttcctcaagttcaaaattagaattaatatcacatgaggcttttgctaatttatcaaatttagagaaactaacattaccaaaatcggttaaaacattaggaagtaatctatttagactcactactagcttaaaacatgttgatgttgaagaaggaaatgaatcgtttgcctcagttgatggtgttttgttttcaaaagataaaacccaattaatttattatccaagtcaaaaaaatgacgaaagttataaaacgcctaaggagacaaaagaacttgcatcatattcgtttaataaaaattcttacttgaaaaaactcgaattgaatgaaggtttagaaaaaatcggtacttttgcatttgc

SEQ ID NO: 327 - DNA, 1436 bp; double-stranded, linear
taacatttaggtacctcttcttaacaaagttcaatagtaacaattaatattttaaacaatatatcaaacatcaatgactagaatacttgcatcatccttctttccatagattggatcaatagcagaagaattaaatctcatcttaattaactcttcaaaagttttattttgattattttgatagaattcataaaagccatcgctcattaaaacaatttgttcactagtaacatctatttgattaataatagcatggtctaaaaatctctcatccaacgaacctatccagtacccactcggttgattagataattttctgattttttgtaaaataatttttttatttaaaacactatttgtaccaattgaatcttttatctcatttttccctttttcaaataagttatctactctatgatcagttatttccatttcgtttactaacatgacgcagtcacctagcatcatatactccaactttttttctgaaagtttagcaaatattggtaagcgataatatagtatattgaaactagaatagtacacctctacttctaaaacattgttagaaatcgatttgactgtcctgattgatttgtcctattattatttcattttactatactctgttaatttatatgagtttaaaccgatttcatctttaacctcgagtaaagcagtttcaaatatttgtttaagagtttttgattctttacaattaaccgacaaactttctgataaaatatgtacaacttctgagactgaataacctatctcctctttagaattatataaatctgtagctccaccaataatccaaaaatactgattttgtgaacctacaatatcctcattttctacggaacttccttgtatcgaacaaattttatttatctttaccataatacttcaacccttttagtgtcaaaagtaaaccaattcctgtcactgttaagaatagttccataatcttattcgaaccagtctttggtaatttttgtttkacatctactatytctttagatttattaatatgattttcagtttctctgccatctccaactattttatagtttacttcttctgtcttattatcttgtttattgtcgatcttgtcattcatttgtctattatctttacttgagttaaactctccgttcttctggttactatcaattacattatttgaattagattgtttttcctctttgtttttttctttttcgtttttatcacttaaattatttgttacaattttgtaaagcccattctccgttacaatattgaaattaccatcgctatcacgtataacaggttctttcccatttgcattagatttgatgaatgatatatacttaccggataaattataaaattggttatttaaaacggttattttaccctttgaatcctcaataacaattccttctttaccc

SEQ ID NO: 328 - DNA, 646 bp; double-stranded, linear
ccggcagacaggagaaggtgttaaatatcaatctcaaatggttcgtcaatggtttctgatacgtattttccgtctttcttccgttgcttgacacactctgtgaggagatattcgatttgcccattgactgaacgaaagtcgtcttctgcccatgatgcgagtgcagcgtataactttgttgagagtcgaagggggatctgcttttttttagcttcagccatctttagtaaaggcttcctgtgttgacaattggttgtgcatcatgattgccacaaagaacgacaaggagatttgaaaccatggcagcttttcgttcttcgtcaagttctaccaattccccttcattgagccgttctagtgccatttcaaccattcctacagcaccatctacaatcatcttccgtgcatcaataatggcagatgcttgttggcgttgaagcataacggcagcaatttctggagcataagctaggtaagtgatacgtgcttcaaggatttccaagccagcatcctcaacacgactttggatttcttcacgaatacgggtagcaacaatttcgctagagccacggagactaccttcatctgcgtgcccatcacccggagtatccacattaggagacacatcgtaaggatagatgcggac

SEQ ID NO: 329 - DNA, 1653 bp; double-stranded, linear
gttgcaggtgcagtaggtgttacttcagatacatttgaacgtgcagaggctctttttgaggcaggagcggatgcgattgttattgatactgcacatggtcattctgcaggtgtcttgcgtaaaattgccgagattcgtgctcatttcccagatcggactttgattgctggaaatattgctactgctgaaggtgcacgtgccctttatgaagcgggtgtagacgttgttaaggttggtattggaccaggttctatctgtactactcgtgtgattgctggtgttggtgttccgcaagtaacagctatctacgatgctgcagctgttgcgcgcgaatatggtaaaacgattattgctgacggtgggatcaagtattctggagatattgtaaaagcacttgctgcaggtggaaatgctgttatgcttggatctatgtttgctggaactgatgaagctccaggcgaaactgaaatcttccaaggacgtaaattcaagacttaccgtggtatgggatcaattgctgctatgaagaaaggttcaagcgaccgttatttccaaggttctgtcaatgaagcaaacaagcttgttccagaaggaattgaaggtcgtgttgcttataaaggagcggcagctgatattgttttccaaatgattggtggtattcgctctggtatgggttactgtggtgcagctaaccttaaagaactacacgataatgctcaatttattgaaatgtctggtgctggtttgaaagaaagccatcctcatgatgtgcaaattactaatgaggcaccaaattattctatgtaaaaaacaatgaaaagaactccagtgaaaacaggagttcttttacaatgttgtcaatttccatttacagcagctttaccatcctgaatagtgaagatacttagattttctggcagattttgaagatggtctaagcttgttgttgtgataaaggtttggattgattgagaaatcgtttctaataattttaactgtctagtgttgtcaagttcactcatcacatcgtcaagcagtaatataggagattctgtggtaatgctttccattaattcgatttctgctaattttatcgagaggacgagactacgatgttgaccttggcttccgaaactagcatccatcccatttatataaaaagaaatgtcatctcgatgaggaccgacaccagtattctttttaaataaatctctggatctacttttttctaaagcaattttgaaagattcggataagttttgtttgtcagttatattgacagaagattgataggatattgacaactcttcgatctgattagagagttcaaaatgtttcttacgcccaaatgattctagtttttttatgaaatctaagcggtgattcattacacgacatccataatcaactagctgatcatctaacacagaaaggaatgtttcatctattttttgagctgattttaggtaagtgtttctttgctttaggatgtggttataattggttaagtcagataaatagattggcttaatttgcccaagttccatatcaatgaattttcgtcgaatcgaaggtgctcctttaattagttgtaaatcttcaggagcaaataagacaacattcatgtgtcctacataatctgaaaggcgtgcc

SEQ ID NO: 330 - DNA, 1340 bp; double-stranded, linear
gaaacactgtatttcaaagcattttttgttagtttaaaattactcccattcttcttttccaaacgtacaatatatccaaaaccattcaaaatactagattctattttttataatatcactaaatccacctaattataggacgttttcagatttttagtcccagtcccagtaccggagaaatattgttttaatataatatctctttttgtcttctaagctcttaaaagcaaaagaacaagtaaagagtcaagacaaggataaaaagtccatattagggcaaataaaaagctttaagacagatgacaaatctaagtcaaataagaaagaccatagcaaaggtgcagagagataaatattggcggtcttcggactgcctttatttttttatccatttttcaaatcaaatttattcagactatatatgcacatatacacttaaattcatataaaaacatggcttgtaaaaaattactttaatcacaataatcgcatttaaaattgtgatgtttgcaagctaaattacggacttcacttggaagttttcccttgtatcttttataatagatagaaaatttgctggcagatgaatatccaacagattctgctatctcttttataggtagttcagtgtttaaaagaagagtttcagctacattcattctttttctttgagtgtactctgtaatgctttgacaatatttttccttaaataaattttttaatttagtaccactcattttagatattttttcaagcgtgccttgatttacattcgttgcaaaatgatcatctaagaatcttgctacatcttcaagtgctttatcatcatcaatttcaattttatatttttttctatttaagtatgtgtcaattactatacttatccattcatttgcctttgctttaaagaaaaaatcagcggcaggagcgtccatcttacaatttaatatttccattgccactctttctaaggcctttgtaagtattatttgattcggttgaagcaaggttgaataaaaagattctggattaatgttaatagatgctaaatgtttttctattagctcttttttaaaaccmatggaaacagcaagataacaacaattctcgtgtaataaaaaaacaaaattatcttttatattatcaaaatcaaaagtacatagagagtttgcggtaatagtttgatacggattaaacttttctccgtttgcactgacaatgtaacttgaataaattgaaacatagtctgacatactataagtgctattttgaactacttcctctttgatataaaaatcatgtatatcgataatgaagatgcctccttcataaaaccggta

SEQ ID NO: 331 - DNA, 607 bp; double-stranded, linear
tatgttcgtgatgagtttttaagtaggaaaaacgtgctaacctctcagattttggaacttgtaaaagaaactcttttttcacccgtagtagttgataatgggtttgatccggccttatttgaaattgagaaaaaacaattgctagcaagtttagcagctgatatggatgattctttttattttgcacataaagaattggataaattgttttttcatgatgaacgtcttcaattggaatatagtgatttacgaaatcgtattttagctgaaactccacaaagttcttattcttgtttccaagaatttttagccaatgatcgaatagatttctttttcctaggtgattttaatgaggttgaaattcaaaatgtattagaatcatttggctttaaaggtcgaaaaggagatgtgaaggttcagtattgtcaaccttattctaatatccttcaggaaggtatggttcggaaaaatgtgggacaatccattttggaattaggttatcattactgttctaaatatggtgatgagcaacatttacccatggattgaatgaatggtttacttggtggatttgctcactctaagctctttacaaatgtccgggaaa

SEQ ID NO: 332 - DNA, 900 bp; double-stranded, linear
ttaaaataccgaattttgttttgtcctctatttcaacattgtgaatcgcctcaggcagagaaccgatactaaagatataaccaaaatagttgtcatttgctttaccgatatcaatcttattggttaaatcaaaatccagttcgtcaattgcgccatcgatgtcttgattgatttccaaaagttttgtaatgaggttacccgtaccgcctgggataatccctaacttaggaatgtagtctctctcatcaatacctgaaatgacttcattgacagttccatctccaccaaacacaaccactgcatcatactgctcacgagaagcttcttcagcaaaatgtgttgcatccagcgctttttcggtaattttggtttcaacatattcaaagtattcttttgctttattctccagcttttctttgtaatccaaagccttctcgccaccagaagtagggttgataattaccattgcttttttcattgattttatccttaattttaaacagaaatgtttacatttcgtcgtatgcaagtaaatgtaatcctattatacaatgaaaatacagaaaagagaaatctgacgtactggagattaatacgcttttattctattttcccatcgcctaactacatcctttaagggttcatccaagtaagaataggccttatccttgatccaatcaggaataccgtaagctgcctctgctawgctacaagtgattgctgcgagagtatcactgtcgccaccaagtgagatggcatttcttatcgcatcttcgaagtctctactttcaagaaaggcgataatggcttgagggacagtttcctgacatgtttcgttaaaacgatagttaggacggatttcatctaaagtttgagatagattgtaatcgtattcttttt

SEQ ID NO: 333 - DNA, 533 bp; double-stranded, linear
cctttctggcacactggtcttggaatacggcaaaacctctgaaaatatctatgctggaatggacgaggaataccgtcgttatcagcctgccatcatcacttggtacgaaacagccaaacatgcttttgatcgcggacagattggcaaaatatgggtggaatcgaaaacgacctcaagggcggtctctacagctttaaatccaagttcaatccgaccattgaggaattcgctggtgagttcaacctgccaactaatcctctttaccacctctccaatctggcctacactctcagaaagaaactgcgcagaagcattaacagaaaggaagcctatgacctttaaacttctcagccaagaagaattcatccagcatacctcagctagatcccaacgctcttttatgcagaccgtagaaatggcagagctgctgagcaagcgtggcttcagtacccagtatgtcggctacactgacccacaagggaaggtagtggtgtcagctgtcctctacagcatgcctatgactggtggccttc

SEQ ID NO: 334 - DNA, 544 bp; double-stranded, linear
ccagcaaactaggaagctagccgtagttgctcaaagcacagctttgaggttgtagataagactgacgaagtcatgtacaaaacactgttttgaggttgcagatagaactgacgaagtcactcaaaacactgttttgaggttgcagatagaactgacgaagtcactcaaaacactgttttgaggttgcagatagaactgacgaagtcannaaccacacctacggcaaagtgaatctgaagtggtttgaagagagtacaacttgtcttttagaaaaggagcctataatgaaagtctttcagcatgtaaatatcgtgacttgtgatcaagatttccatgtttatcttgatggaatcttagcagtcaaggattctcaaatcgtctatgtcggtcaagataagccagcgtttttagagcaagctgagcagattatagactatcagggagcttggattatgcctggtttggtcaattgtcacacccattctgcaatgacaggtctgagagggatccgagatgacagcaatctccatgaatggctcaatga

SEQ ID NO: 335 - DNA, 349 bp; double-stranded, linear
ccaggaactcaaatgtaagtaggggttccttttttgtatatttttcaaataacgcctctacactatttgtagcaaattcaccaactacagttgtatcttagttaaaataagttagaatatgtaagtgagtaccagatataccaagacatcgtcaccatctaaggtatattcaaaatacaaaagttgaccaactagatttctgaatatccttatatatccattcttaaaattggtttaaatagcgtagtcttttaaactagttttgagaatccaaaaaatcttcctacatatgtaagaagattttttagttcagaatgattagatttagctaatggatacctatcctacc

SEQ ID NO: 336 - DNA, 1206 bp; double-stranded, linear
ctccgataaccacaccagcaatggaaataattccatcgttagcatcaagaacacccgcacgcaggatatttaaacgacctgcaaaatttgaatcaatttcgtgatttgtttctgacgctaaatttcaagttcaagttagccatcaagaagtcttctctgggtgacttgtagtccaagcattttttaggatagttgttaatccacttttcgatgaatgcgacttctttgggagtcattttcttggttcccttaggtaaccatctacgaatgagcctgttgtgattctcattagttcccgggatcctctagagtcgacctgcaggcatgcaagcttggcactggccgtcgttttacaacgtcgatgactggggaaaaccctggcgttacccaacttaatcgccttgcagcacatccccctttcgccagctggcgtaatagcgaagaggcccgcaccgatcgcccttcccaacagttgcgcagcctgaatggcgaatggggcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaagttttcaccgtcatcaccgaaacgcgcgaaacgaaagggcctcgtgatacgcctatttttataggttaatgtcatgataaggatggtttcttagacgtcaagtggcacttatcggggaaatgtgcgccgagaccctatttgtttatttgtctaaatacattcaaatatgtatccgctcgtgagaaaataaacctgataaatgcgtcaataatattgaaaaatgaagagtatgagtattctacatttccgtgtcgcccttatacccttttttgcggcatgttgccttcctgtttttgctcacccagaaaacgctggtgaaagtttaagatgctgaaaaatcatttgggtgcacaactggggttacatccaactggaatctccancagcagttaagatcctctgacagttgtacacgccgcaagaactattcccgatgaatgagcaacttttaaaagtcctgcgaatgttggggcggtaataatccccgtgttgtaggcccgg

SEQ ID NO: 337 - DNA, 813 bp; double-stranded, linear
ctgctcaactcagacagtcaaatttctgactttaccaaaagaaccatcaaaaaagttgctgaaaaaggccatcaggttattattacgacaggtcgcccttaccgtatgtcaaaagatttttaccgtgaactgggcttagacactcctatgattaacttcaacggatcccttactcatttaccagaccaagtttgggattttgaaaagtgtttgactgtagacaaaaaatatctgctagatatggttcaacgttcagaggacattcaagccgattttatcgctggagaatatcgtaaaaaattctacattacaaatcccaatgaagaaattgccaatcccaaactatttggtgtagaagctttccagcctgaagatcaattccagcctgaattggtgaccaaggaccctaactgtatcctcttgcagactagagccagtgacaaatattccttggcaaaagaaatgaacgccttctaccagcatcaactttctatcaatacctggggaggtccgctcaatatccttgaatgtaccccaaaaggtgtcaacaaggcctttgctttggactacttgctcaagataatgaatcgtgacaaaaaagatttgattgcctttggagatgaacacaatgataccgaaatgctcgcttttgctgggaagggttatgccatgaaaaatgccaatccagagctactcccttatgcagatgagcaaatttcccttaccaacgaccaagatggggttgccaaaaccctacaagacttattcttataacctatactgatactcaatgaggggcaaagagcgaactta

SEQ ID NO: 338 - DNA, 683 bp; double-stranded, linear
cctagataaatgatataattctattattgttcgtaaaaattaaaaggagattgatgatggacaaattatttaaactaaaagagaacggtacagacgttcgtacagaggttctcgctggtttaacaactttctttgcaatgagctatattctctttgtaaacccacaaatactttcacaaacaggaatgcctgctcagggcgtcttcctagcgacgattattggtgcagtagcgggtaccttgatgatggctttttatgctaacttaccttatgcccaagcgccaggtatgggactcaatgccttctttacctttacagttgtattcgggcttggttattcttggcaagaagccctagctatggtcttcatctgtgggattatttcattgattattaccttgacaaatgttcgtaaaatgatcattgaatcgattcccaatgctcttcgctcagctatttcagctggtatcggtgtcttccttgcctatgtagggattaagaatgctggacttttgaaattcacgattgatccaggcaactatactgttgtaggagaaggggctgacaaagctcaagcaacgattgcagcaaactcttcagcagttccaggattggtcagctttaataatccagctgttttagtggctcttgcaggacttgccattactatcttctttgtcatc

SEQ ID NO: 339 - DNA, 852 bp; double-stranded, linear
ctactttacatggaagtagtcactgaattccagttagaaattactttgtaactacgttttgaggaggagtaaaatgctttcctacgttcgatattacccactagcgatagctaaattaatgtgtctgtgctctcctaaaatctgctgatttattactgactaatacaggaggttttttttatggacagacaatcatatctgctattggtgtttatatttccaccagtatcgattatttaattattttaattattttatttgcacagctatcacagaataaacagaaatggcatatttatgcggggcaatatctaggcacaggcttacttgtaggggcgagtttagttgctgcttatgtcgttaatttcgtgcctgaagaatggatggttggattgcttggtttaatccctatctatttagggattcgctttgcaattgttggagaagatgcggaagaagaagaggaagaaattattgaaagattagaacaaagcaaggcaaatcaactgttttggacagttacattgctgacaattgcgtctggcggagataatttaggtatctatataccttattttgcttcgttagattggtcacagaccctcgtggccttgcttgtgtttgtaatcggcataattatcttttgcgagattagtcgggtgttatcctctattccgttaatattcgagacaattgaaaaatacgagcgaatcattgtgcccttagtattcattctacttggactatacatcatgtatgaaaatggcacgatagagacttttctgatcgtgtagatttttttgtttcactagggatttagcccgagctcaaatcagctctctgattttcaga

SEQ ID NO: 340 - DNA, 754 bp; double-stranded, linear
ccgcacaaaagcgcatagtatcaagattctataaagccttgatactatgcctttttaatggataaatagttagtcttttttaaagaccggatctttcaaactctgcatactggcattgatcaccgcgcctaggataacaattttagcaatcaagataaaccaaaacatcataacaacaagaagaacggaacctaaaattcggacatccaccaaatgatggacatagtaattgagataactagagaacagagttagtaaacctaaaatcactaagagaacaaaggcactgcctggtagggtatagctaattttcctgttagatagattgggaagaaaataataaagcatgaccaagatagcaaagaggagggcgtaaatcagaggacctgccaacccttgtaaagcctgatagataatgccatcttttgtccaataatgagcaagtaaagccaaaatcatctgaccaaataagatcaaaaacaaggcaaacgcaaagaggagctgcaaccaaaactgactaggagacttagcatctgatgggaaataagtccacgactcttttcgacgccataagccttgttaaaagctttttgcaagaaattcatagattttgaaaaactccataacgccgataaaacagaaaaactcaataaacctgttgaaggttgcgtcaagacttctctggctattttttccacaccttcatagaggcttggggggcagacgtctttcataaagcccaaaaattctccca

SEQ ID NO: 341 - DNA, 707 bp; double-stranded, linear
ggggataactctaggagtaccgctattactcgacttaatgagtgcacaagaagtcaggatttttatgcaggttgggcgcttcatcagacagggaagatttacagcgactattatggaagtcaaggtttgctttattatttgctgacttacgtgagtcagggcggatttttctttgccatctttgagtggttagccttggtagcaggaggatttttcctttttagatcagcggacaccttgacagagcaaggagaccaagctggacatctggtgactattttttacatgctagttacaggtcttgcttttggtggaggctatgcgactcttttagcgcttcctttcttattcgcagcctttagtttagttgcggcttacctaagcaatccaagccatgataagggatttgtacggattgggctagctttggcaggcggatttttctttgctcccttatcatcgctcctgtttattgctgtagtgagtttaggcttgttggtctttaaccttgggcatagacgctttgcgcatgggttttatcagtttcttgcagtggctttaggtttttcacttgtcttttatccaactgcctactatagtgctgcaacaggaagttttggggatgcgwttagtggtattcgttatcctattgacagtattcgctttgattttacttctaaaattttagagaatatgtttttttaagg

SEQ ID NO: 342 - DNA, 762 bp; double-stranded, linear
ggattttgaaaaaccataccgatttgacgacgtatattccaaacattttcctcagtcaaacgttggccatcaattacaatctctccggattctgcttccagtaagccatcaattaatcgaaccgtcgttgatttaccactaccattatgccctacaatcgaaagccattctccacgtttcacgtgaaagtaatatccttcacatcgtagtagttctgattttctttatagcgaaaagaaagattttttacatcaattattgatttcatttcgaaccaaatgtccctttaaatacataggcactacccttgaaatagtcatagccagagtagatagtgaaaaataaggctacataaagtagaacttgaccaagcaaagtccaatgtaatagcaagaaaataatggcaaacatctgactaaaagttttaatttttccaggcattgctgctgctaaaattgttccaccagtttcaaccaataaaagccttaaacctgtcacagctaactcacgacagataatcactgcaacaatccaagccggagccatacctaactcaatcaacataataaaagccgacataactagtaacttatccgccataggatctgcaaatttaccaaaattactgaccacattccatttacgagctaaatatccatctaaatagtcggtaatactggcaacagcaaagataatagctgcaactatatgactctctatcgaatttcctatcgttaaaataaagataaaaataggtataaa

SEQ ID NO: 343 - DNA, 482 bp; double-stranded, linear
cttttgatacacttaaactatgaatacaaatctcaagcccaaacttcagcgttttgcttctgcgactgcctttgcctgtcctatctgtcaagaaaatctgactctgttagagactaatttcaagtgctgcaaccgtcattcttttgacttggcgaaatttggctatgtcaatctagtccctcaaatcaagcaatctgctaactacgacaaggaaaattttcaaaaccgtcaacaaatcctagaagccggcttttaccaagctatcttagatgctgtatctgacttgcttgcaagctcaaaaactaccacaacaattttggatatcggttgtggtgaaggattctattctcgcaaactacaagaaagtcactctgaaaaaactttctatgcctttgacatctccaaagattcagtccaaatcgcggctaaaagtgaacccaactgggcagtcaattggttcgttggcgacttggcacgacttc

SEQ ID NO: 344 - DNA, 520 bp; double-stranded, linear
tttatttttataaagtcaatacctgtctttactttttcttaaaaaaagtttattatgttctttaaggaggtgtaaaacatgaaaataaataataaactcgttggagaacgtattcaaaatatccgtttaagccatggcgactctatggaaaaatttggagaaaaatttaatactagcaaaggtacagttaacaactgggaaaaaggtcgcaatttaccaaataaagaaaacctactaaaaattgcatctattggaaaaatgagtgttgaagagttactctacggcgattacaatacttatctacacttaaagattatggatttagctcctgaatgtataaaaaattatgatgagtataactctttacacgatgatataacaaataaagcgttacagatcgctcaaaataccatttctaagattgattatcaaatttcagacgaaacgatcaaaaaatttattgatttagctatcgaacaatcgagagatttgcaaggaaatttgttgaaaaataacgggt

SEQ ID NO: 345 - DNA, 1003 bp; double-stranded, linear
gcatcaaatccgccatcaaagaagttctctggatttaccaagaccagtcaaatagcttagaagtgcttaatgacaagtacaatgttcactactggaatgactgggaagttggagacacgggaaccattggtgagcgctatggtgccgttgttaagaaacacgacattatcaataagcttctcaaacagttggaaaccaatccttggaaccgccgcaatattatttcgctctgggattaccaagctttcgaagaaacagatgggctgctcccgtgcgcctttcagaccatgtttgatgttcggcgtgttgatggggaaatctatctggatgcgaccttgacccagcgctccaatgatatgctggtggcccaccacatcaacgctatgcagtatgtggctttgcagatgatgattgccaaacattttggctggaaggttgggaagttcttctacttcatcaacaacctccatatctatgataatcaatttgaacaagctcaggaattgctccgtcgggagccgtcaaactgccaaccacgcttggttttaaatgttcctgatgggactaatttctttgatatcaaagcagaagattttgagttggtggattatgaccctgttaagccacagttgaagtttgacctagctatttaaaagaatagaaaaaagaagttgagaataatcccaacttcttttgtttcttaacgtgatacgcggcgacgagctgcttttttacggttttcttcgatgaaagctgctttttgctcttctggttcgattactttctttttaaatgcgtatactgcacctgcaacggcagcgacagttcctgcgacacctgttacaagacctttagcgaatcctttagccatgagtcttcctcctttatattctcaatcagccagcctcctcaagaggtcacatttttctgactgacctttttgtgttataataatagtaacgaaaaaatgggaatttttcaaggaaaaaagatgagaacaaaa

SEQ ID NO: 346 - DNA, 750 bp; double-stranded, linear
ccgcacgtactattccagatgccgaggaagtggacctcatcctcgttggcgcaactggtctcaacgcctttgaacgcctcttggtcggctcttcatctgaatacatactccgccatgctaaggtcgatttgctggttgtgagagaacaagaaaaaaccttataatcacaaagaaaaggagcccctagctcctttttgtttacgatttatttctctctttatggcgttcgtaagccttgagctggcgctgcagttcctttttaatagcaggttctggagcatatttttcttcccaattatctggttttaagattttatgggtcactggatcaaaatgagccttgccatctggaaaaattttccccatattggcctgatggacaatatcaaaaatacgttctgggtccacccccatcaagacaaaactgccgtaggtgaagtaaagcgtgtcaatcaaggcatccacttgccctatcaaatcttgctgagcaggtgtcttcttggctactttatctgctgccttatcaagggcctgatgaagttgcgatacagcttgaccaaaatcttcttcagaaggactggctgctcgaacaaactccaccaattcttctattttaaaaccagccctatgggttgcaccctctaaatcccaagctcgaggttcttcttgggttcgttcatccatcatgtggtggaaagtcttgaccttattgaaatgatagtcacggctgacaaagactttttctgaaga

SEQ ID NO: 347 - DNA, 596 bp; double-stranded, linear
cgcaacatacggataacctccaaagaatatttttatattatagcaaagctttaaattgaatgttagagtcttgttcaaaacaatcatcaaaaccacgtggatgatggtattctactaagtgttgatcttgaggataagtgtacttaccgccaacttcccagataaatggatggaaatcgtattgcaagcgatcttttcgcattttccaaagttctagaatctcattagtagaagccatgaagttagaccagatatcatagtgaactgggataatgactttggtacgcagattttctgccatacgaagaaggtcgatagatgtcaktttgtcttggatacctaccggattttcaccatagttattcaaagcaacatcaattttaaagtctttaccatgttttgcaaaatagtttgagaagtgagaatctgcaccatgatagatggttccacctggtgtttcaaagatatagttaacagccttttgagccatttcttcatctgtaacagccaagccagcagttcaccgcctgtctcatcagcaccgttcactgggagagttaccaagcaagtacggtcaaatgattctactgcatgaa

SEQ ID NO: 348 - DNA, 673 bp; double-stranded, linear
cagagtcaacagcctgagttgaaggcaactttagacacagcagttacgacagctgaatgagctcctccatcagttttttctttaatgagtccagctacatcttcaacttcgaggccgttaatcacaatgtcagcgcctacttcttttgcaagggcaagtttgtcattgttgatatcgactgcgataacatgagcattgaatacttttttagcgtattgaacagcgaggttaccaagtccaccagcaccgtaaagaacaacccattggcctggttcaacttttgcttctttgatagctttataggttgttactccagcacatgtgatagaagaagcttgggctggatcaagtccgtcaggaactttgacagcatagtcagcagttacgatacattgttcagccataccaccgtctactgagtagccagcatttttcactgtacggcaaagggtttcgcgaccagttgtacagtattcgcaagtgccacatccttcaaagaaccaagcaacgctgacgcggtcaccgactttaaggcttttcacatctggagcaatctctttaacgataccgataccttcgtgcccaagaacacgtcctgggacttgaccaaagtcaccatgagcaacgtggaggtcggtgtggcaaacgcccacagtattcacttctacaagtg

SEQ ID NO: 349 - DNA, 198 bp; double-stranded, linear
gtaccctacaaatgctttacagtatgggttgagggtggtcaatggaactatggagtaggttggacaggaacttttggatattctgattacttacattctactcgatatcatacagcaactgttagacatgggggtagaacctctaaggattatgcaaaacctgaggcatgggctagagcttccctcaccaagattccg

SEQ ID NO: 350 - DNA, 891 bp; double-stranded, linear
gcttcttctatagacaaaaatatcatgggtaaaataatcaaggctatagctagaaggagggaccaatccactactaatcctaagaacaaaacactcaagagagcagaagagagaggttcactggcactgataacggcaaccaccaaaggagaaaccaaggacacagccttcatggaaatgaaaaaagcaaaagccgttccaaagaaagcgataatgaggcaaatcaagatactccaaatatcaagagtaaaggaaagctgataaaccggcgagaggacattgctaaacaaacctgccaaaatcatcccccacccaaccgtaggaacaaaaccataacgcttagcaaaaggttggggcaagataacattaaacataacacccatggcactcagcaaacctgttataagagctagcggcgtcatggataactgagagaggtctccctttgtcgccatcaagcaaacacccagcatggcaaccaaaacatagaaaacagcgctttttgacgctcgtttttgataaaccaagcgattgtaaaagaggataaagacagggctaataaactgtaaaatagttgctgtcgtagcatttgagtattctacacagagatagaaaaaatactgaactgaaaaaatccccaaaatagcataggctaaaaagggcaggtaatttttcttgtctcgccaaatatctagcacttgcgattttaattgtattgcagaccaaatgagtacaagactccctgccagtgtcaaacgcatagaggtaatccagcccgaagacacctgataatgagtaaagaagtactctcctaaaattccacagattccccatattaagccggataggagcgaataaatttttccgttaacaatctttttctgatactga

SEQ ID NO: 351 - DNA, 325 bp; double-stranded, linear
gaaagcgttcaatagaacattgcttttttatttttagagtaagctaagcgcttcagcatctgcgatgatggttacatcagggtgattttggaggctacttgcaggtaggttctcagtcactgggccagatactgttccggcaatggcttctgctttcgactcaccgtaagcaaaaagaataatagacttggcatccaaaatgtttttaatccccattgaaatagcttgggttgggacgtcttcaatcttggcaaagaagcgtgcattggcttcgatagtagactggtcaagttctactagatgcgtttgactgtcaaatggagtg

SEQ ID NO: 352 - DNA, 344 bp; double-stranded, linear
caagagcagtttgatgatttttgataagcatgcgaatttaaaatacaaatatggcaatcgcaagttttggtgtagaggctattatgtagatacggtaggccgtaatcagaaagtgatagctgaatatattcagaatcaattacaagaagacagagtagcagacctagctcacgttattcgagtcagtagatccgtttactggcgaaataaataagaggaagtaacgtnaagtgctttagcacctgctcgggaaagtggtgcgcgaggaagctatttcaggatgctttggccctggccggtagaagcgttatagccgcagactacgacacttcacactggtggtt

SEQ ID NO: 353 - DNA, 692 bp; double-stranded, linear
ccctatccctgctattggggctgctctcattgctgctttggcacaaatcagtcttccaattggacctgttcccttcactctgcaaaactttgcaatcggcttgattctactgtctttagaccgagagaggctgtactttctgctggactctatcttcttctaggtgctatcggtcttcctgtctttgcaggaggtggagctggttttcaggctttagttggccctactgcaggctatctttggttttatctcgtttactctggacttacttcctctctaaccaacagcaagagtggtgttgttaagatttttcttgcaaacctcttgggtgatgcccttgtctttgtcggcgggattctcagcttgcatttcctagctggaatggcatttgaaaaagctcttgctgtgggggttcttccctttatcattccagaccttggcaaacttctagctattagttttattagccgtcccctacttcaacgccttaaaaatcaggcttactttactaactaaaaaaggatatcgagttatcatgactcaatatccttttcttttattttgaaaacttatactcaatgaaaatcaaagagcaaactaggaagctagccgcaggctngcaaaacactgttttgaggttgtggatgaaactgacgagtaanatctcatacatacggcaaggcaaagctgac

SEQ ID NO: 354 - DNA, 1005 bp; double-stranded, linear
gtgatggactactggttcaaaacgcatccagaagattttttcgataatgtcggacctcttgtagccagtaacttttttcatacttacaccgaagatttccacttgatgaaggaaattggagttaattctttccgcacttccatccaatggagtcgactcatcaagaatttagagacaggtgagcctgatccaaaaggtattgctttctacaatgccatcattgaagaagctaaaaagaaccagatggatcttgtgatgaatttacatcattttgatttaccagtggaacttcttcaaaaatacggtggttgggaaagcaaacatgtagtggagttattcgtgaagtttgccaagactgctttcacatgctttggagataaggttcattactggacaactttcaatgagccaatggtcattccagaagcagggtacttatatgctttccattatccaaatctaaaaggaaagggaaaagaggccgtacaagtcatctataatctaaaccttgctagtgcaaaagtgattcaactatatcgctcattagaacttgatggaaagattgggattattttaaacttgacacctgcttatccaagaagtaattctccagaagacttagaagcaagtcgatttacagatgacttctttaacaaagtcttcttgaatccagctgttaaaggaactttcccagaaagattggtaaaacagctagagagagatggcgtgttatggagtcataccgaaaaagagcttcaactgatgaaatcaaatacggttgattttcttggagtaaactactaccatccaaaacgtgttcaagcacaagcaaatcctgaggaatatcagacgccctggatgccagaccaatacttcaaagagtatgaatggctggagcgtcgcatgaatccatatcgtggttgggaaatttttccgaaagccatttatgatattgctatgattgtgaaggaagaatatggtaatatcccatggtttatcagtgaa

SEQ ID NO: 355 - DNA, 973 bp; double-stranded, linear
ccgacaagcaatattaaaaagagtaaactattaactagttaattaaccggtttattactttatagtgaatcaaatatacttaagaaaagaggaaagaatgaaaattaataaaaaatatctagcaggttcagtggcagtccttgccctaagtgtttgttcctatgagcttggacgttaccaagctggtcaggataagaaagagtctaatcgagttgcttatatagatggtgatcaggctggtcaaaaggcagaaaacttgacaccagatgaagtcagtaagagggaggggatcaacgccgaacaaattgttatcaagattacggatcaaggttatgtgacctctcatggagaccattatcattactataatggcaaggttccttatgatgccatcatcagtgaagagctcctcatgaaagatccgaattatcagttgaaggattcagacattgtcaatgaaatcaagggtggttatgtcattaaggtaaacggtaaatactatgtttaccttaaggatgcagctcatgcggataatattcggacaaaagaagagattaaacgtcagaagcaggaacgcagtcataatcataactcaagagcagataatgctgttgctgcagccagagcccaaggacgttatacaacggatgatgggtatatcttcaatgcatctgatatcattgaggacacgggtgatgcttatatcgttcctcacggcgaccattaccattacattcctaagaatgagttatcagctagcgagttagctgctgcagaagcctattggaatgggaagcagggatctcgtccttcttcaagttctagttataatgcaaatccagctcaaccaagattgtcagagaaccacaatctgactgtcactccaacttatcatcaaaatcaagggggaaacatttcaagccttttacgtgaattgtatgctaacccttatcagaacgccatgtgggatctg

SEQ ID NO: 356 - DNA, 843 bp; double-stranded, linear
ggtcgcatctgcaatatctgtcgcctccacataagcgacaccagccttgtctgctgcccgtttgacacgttctgcagattgacccaggatgaccatcttcttgagtccagtaatgtctggcaccaattcgtcaaactcattgccacggtccaaaccacctgcaatcaagacgaccttgctgttgtcaaatcctgacaagctttttgagtagccaagatattagttgatttactgtcgttatagaatttaacacscttgatgtcatccacaaactggagacggtgtttgacaccaccgaaggctgaaagagtttccttgatggtttgattgtccacatcacgaagcttggctacagcaatagtcgcaagggcattttccacattgtggctacctggaacaccgatttcattcgctgccatgactacttcaccacggaagtagagttgaccatcttccagataagctccatcaaccttttcaagtgttgaaaatggtacaacagtggcttctgtcttggaagtcaagtcttttgccaagtcttgattaaagttcaagacaaggaaatcagctgctgtcatcttgttctggatattccacttggctgctacatattccgaaaatgacccatggtagtcgatatgagttggcatgaggttggtaataaccgcaatctctggatggaattcttgaacacccatgagttggaaagaagaaagttccataacaagcgtgtccttatctgatgctatttgagcaacctgactagctggatagccgatattccctgataaaagaccatgttggccagcagcagtcaaaacttcccgggntcctctagagtcg

SEQ ID NO: 357 - DNA, 807 bp; double-stranded, linear
ttttttttatattttttttatttattattttttggcaaaaaagaccaatttgctttggagcattgcttctgcattaaattgtctatttttgctcgtgctgttacgctctttgtatcatgtattaactagcaagtgcaacttgcaaactactagtaagaggagaaaaacaaaatggttatgactgacccaatcgcagacttcctaactcgtattcgtaatgctaaccaagctaaacacgaagtacttgaagtacctgcatcaaacatcaaaaaagggattgctgaaatccttaaacgcgaaggttttgtaaaaaacgttgaaatcattgaagatgacaaacaaggcgtcatccgtgtatttcttaaatacggaccaaatggtgagaaagttatcactaacttgaaacgtgtttctaaaccaggacttcgtgtctacaaaaaacgtgaagaccttccaaaagttcttaacggacttggaattgccatcctttcaacttctgaaggtttgcttactgataaagaagcacgccaaaagaatgttggtggtgaggttatcgcttacgtttggtaaaatcaagatacaaagctcgtaaagaacaaagcaaaattaggaagttggagaagtttgtttacaaacaggccaacttatctattttgcacagttcttagagcgtgttcagttcagctcttgagctaagtaagtatctgaaccccgtgaaaactggccgtgctggcatgttcgggtaacaggaganaataaacatgtcacgtattggtaataagttcagctaaggccttcgtaaaagtt

SEQ ID NO: 358 - DNA, 653 bp; double-stranded, linear
cccagtatttttgtccaagcacgaccagaaaaggatgatacagatctggaattggctctcttaaccatctttgaacaaaatcctcaggctcaggtcactattttcggtgccttgggtggccgtattgaccatatgttggccaatgtctttctgcctagcaatcctaagttggcaccctatatgcatcaaatagaaattgaggatgggcaaaacttgattacttattgtccagaaggaatcagtcagctagaacctcgttcagactacgactatctagcctttatgccagttcgggatagccaagtatgagttgacagaggaaaattttttctttaaaaaagtgtacgcttctaacgaatatatagatagggaagtgtcggtaacttgcccagatggttatgtggtcgtactgcatagcaaggacaggaggtaggatggaaagtttacttattctattattaattgccaatctagctggtctctttctgatttggcaaaggcaggataggcaggagaaacacttaagtaagagcttggaggatcaggcagatcatttgtcagaccagctggattaccgctttgaccaagccagacaagccagccagttagaccaaaaagatttggaagtggttgtcagcgaccgtttgcaagaa

SEQ ID NO: 359 - DNA, 641 bp; double-stranded, linear
caccatgtgatgtgacgctggccacagctgtcagaaatctggcgagccatcgtgtgcaatgactcttcccgatgtaatcttgttcatagtcctttgatgaatatgttcaagctgtagaaggtgcgcttcctgaacacttatcaactgttacaggcgagttgaccagtcaggaaacagatggctggtacacacttgccaacacttcttcatcccgcatttacctaaaacaagccttccaagaaaatagcaacctcctagagcaagtggtagaacccttgactattatcactggtggacacaaccacaaggaccagttgacctatgcttggaaaacacttttgcagaatgcgccacatgatagtatctgtggctgtagcgtggacgaagttcaccgcgagatggaaacgcgttttgccaaggtcaaccaagtaggaaactttgttaaaagtaacttgctcaacgagtggaagggtaaaattgctacggataaggctcaaagtgactatctctttactgtcattaacacaggcttgcatgataaggtcgatactgtcagcacagtgattgatgtggcgacttgtgatttcaaggaattgcacccaacagaaggctacaaaaagatggctgctcttatcttgccg

SEQ ID NO: 360 - DNA, 1958 bp; double-stranded, linear
cctcaaggccaatttgaaggctctaaaacaatggaaaagtgctacacagatgtgacagaatttgccattccagcaagtactcaaaagctttacttatcaccagttttagatggctttaatagcgaaattattgcttttaatctttcgacttcacccaacttagaacaagtacaaacaatgttagaacaggcattcaaagagaagcactacgagaatacgattctccatagtgaccaaggctggcaatatcaacacgattcttatcatcggttcctagagagtaagggaattcaagcatctatgtcacgcaagggcaacagccaagacaacggtatgatggaatctttctttggcattttaaaatccgaaatgttttatggctatgagaaaacatttaaatcacttaaccaattggaacaagccattatagactatattgattactacaacaacaaacgaattaaggtaaaactaaaaggacttagtcctgtgcagtacagaactaaatcctttggataaattaattgtctaactttttggggtcagtacaaaactcttgctactatgcgttttattattgaaagacttattggactttctctcaaatcgagtttttactcaattttcttacttgattgggattgaaattccaattaatttctctgagtagagtgtcttgatattggcttcatcaacagaggccttatcaattttacgtttcaagaaaaattcttgaatggtttcgatttcaggctcacgaatagcacggtgtttgtttgagatgaggatttcatagtgaagcggagcttgggtaaaaataacatctgtattccctgcagaataaacctcaacaagggttgcatcggtactttctagctgactttttacaagttgcgagtgtgagtttgtcgtattgataagcttcataatatttcctccgattttctaattctattatagcactttttgaataaagtcgcttgatttatactcaatgaaaatcaaagagcaaactaggaagctagccgcaggctatacttgagtacggtaaggcgacgctgacgtggtttgaattttattttcgaagagtattagccaatcttatgctgttttttccaagattcaatggcccatttatggctaccacgtttaaggtttttgatagcctcgtcaatagggaaccaggcaatatgattaaagttttctagtggcttttgtacttctttgaaaggagttgcttcatagaggtaggcaggattgtagtagtaggtatcacgatgacgagaatagaaatattcgtcagcttgtccgtaataggtaccaatttctgctgtgaaaccaagctcttcaatcaactcatgctttagggcttcctgatgattttcacctgcttcaatttctccacatggtaggaaccaagcaccatttggttcttgaacaagaacaatttgtttttgttcaggattagggataactgcatatacgccatagcgagcaatatagtctgtattcactttttttctccgaaagttgggtttgccattgcattttcctcattatctagtatcgttattattatagtgaaatgaaccaaaaatagtacacaatgtggtataatcttcttatggcatattcaatagattttcgtaaaaaagttctctcttattgtgagcgaacaggtagtataacagaagcatcacacgttttccaaatctcacgtaataccatttatggctggttaaagctaaaagagaaaacaggagagctaaaccaccaagtaaaaggaataaaaccaagaaaggttgatagagatagacttaaaaactatcttactgacaatccagacgcttatttgactgaaatagcttctgaatttggctgtcatccaactaccatccactatgcgctcaaagctatgggtacactcgaaaaaaaaaagaactacacctactatgaac

SEQ ID NO: 361 - DNA, 851 bp; double-stranded, linear
tatgaaattaagttatgatgataaagttcagatctatgaacttagaaaacaaggatatagcttagagaagctttcaaataaatttgggatamacaattctaatcttaggtatatgattaaattgattgatcgttacggaatagagttcgtcaaaaaaggaaaaaatcgttactattctcctgatttaaaacaagaaatgattaataaagtctgacatgaaggctggactaaagatagagtttctcttgaatacggtctcccaagtcgtacgatacttcttaactggctagcacaatacaggaaaaacgggtatactattgttgagaaaccaagagggagagtacctgagagcggagaatgccatcctaaaaaagttaagagaactccgattgaaggaggaaaaagagaaagaagaaagacagaaattgtttaagaattaatgactgagttttcgttagatcttcttttaaaagtcattaaactagctcgttcgacctactactatcacttgaaacagctagataaaccagataaggaccaagagcttaaagctgaaattcaatccatttttatcgaacacaaaggaaattatgcttatcgtcggatttatttagaactaagaaatcgtggttatctggtaaatcataaaagagttcaaggcttgatgaaagtactcaatttacaagctaaaacgcgacagaaacgaaaatattcttctcataaaggagacgttggcaagaaggcagagaatctcattcaaggccaatttgaaggctctaaaacaatggaacagtgctacacagatgtgacagaatttgccattccagtaagtacttaaaagctttacttat

SEQ ID NO: 362 - DNA, 1168 bp; double-stranded, linear
gggtagaatcgatatctccaatgagttggtttagctggtgaaactgtaaaaagatttcgwccaattcaaggttgaggcatcgcaaactatggactgtttcctcgtcagttctggaaagaaaacgggataaggttggctgtgaagcaagctgccctccttccaacaattttggaaagtaggcatcagctgacaattctttacaagcatagtccgttccataacctgttaacagttgaaagaggaactggacaaggatatctgaatccgaataacgacagtagcggcgttggtcattcgttactaaatacttagaaatccgctcttttagtttcaactgggaaaaaagttcctgaaaaaagataagaccaccatactgggttaaatgacctccatcgaaagatagttggtaaaaagacttgttttggaagtgatgatttggtaaactgttcatgtgagtttcctttctttttgtgtttttttctacacttataccataaaggggaaactcttttttgtctagtaaaaaacacccattgggtgaaaaaagaaaccatccaggatctaagctaaggcaaggattctggatggtttttagatttggggtgaataattggggttttagctgcttgcggccaatcaggttcagatacaaaaacttactcatcaacctttagtggaaatccaactacatttaactatctattagactattacgctgataatatagtcaattgaaacaagaacaagacaaaagagcctcataaaaggtattgcaacttggtaatacctttttgaggtgctttttgatatgagcccatgttttctcaataggattgtactcaggtgagtagggaggaagaggtaaaagtttatacccaaactcttcacacaagagttctaacttacccattctatggaatcttgcattatccataataataaccgatggtgtgtttaatgttggtaagagaaatttctgaaaccaagcttcaaaaaagtcgctcgtcatcgtctcttcgtaagttattggagcgattaactcaccatttgttagacctgcaaccaaagaaatcctctgatatcttcttccagatactttgcctcttcttaactgaccttttaatgagcgaccatattctcgataaaaataagtatcgaatcctgtttc

SEQ ID NO: 363 - DNA, 4483 bp; double-stranded, linear
gtcagcttcagcaagcccatcagcttctgaatctgcatcaaccagtgcgtccgcttcagcgtcaaccagtgcgtcggcttcagcgtcgacaagtgcttcggcttcagcatcaacgagtgcgtcggcctcagcaagcgcaagtacctcagcgtcagcttccgcctcaaccagtgcgtcggcttcagcaagcacaagtgcgtcagcctcagcaagtatctcagcgtctgaatcggcatcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcgacaagcgcctcagcttcagcaagtaccagtgcgtcagcctcagcgtcgacaagtgcgtcagcctcagcaagtactagtgcatcagcttcagcatcaacgagtgcatcggcttcggcgtcaaccagtgcatcagagtcagcaagtaccagtgcgtcagcttccgcatcaacaagtgcctcggcttcagcaagcaccagtgcgtcggcttcagcaagtactagcgcctcagcctcagcctcaaccagtgcgtcagcctcagcaagtatctcagcgtctgaatcggcatcaacgagtgcgtccgcttcagcaagtactagcgcctcagcctcagcgtcaacaagtgcatcggcttcagcgtcaacgagtgcgtctgaatcggcatcaacgagtgcgtccgcttcagcaagtactagcgcctcagcctcagcgtcaacaagtgcatcggcttcagcatcaacgagtgcgtccgcttcagcaagtactagcgcctcagcctcagcgtcaacaagtgcatcggcttcagcgtcaacgagtgcgtctgagtcagcatcaacgagtgcgtcagcctcagcaagcacatcagcttctgaatctgcatcaaccagtgcgtcagcctcagcatcgacaagcgcctcagcttcagcaagtaccagtgcgtcagctcagcgtcgacaagtgcstcrgcttcagcaagtaccagtgcgtcagcctcagcaagtaccagtgcktcagcctcagcgtcgacaagtgcgtcggcctcaaccagtgcatctgaatcggcatcaaccagtgcgtcagcctcagcaagtactagcgcctcagcctcagcatcaacgagtgcgtccgcttcagcaagtactagtgcatcagcttcagcaagtactagcgcctcagcctcagcgtcgacaagcgcctcagcttcagcaagtaccagtgcgtcagcctcagcgtcgacaagtgcgtcggcttcagcaagtacctcagcgtctgaatcagcatcaacaagtgcgtcggcttcagcatcaacgagtgcatcagcttcagcatcaacaagtgcttcagcttcagcaagtaccagtgcgtcggcttcagcatcaacgagtgcttcagtctcagcgtcaaccagtgcctctgaatccgcatcaacaagtgcctcggcttcagcaagcaccagtgcttcggcttcagcgtcaacgagtgcgtctgagtcagcatcaacgagtgcgtcacctcagcaagcacatcagcttctgaatctgcatcaaccagtgcgtcacttccgcatcaacaagcgcctcggcctcagcaagtacaagtgcttcagcctcagcatcaaccagtgcatcagcttcagcctcaacaagtgcttcagcctcagcgtcaaccagtgcctcggcttcagcaagtaccagtgcgtcagcttcagcaagcacaagtgcgtcagcttcagcatcaaccagtgcttcggcttcggcatcaacaagtgcctcagcatcagcatcaacgagtgcgtcasctcagcaagtactagtgcatcagcatcagcatcaaccagtgcatcagcctcagcaagtatctcagcgtctgaatcggcatcaacgagtgcatcagcatcagcatcaacgagtgcatcggcttcagcgtcaaccagtgcatcagtctcagcaagcaccagtgcgtcggcttcagcatcaaccagtgcctcagcctcagcaagtatctcagcgtctgaatcggcatcaacgagtgcgtcagcctcagcaagtactagtgcatcagcatcagcatcaacgagtgcatcggcttcagcaagtaccagcgcctcagcttcagcaagcaccagtgcgtcagcctcagcaagtaccagcgcctcagcctcagcaagcaccagtgcctcagcttcagcaagtaccagtgcgtcagcctcagcgtcgacaagtgcgtcggcttcagcaagtacctcagcgtctgaatcagcatcaacgagtgcatcagcttcagcatcaacaagtgcttcagcttcagcaagtaccagtgcgtcggcttcagcatcaacgagtgcttcagtctcagcgtcaaccagtgcctctgaatcagcatcaacaagtgcctcggcttcagcaagcaccagtgcgtcggcttcagcaagtactagtgcatcggcttcagcatcgacaagtgcgtctgaatcggcatcaacgagtgcttcggcttcagcatcaacgagtgcgtcagcctcagcaagcacatcagcttctgaatctgcatcaaccagtgcgtccgcttcagcgtcaaccagtgcgtcggcttcagcgtcgacaagtgcttcggcttcagcatcaacgagtgcgtcggcctcagcaagcgcaagtacctcagcgtcagcttccgcctcaaccagtgcgtccgcttcagcaagcacaagtgcgtcagcctcagcaagtatctcagcgtctgaatcggcatcaacgagtgcgtcggcctcagcaagcgcaagtacctcagcgtcagcttccgcctcaaccagtgcgtcggcttcagcaagcacaagtgcgtcagcctcagcaagtatctcagcgtctgaatcggcatcaacgagtgcgtctgagtcagcatcaacgagtacgtcagcctcagcaagcacatcagcttctgaatcggcatcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcgacaagcgcctcagcttcagcaagtaccagtgcgtcagcctcagcgtcgacaagtgcgtcagcctcagcaagtactagtgcatcagcttcagcatcaacgagtgcatcggcttcggcgtcaaccagtgcatcagagtcagcaagtaccagtgcgtcagcttccgcatcaacaagtgcctcggcttcagcaagcaccagtgcgtcggcttcagcaagtactagcgcctcagcctcagcctcaaccagtgcgtcagcctcagcaagtatctcagcgtctgaatcggcatcaacgagtgcgtccgcttcagcaagtactagcgcctcagcctcagcgtcaacaagtgcatcggcttcagcgtcaacgagtgcgtctgaatcggcatcaacgagtgcgtccgcttcagcaagtactagcgcctcagcctcagcgtcaacaagtgcatcggcttcagcatcaacgagtgcgtccgcttcagcaagtactagcgcctcagcctcagcgtcaacaagtgcatcgggttcagcgtcaacgagtgcgtctgagtcagcatcaacgagtgcgtcacctcakcaagcacatcagcttctgaatctgcatcaaccagtgcgtcacttccgcatcaacaagcgcctcggcctcagcaagtacaagtgcttcagcctcagcatcaaccagtgcatcagcttcagcctcaacaagtgcttcagcctcagcgtcagaccagtgcctcggcttcagcaagtaccagtgcgtcacttcagcaagcacaagtgcgtcagcttcagcatcaaccagtgcttcggcttcggcatcaacaagtgcctcagcatcagcatcaacgagtgcg

SEQ ID NO: 364 - DNA, 2550 bp; double-stranded, linear
gtacctcagcgtccttccgcctcaaccagtgcgtccgcttcagcaagcacaagtgcgtcacctcagcaagtatctcagcgtctgaatcggcatcaacgagtgcgtcggcctcagcaagcgcaagtacctcagcgtcacttccgcctcaaccagtgcgtcggcttcagcaagcacaagtgcgtcasctcagcaagtatctcagcgtctgaatcggcatcaacgagtgcgtctgagtcagcatcaacgagtacgtcagcctcagcaagcacatcagcttctgaatcggcatcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcgacaagtgcgtcggcctcaaccagtgcatctgaatcggcatcaaccagtgcgtcagcctcagcaagtactagtgcatcagcttcagcatcaacgagtgcatcggcttcggcgtcaaccagtgcatcagagtcagcaagtaccagtgcgtcagcttccgcatcaacaagtgcctcggcttcagcaagcacatcagcatctgaatcagcgtcaaccagtgcttcggcttcagcaagtaccagtgcttcagcttcagcatcaaccagcgcctcggcctcagcaagcacctcagcttctgaatcggcctcaaccagcgcctcggcctcagcaagcacctcagcttctgaatcggcctcaaccagcgcctcagcctcagcatcaacgagtgcttcggcttcagcaagcacaagcgcctcgggttcagcatcaacgagtacgtcagcttcagcgtcaaccagtgcttcagcctcagcatcaacaagtgcgtcagcctcagcaagtatctcagcgtctgaatcggcatcaacgagtgcgtctgagtcagcatcaacgagtacgtcagcctcagcaagcacaagtgcttcagcctcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcggcctcaaccagtgcatctgaatcggcatcaaccagtgcgtcagctcagcaagtactagtgcatcagcttcagcatcaacgagtgcatcggcttcggcgtcaaccagtgcatcagagtcagcaagtaccagtgcgtcacttccgcatcaacaagtgcctcggcttcagcaagcacatcagcatctgaatcagcgtcaaccagtgcttcggcttcagcaagtaccagtgcttcagcttcagcatcaaccagcgcctcggcctcagcaagcacctcagcttctgaatcggcctcaaccagcgcctcggcctcagcaagcacctcagcttctgaatcggcctcaaccagcgcctcagcctcagcatcaacgagtgcttcggcttcagcaagcacaagcgcctcgggttcagcatcaacgagtacgtcagcttcagcgtcaaccagtgcttcagcctcagcatcaacaagtgcgtcagcctcagcaagtatctcagcgtctgaatcggcatcaacgagtgcgtctgagtcagcatcaacgagtacgtcagcctcagcaagcacctcagcttctgaatcggcctcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcgacaagcgcctcagcttcagcaagtaccagtgcgtcagcctcagcgtcgacaagtgcgtcagctacagcaagtactagtgcatcagcttcagcatcaacgagtgcatcggcttcggcgtcaaccagtgcatcagagtcagcaagtaccagtgcgtcagttcacgcatcaacaag

SEQ ID NO: 365 - DNA, 1436 bp; double-stranded, linear
acccagcaagtactagtgcatcggcttcagcaagcaccagtgcgtcggcttcagcatcaaccagtgcctcagcctcagcaagtatctcagcgtctgaatcggcatcaacgagtgcgtcacctcagcaagtactagtgcatcagcatcagcatcaacgagtgcatcggcttcagcaagtaccagcgcctcagcttcagcaagcaccagtgcgtcasctcagcaagtaccagcgcctcagcctcagcaagcaccagtgcctcagcttcagcaagtaccagtgcgtcagcctcagcgtcgacaagtgcgtcggcttcagcaagtacctcagcgtctgaatcagcatcaacgagtgcatcagcttcagcatcaacaagtgcttcagcttcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcggcctcaaccagtgcatctgaatcggcatcaaccagtgcgtcagcctcagcaagtactagcgcctcagcctcagcatcaacgagtgcgtccgcttcagcaagtactagtgcatcagcttcagcaagtactagcgcctcagcctcagcgtcgacaagcgcctcagcttcagcaagtaccagtgcgtcagcctcagcgtcgacaagtgcgtcggcttcagcaagtacctcagcgtctgaatcagcatcaacaagtgcgtcggcttcagcatcaacgagtgcatcagcttcagcatcaacaagtgcttcagcttcagcaagtaccagtgcgtcggcttcagcatcaacgagtgcttcagtctcagcgtcaaccagtgcctctgaatccgcatcaacaagtgcctcggcttcagcaagcaccagtgcttcggcttcagcgtcaacgagtgcgtctgagtcagcatcaacgagtgcgtcagcctcagcaagcacatcagcttctgaatctgcatcaaccagtgcgtcagcttccgcatcaacaagcgcctcggcctcagcaagtacaagtgcttcagcctcagcatcaaccagtgcatcagcttcagcctcaacaagtgcttcagcctcagcgtcaaccagtgcctcggcttcagcaagtaccagtgcgtcagcttcagcaagcacaagtgcgtcagcttcagcatcaaccagtgcttcggcttcggcatcaacaagtgcctcagcatcagcatcaacgagtgcgtcagccgg

SEQ ID NO: 366 - DNA, 735 bp; double-stranded, linear
gcagttgccacaccgtgctgaccagcacccgttcctgcgataattttctttttacccatgcgtwtggcaagccaaacttgtcctaaggcattgttaatcttgtgggctcctgtatggttaaggtcttcccgtttgagataaatcttgctccgccaatatgctgggtcaagttttttgcgtaataaagaggagtttcacgtcctacgtactggcgcaaaagctggtttaattcctcttggaaacttgggtctgcctgactttcacggtaggccttctccaactccaaaactgctgtcatcaatgtttctgggacaaaacgtccgccgaattttccgtaaaatccatctttatttggttcctgatatgccatgctttaccctctctataaatcttctaatcttttcatgatctttttgtccatctgtctccactccgctcgatacatctactgcatagggagtaaagtgttgaattgcttttactacattatcttcattaaggccacctgcgataaagaagggctgtgctagtccagtcgtatccagttgaccccaatcaaagggctggccacttcctgccacaggggcatcaaagagtagataatctgcctgagaattggggacatgcccatttccatctacctgcacagcctgaatactggcacaaggcaaattctcaaataaatcatctgccacctgaccgtgaacttgaaccaagtccaagccggggatcctc

SEQ ID NO: 367 - DNA, 1702 bp; double-stranded, linear
tactagcgcctcagcctcagcgtcaacaagtgcatcggcttcagcatcaacgagtgcgtccgcttcagcaagtactagcgcctcagcctcagcgtcaacaagtgcatcggcttcagcgtcaacgagtgcgtctgagtcagcatcaacgagtgcgtcagcctcagcaagcacatcagcttctgaatctgcatcaaccagtgcgtcagcctcagcatcgacaagcgcctcagcttcagcaagtaccagtgcgtcagcctcagcgtcgacaagtgcgtcggcttcagcaagtaccagtgcgtcagcctcagcaagtaccagtgcgtcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcatcagagtcagcaagtaccagtgcgtcagcttccgcatcaacaagtgcctcggcttcagcaagtactagcgcctcagcctcagcgtcaacaagtgcttcagcttccgcgtcaaccagcgcctcggcctcagcaagtatctcagcgtctgaatcggcatcaacaagtgcctcggcttcagcatcaacgagtgcatcagtctcagcaagcaccagtgcgtcggcctcagcaagcaccagcgcgtctgaatccgcatcaaccagtgcctcagcttcagcaagtacctcagcatctgaatcagcatcaacaagtgcatcggcttcagcaagcacaagtgcttcagcctcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcggcctcaaccagtgcatctgaatcggcatcaaccagtgcgtcagcctcagcaagtactagcgcctcagcctcagcatcaacgagtgcgtccgcttcagcaagtactagtgcatcagcatcagcatcaacgagtgcatcggcttcagcaagtaccagcgcctcagcttcagcaagcaccagtgcgtcagcctcagcaagtaccagcgcctcagcctcagcaagcaccagtgcctcagcttcagcaagtaccagtgcgtcagcctcagcgtcgacaagtgcgtcggcttcagcaagtacctcagcgtctgaatcagcatcaacgagtgcatcagcttcagcatcaacaagtgcttcagcttcagcaagtaccagtgcgtcggcttcagcatcaacgagtgcttcagtctcagcgtcaaccagtgcctctgaatcagcatcaacaagtgcctcggcttcagcaagcaccagtgcgtcggcttcagcaagtactagtgcatcggcttcagcatcgacaagtgcgtctgaatcggcatcaacgagtgcttcggcttcagcatcaacgagtgcgtcagcctcagcaagcacatcagcttctgaatctgcatcaaccagtgcg

SEQ ID NO: 368 - DNA, 941 bp; double-stranded, linear
accagtgcatcagcttcagcctcaacaagtgcttcagcctcagcgtcaaccagtgcctcggcttcagcaagtaccagtgcgtcacttcagcaagcacaagtgcgtcacttcagcatcaaccagtgcttcggcttcggcatcaacaagtgcctcagcatcagcatcaacgagtgcgtcacctcagcaagtactagtgcatcagcatcagcatcaaccagtgcatcagcctcagcaagtatctcagcgtctgaatcggcatcaacgagtgcatcagcatcagcatcaacgagtgcatcggcttcagcgtcaaccagtgcatcagtctcagcaagcaccagtgcgtcggcttcagcatcaacgagtgcctcagcctcagcaagtatctcagcgtctgaatcggcatcaacgagtgcgtcagcctcagcaagtactagtgcatcggcttcagcaagcaccagtgcgtcggcttcagcatcaaccagtgcctcagcctcagcaagtatctcagcgtctgaatcggcatcaacgagtgcgtcagcctcagcaagtactagtgcatcagcatcagcatcaacgagtgcatcggcttcagcaagtaccagcgcctcagcttcagcaagcaccagtgcgtcagcctcagcaagtaccagcgcctcagcctcagcaagcaccagtgcctcagcttcagcaagtaccagtgcgtcagcctcagcgtcgacaagtgcgtcggcttcagcaagtacctcagcgtctgaatcagcatcaacgagtgcatcagcttcagcatcaacaagtgcttcagcttcagcaagtaccagtgcgtcggcttcagcatcaacgagtgcttcagtctcagcgtcaaccagtgcctctgaatcagcatcaacaagtgcctcggcttcagcaagcaccagtgcgtcggcttcagcaagtactagtgc

SEQ ID NO: 369 - DNA, 869 bp; double-stranded, linear
cagcaagtactagtgcatcagcttcagcatcaacgagtgcatcggcttctgcgtcaaccagtgcatcagagtcagcaagtaccagtgcgtcagcttccgcatcaacaagtgcctcggcttcagcaagcaccagtgcgtcggcttcagcaagtactagcgcctcagcctcagcctcaaccagtgcgtcagcctcagcaagtatctcagcgtctgaatcggcatcaacgagtgcgtccgcttcagcaagtactagcgcctcagcctcagcgtcaacaagtgcatcggcttcagcgtcaacgagtgcgtctgaatcggcatcaacgagtgcgtccgcttcagcaagtactagcgcctcagcctcagcgtcaacaagtgcatcggcttcagcatcaacgagtgcgtccgcttcagcaagtactagcgcctcagcctcagcgtcaacaagtgcatcggcttcagcgtcaacgagtgcgtctgagtcagcatcaacgagtgcgtcagcctcagcaagcacatcagcttctgaatctgcatcaaccagtgcgtcagcctcagcatcgacaagcgcctcagcttcagcaagtaccagtgcgtcagcctcagcgtcgacaagtgcgtcggcttcagcaagtaccagtgcgtcagcctcagcaagtaccagtgcgtcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcatcagagtcagcaagtaccagtgcgtcagnttccgcatgcaacaagtgcctcggcttcagcaagtac

SEQ ID NO: 370 - DNA, 750 bp; double-stranded, linear
tcaacaagtgcctcagcatcagcatcaacgagtgcgtcagcctcagcaagtactagtgcatcagcatcagcatcaaccagtgcatcagcctcagcaagtatctcagcgtctgaatcggcatcaacgagtgcatcagcatcagcatcaacgagtgcatcggcttcagcgtcaaccagtgcatcagtctcagcaagcaccagtgcgtcggcttcagcatcaacgagtgcctcagcctcagcaagtatctcagcgtctgaatcggcatcaacgagtgcgtcagcctcagcaagtactagtgcatcggcttcagcaagcaccagtgcgtcggcttcagcatcaaccagtgcctcagcctcagcaagtatctcagcgtctgaatcggcatcaacgagtgcgtcagcctcagcaagtactagtgcatcagcatcagcatcaacgagtgcatcggcttcagcaagtaccagcgcctcagcttcagcaagcaccagtgcgtcagcctcagcaagtaccagcgcctcagcctcagcaagcaccagtgcctcagcttcagcaagtaccagtgcgtcagcctcagcgtcgacaagtgcgtcggcttcagcaagtacctcagcgtctgaatcagcatcaacgagtgcatcagcttcagcatcaacaagtgcttcagcttcagcaagtatctcagcgtctgaatcggcatcaacgagtgcgtccgcttcagcaagtactagcgcctcagcatcagcgtcaacg

SEQ ID NO: 371 - DNA, 957 bp; double-stranded, linear
ccggaaaacagctctggcgcttggtcttgcccagcgtattgctagtggtgacgtgcctgcggaaatggctaagatgcgcgtgttagaacttgatttgatgaatgtcgttgcagggacacgcttccgtggtgactttgaagaacgcatgaataatatcatcaaggatattgaagaagatggccaagtcatcctctttatcgatgaactccacaccatcatgggttctggtagcgggattgattcgactctggatgcggccaatatcttgaaaccagccttggcgcgtggaactttgagaacggttggtgccactactcaggaagaatatcaaaaacatatcgaaaaagatgcggcactttctcgtcgtttcgctaaagtgacgattgaagaaccaagtgtggcagatagtatgactattttacaaggtttgaaggcgacttatgagaaacatcaccgtgtacaaatcacagatgaagcggttgaaacagcggttaagatggctcatcgttatttaaccagtcgtcacttgccagactctgctatcgatctcttggatgaggcggcagcaacagtgcaaaataaggcaaagcatgtaaaagcagacgattcagatttgagtccagctgacaaggccctgatggatggcaagtggaaacaggcagcccagctaatcgcaaaagaagaggaagtacctgtctacaaagacttggtgacagagtctgatattttgaccaccttgagtcgcttgtcaggaatcccagttcaaaaactgactcaaacggatgctaagaagtatttaaatcttgaagcagaactccataaacgggttatcggtcaagatcaagctgtttcaagcattagccgtgccattcgccgcaaccagtcagggattcgcagtcataagcgtccgattggttcctttatgttcctagggcctacaggtgtcggggtatccga

SEQ ID NO: 372 - DNA, 807 bp; double-stranded, linear
caaagcgcctcagcttcagcatcaacaagtgcgtcggcttcagcatcaaccagtgcctcggcttcagcgtcaaccagtgcgtcacattcagcaagtaccagtgcttcagtctcagcatcaacaagtgcttcagcctcagcatcgacaagtgcctcggcttcagcaagcacatcagcatctgaatcagcgtcaaccagtgcttcggcttcagcaagtaccagtgcttcagcttcagcatcaaccagcgcctcggcctcagcaagcacctcagcttctgaatcggcctcaaccagcgcctcggcctcagcaagcacctcagcttctgaatcggcctcaaccagcgcctcagcctcagcatcaacgagtgcttcggcttcagcaagcacaagcgcctcgggttcagcatcaacgagtacgtcagcttcagcgtcaaccagtgcttcagcctcagcatcaacaagtgcgtcagcctcagcaagtatctcagcgtctgaatcggcatcaacgagtgcgtctgagtcagcatcaacgagtacgtcagcctcagcaagcacctcagcttctgaatcggcctcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcggcttcagcatcaaccagtgcctcggcttcagcgtcaaccagtgcgtcagcttcagcaagtaccatgtgcttcatgtctcag

SEQ ID NO: 373 - DNA, 1068 bp; double-stranded, linear
catcggcttcagcatcaacgagtgcgtccgcttcagcaagtactaccgcctcagcctcagcgtcaacaagtgcatcggcttcagcgtcaacgagtgcgtctgagtcagcatcaacgagtgcgtcacctcagcaagcacatcagcttctgaatctgcatcaaccagtgcgtcacctcagcatcgacaagcgcctcagcttcagcaagtaccagtgcgtcacctcagcgtcgacaagtgcgtcggcttcagcaagtaccagtgcgtcasctcagcaagtaccagtgcgtcacctcagcgtcgacaagtgcgtcggcctcaaccagtgcatctgaatcggcatcaaccagtgcgtcacctcagcaagtactagtgcatcagcttcagcatcaacgagtgcatcggcttcagcatcaaccagtgcatcagagtcagcaagtaccagtgcgtcagcttccgcatcaacaagtgcctcggcttcagcaagtactagcgcctcagcctcagcgtcaacaagtgcttcagcttccgcgtcaaccagcgcctcggcctcagcaagtatctcagcgtctgaatcggcatcaacaagtgcctcggcttcagcatcaacgagtgcatcagtctcagcaagcaccagtgcgtcggcctcagcaagcaccagcgcgtctgaatccgcatcaaccagtgcctcagcttcagcaagtacctcagcatctgaatcagcatcaacaagtgcatcggcttcagcaagcacaagtgcttcagcctcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcgggctcaaccagtgcatctg

SEQ ID NO: 374 - DNA, 620 bp; double-stranded, linear
cagcatcaacgagtgcttcagtttcagcgtcaaccagtgcctctgaatcagcttcaacaagtgcctcggcttcagcaagccccagtgcgtcggcttcagcaagtactagtgcatcggcttcagcatcgacaagtgcgtctgaatcggcatcaacgagtgcttcggcttcagcatcaacgagtgcgtcagcctcagcaagcacatcagcttctgaatctgcatcaaccagtgcgtccgyttcagcgtcaaccagtgcgtcggcttcagcgtcgacaagtgcttcggcttcagcatcaacgagtgcgtcggcctcagcaagcgcaagtacctcagcgtcagcttccgcctcaaccagtgcgtcggcttcagcaagcacaagtgcgtcagcctcagcaagtatctcagcgtctgaatcggcatcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtca

SEQ ID NO: 375 - DNA, 720 bp; double-stranded, linear
gtattggggcgccccaacctctatgtgactacggattatttcctagattacatggggataaaccatttagaagaattaccagtgattgatgagcttgagattcaagcccaagaaagccaattatttggtgaaaggatagaagaagatgagaatcaataagtatattgcccacgcaggtgtggccagtaggagaaaagcagaagagctgattaagcaaggcttggtgacggttaacggccaagtggtgcgtgaactagcaaccactatcaagtcaggcgacaaggtcgaagttgaaggtcaacctatctacaacgaagaaaaggtctactatctgcttaacaaaccacgcggtgtgatttccagtgtgacagatgataagggtcgcaagacggttgtcgacctcttgcccaatgtcaaagagcgtatttaccctgtgggtcgtttggactgggatacatcaggtgtcttgattttgaccaatgatggggactttacagacgagatgattcaccctcgtaatgagattgacaaggtttatgtcgcgcgtgttaaaggtgtggccaataaggacaatctccgccccttgacccgtggtcttgagattgatggtaagaaaaccaagccataatatataggttttgtagcctctacaccataaatatttgctaataaaaatactgtattattaccctcttaaggtgcgaaattattcaagttctt

SEQ ID NO: 376 - DNA, 648 bp; double-stranded, linear
cgccatttcccatcgtaccgccgaaaatcccagcgcctcagccatcaaatatcctatcaacgttctcaaaaaaagtgaccgctctctcatcatgtttccaagtggtagccgccactcaaacgatgtcaaggggggcgcacactskattgccaaaatggccaaggtccgtatcatgccggttacctacaccggtcccatgactttgaagggcttgattagccgtgaacgtgtcgatatgaactttggaaatccaatcgatatctcagatatcaagaaaatgaatgatgaaggcattgaaacagtcgccaatcgtattcaaacagaattccaacgtctggacgaagaaacgaaacaatggcacaatgataaaaaaccaaatccactctggtggtttatccgcatccctgccctcatccttgctattatcctcgctatcctaaccatcatctttagctttatcgcaagcttcatctggaacccagataagaaaagagaagaacttgcatagaagaaatgaaccttggccaaacagctaaggttttcatttatatagtagattggwactagaatagtacacctctacttctaaaacatttttagaaatcgatttgactgtcctgatcgatttgtcctaatcttatttcaatt

SEQ ID NO: 377 - DNA, 690 bp; double-stranded, linear
gtgcatcgctttcagcatcgacaagtgcgtctgaatcggcatcaacgagtgcttcggcttcagcatcaacgagtgcgtcagcttcagcaagcacatcagcttctgaatctgcatcaaccagtgcgtccgcttcagcgtcaaccagtgcgtcggcttcagcgtcgacaagtgcttcggcttcagcatcaacgagtgcgtcggcctcagcaagcgcaagtacctcagcgtcagcttccgcctcaaccagtgcgtccgcttcagcaagcacaagtgcgtcagcctcagcaagtatctcagcgtctgaatcggcatcaacgagtgcgtcggcctcagcaagcgcaagtacctcagcgtcagcttccgcctcaaccagtgcgtcggcttcagcaagcacaagtgcgtcagcctcagcaagtatctcagcgtctgaatcggcatcaacgagtgcgtctgagtcagcatcaacgagtacgtcagcctcagcaagcacatcagcttctgaatcggcatcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcagcttcagcatcaacgagtgcatcggctt

SEQ ID NO: 378 - DNA, 1003 bp; double-stranded, linear
cgagattctctggagttatggatgtcgttccaatatgtgcacgttggaatgttagtgcttatatggggggaacagaatcctctcttgattgaagacaagctagtcattaggctggtttgtctttttgtcaactgtagtgggttgatataatagtattagtgagtgggataaaagtttcatttagtttattcagtacaaatttaacgggtcaagatttatatactagtggtgtttttggggctgagagaagtatcttgattttatgtgtggtttttatacttacagttgttctgctccaaagagcttgtagagaagaattagctcataaaggagattgattattttgatatcaaaaaaatgcacaggataacctgatgcatttttttagcgacaatgcttgctacttccttctgtcgaatttagacaattttaaaccccaattattcaccccaaatctaaaaaccatccagaatccttgccttagcttagatcctggatggtttcttttttcacccaatgggtgttttttactagacaaaaaagagtttcccctttatggtataagtgtagaaaaaaacacaaaaagaaaggaaactcacatgaacagtttaccaaatcatcacttccaaaacaagtctttttaccaactatctttcgatggaggtcatttaacccagtatggtggtcttatcttttttcaggaacttttttcccagttgaaactaaaagagcggatttctaagtatttagtaacgaatgaccaacgccgctactgtcgttattcggattcagatatccttgtccagttcctctttcaactgttaacaggttatggaacggactatgcttgtaaagaattgtcagctgatgcctactttccaaaattattggaaggagggcagcttgcttcacagccaaccttatcccgttttctttccagaactgacgaggaaacagtccatagtttgcgatgcctcaaccttgaattggtcgaattcttttt

SEQ ID NO: 379 - DNA, 738 bp; double-stranded, linear
ccgatgattctgattggtttgctctttactttgctgggaattttgaggtagatctatgattgaaatactaattgttttagctattatcctatctcttgctttgattgtattggtaactatacaaccccgtcaaaatcaactattttccatggatgccactagtaatattggtaaaccaagctactggcagagcaacaccttggtcaaggtgctcactttattggtgagtttggctttatttattctactattaacctttatggtgattacttataaataaaagaaaacttcagatattcaccttttgtggattggtctgaagttttcttttttatactcaatgaaaatcaaagagcaaactaggaagctagccgcackgctcaaaacaccgttttgaggttgtagatataactgacgagcgactcaaaacaccgttttgaggttgtagatataactgacgagcgactcaaaacaccgttttgaggttgtggatagaactgacgagcgactcaaaacaccgttttgaggttgtggatagaactgacgaagtcgctcaaaacaccgttttgaggttgtggatagaactgacgaatgctcaaaacaccgttttgaggttgtggatagaactgacgaagcgaacatatatacagcaaggcgacgctgacgtggtttgaagagtattactgtctatatttttggtaaaaatcaacttttacttggatgaaggttttttttttt

SEQ ID NO: 380 - DNA, 695 bp; double-stranded, linear
ccgtcttatcaaagaggttaacaaaggcaccaaatttctcgatacgaacgactttagcacggtaaacttcatccactttggcttcacgaaccaaaccagcaataatttctttggcacggttaatagcatcttggtcactagagtagatagacacatttccttcttcgtctatatcaatcttaacacctgtttcagcgataatcttgtcgatggtttctccacccttaccgatgacaatcttaatcttgtccacatcaatcttgatcgtatcaattttcggagcagttggagccaattctggacgaacttctggaatggttgcttcaatgacatcaaggatttcaaaacgcgctttcttggcttgagcaagagcctccgtcaagatttctgcagtaatcccttgaatcttgatatccatttgaagggctgtaatcccatcacgagtacctgcaaccttgaagtccatatctccaaagtgatcttccaaaccttggatatctgtcaatactgtgtagttatttccatctgagataagccccatagcaataccagctactggcgccttgattggcacaccaccagccataagggcaagagttcccgcacagatagaagcttgagatgaagaaccgtttgattccaaaacttctgctactagacggatagcgtaggggaattcttccaagcttggcagg

SEQ ID NO: 381 - DNA, 691 bp; double-stranded, linear
gacatcttatctaaatacatgctaatatatttagatacaaacattccaacttgataattttcactcatctttcatcattccttatacaactatgcagtataaatagaatagttttctcatcagaatgagactattttaatattagatccccaattattcaccccaaatctaaaaaccatccagaatccttgccttagcttagatcctggatggtttcttttttcacccaatgggtgttttttactagacaaaaaagagtttcccctttatggtataagtgtagaaaaaaacacaaaaagaaaggaaactcacatgaacagtttaccaaatcatcacttccaaaacaagtctttttaccaactatctttcgatggaggtcatttaacccagtatggtggtcttatcttttttcaggaacttttttcccagttgaaactaaaagagcggatttctaagtatttagtaacgaatgaccaacgccgctactgtcgttattcggattcagatatccttgtccagttcctctttcaactgttaacaggttatggaacggactatgcttgtaaagaattgtcagctgatgcctactttccaaaattgttggaaggagggcagcttgcttcacagccaaccttatcccgwtttctttccagaactgacgaggaaacagtccatagtttgcgatgcctca

SEQ ID NO: 382 - DNA, 750 bp; double-stranded, linear
atctctctgcgtaatggtcctcagataactctgatgatgtgtggcgatatagaactgagccaagttatgcctaaagggccttaggaataggagctttcacaagcttatccagatgattatcttttactcgttatggacaatgctatatggcataaatcaagtaccttaaagattccgactaatattggctttgcatttattcctccatacacaccagagatgaaccccattgaacaagtgtggaaagagattcgtaaacgtggatttaagaataaagcctttcgaactttggaagatgtcatacaaggactggagaaggaggtgataaagtccatcgttaatcggagacggactagaatgctttttgaaaacagatgagtataaaaagaaagtcctcatttcaatagaaatcacgactttctgatgaatttatagtaaaatgaaataagaacaggatagtcaaatcgatttctaacaatgttttagaagcagaggtgtactattctagtttaaatccactatatttggggagtgatagaaaagcccttcatcagccaatctacttgttcaggtgcgagagctttgacatccttttctgtactggaccaagtcagttttccgttctcaaagcgtttatataatatccaaaatccttgaccatcccagtaaagaactttaaagcggtctttacgtccaccacaaaagagaaagacttgatcggagaaaggatccaattcaaagtgggtttgg

SEQ ID NO: 383 - DNA, 738 bp; double-stranded, linear
tcaaattcttcgtggtccgcatatctntcttcgtacacggcagtcacttggtctttcactactcgagtcgcagcttcacgggccaatttctcttctacttgaactgccttttggaggtcactgttgtaggctgcaatgatttcagcttgcaattcagcatccacgtgaagcaattccacttctgctttttctttaccgacagcagcaacgatttcttcttggaaggcaatcaattctttgacagcttcgtgccctttaaggagcgcttccaacatgatttcttctgacaattctttggcaccagactctaccatgttgatagcgtgcttggttccagctactgtcaattcaagaagagattgctctgcttgttcttgacttgggttgatgatgatttggccatctacatatcccacttgtaccccagcaattggtccgtcaaatggaatatctgaaatagacagtgccaaagatgaaccaaacatagcagccattggtgcagatgcattttcatcataagaaagcactgtattgatgacttggacttcattacggaaaccttccgcaaacataggacgaatcggacggtcaatcaaacgcgctgtcaaggtcgcatctgttgaaggacgtccttcacgtttcataaagccaccaggaaacttcccagccgcatacattttttcttcgtagttgacttggagtgggaagaaatcctcagttgccattttctggggatcc

SEQ ID NO: 384 - DNA, 657 bp; double-stranded, linear
ccccctatttaccgtggactaaagttgtacaagaaaagtgcaaataagaaatctccagattaggaactatatatgagttctctagtctggagatttttcaatagacttcgttattgggcggttactttcgaaactttgaaaacttcaaaaaacggatttttatcgctttcaaattcttttggggtcaaactcagtaacttattcgccttgtagacttcatgacgctcagggtatactttcaaggtcccaaatagccaagaatcgtcagcgatattatctgaatcatctccttcttgttctcctttagttcgcctgaggacagccttgacacgcgccagaattctctagggctaaaaggcttggtcaggtagtcatcagcccctaattccaaggccaaaaccttatcaaattcatcacttttcgcagaaaccatcataattggagttttgacgcctttggctctcagccgcttacaaacttccatgccatctaattgtggtaacatgatatcaagcaagataaaatcaaagggttctgtttctgccaaagctaaggccttccgtccatttgtcaccaattgagtagaaaagccttccttacttaaatggtagtcaagcaatttcagaatgtgttcttcatcatccactaataagactt

SEQ ID NO: 385 - DNA, 586 bp; double-stranded, linear
ccgcatcagcatcaacgagtgcatcggcttcacgtcaaccagtgcatcagtctcagcaagcaccagtgcgtcggcttcagcatcaacgagtgcctcagcctcagcaagtatctcagcgtctgaatcggcatcaacgagtgcgtcagctcagcaagtactagtgcatcggcttcagcaagcaccagtgcgtcggcttcagcatcaaccagtgcctcagcctcagcaagtatctcagcgtctgaatcggcatcaacgagtgcgtcacctcagcaagtactagtgcatcagcatcagcatcaacgagtgcatcggcttcagcaagtaccagcgcctcagcttcagcaagcaccagtgcgtcacctcagcaagtaccagcgcctcagcctcagcaagcaccagtgcctcagcttcagcaagtaccagtgcgtcacctcagcatcgacaagtgcgtcggcttcagcaagtacctcagcgtctgaatcagcatcaacgagtgcgtcagcttcagcatcaaccagtgcctcagcctcagcaagtatcagtgcgtcagcttcagcatcaacgagtgcgtcagctgcagcaagta

SEQ ID NO: 386 - DNA, 451 bp; double-stranded, linear
cgtcggcttcagcatcaacgagtgcatcagcttcagcatcaacaagtgcttcagcttcagcaagtaccagtgcgtcggcttcagcatcaacgagtgcttcagtctcagcgtcaaccagtgcctctgaatccgcatcaacaagtgcctcggcttcagcaagcaccagtgcttcggcttcagcgtcaacgagtgcgtctgagtcagcatcaacgagtgcgtcacctcagcaagcacatcagcttctgaatctgcatcaaccagtgcgtcagcttccgcatcaacaagcgcctcggcctcagcaagtacaagtgcttcagcctcagcatcaaccagtgcatcagcttcagcctcaacaagtgcttcagcctcagcgtcaaccagtgcctcggcttcagcaagtaccagtgcgtcagttcagcaagcacaagtgcgtcaatttagcatcaaccag

SEQ ID NO: 387 - DNA, 425 bp; double-stranded, linear
tctcagcaagcaccattgcgtcggcttcatcaagcaccagcgcgtttgaatccgcatcaaccagtgcttcagcttcagccaagttacctcagcatctgaatcagcatcaacaagtgcatcggcttcagcaagcacaagtgcttcagctcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaag

SEQ ID NO: 388 - DNA, 572 bp; double-stranded, linear
agaggatccccggatcctcagtcgctgagataactcctttgggcttgttcatcatgtagtagacaaactcttcatactccaacacttgcccattttatgcgaatctcatctattttttcttttttttgcaatttagctgatttttcttttttaccatttacagtcacgcgcccagccttgagcaagtttttgacctcagtccgacttcccaccgcacaggcaactaaaaatttatctaatctcatagaactattatatcatatcaaaaggaggctagtacaatgaccaacctccttttcgtttcatactcttcaaaaatctcttcaaaccgcgtcaacgtcgccttgccgtatatatgttactgacttcgtcagttctatctgcaacctcaaaacagtgttttgagctgacttcgtcagttctatctgcaacctcaaagcagtgctttgagcatcctgcggctagtttcckagtktgctctttgatttwcattgagtatcagatttaggaaattaacttcctcgkctccaaaaaakagctaaaacaatcaaggctcctaaaatcgctgggat

SEQ ID NO: 389 - DNA, 505 bp; double-stranded, linear
caacaagtgcctcggcttcagcatgcacaagtgcttcagcttcagcatgtacctgagcgtctgaatcagcatcaacgtgtgcgtccgcttcagcatgtactgctgcctcagcatcagcgtcaacawgtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcggcctcaaccagtgcatctgaatcggcatcaaccagtgcgtcagcctcagcaagtactagcgcctcagcctcagcatcaacgagtgcgtccgcttcagcaagtactagtgcatcagcatcagcatcaacgagtgcatcggcttcagcaagtaccagcgcctcagcttcagcaagcaccgg

SEQ ID NO: 390 - DNA, 447 bp; double-stranded, linear
gctaagactacctcattaggggcataggctgctaaaataactgcagctgtggttaatgacaatactgtactttttttcattttaattccttacatatttatataacttccaatagataataaactttaactttgctagcctttgttataaaaagttttactaagtattatctaggaaatagagtagtacatttatatataattgttatctctctataaaaacagtatatcatttaaaaaaatttaagtcaaaaaaattaacattagttaatttattttttagcacacattaaaaaataagattagtactcaatgaaaatcaaagagcaaactaggaaactagccgcagattgctcaaaacagtgttttgaggttgtagatggaatgacgtagtcagctcaaaacactgttttgaagttgtggatagaactgacgaagtcggtaccga

SEQ ID NO: 391 - DNA, 572 bp; double-stranded, linear
agcacttgtcgttgaattctacaacaaaatgttgtaatattttattgaataagataggccttgatattaagcactttgggacgttctcccttagtgcttttttgatttctcttagtatccagctataatcgttgagacataactagaccgatatagtccaaagtgatatagtaaaatgaaccaaaaatagtacacaatgtggtataatccttttatggcatattcaatagattttcgtaaaaaagttctctcttattgtgagcgaacaggtagtataacagaagcatcacacgttttccaaatctcacgtaataccatttatggctggttaaagctaaaagagaaaacaggagagctaaaccaccaagtatagtgtattgaatctataacagtacaccttggctgctaaaatatttctataaattaatttgactttcctgatagagatgttcacatcttatttcaaactactatataagttctataatctctttataagatttgcccatcagacaaaatagaacgatttgaaggcgtttatgatatttagctgtacgagagtcttttaaaag

What is claimed is:

1. An isolated polynucleotide fragment comprising the nucleic acid sequence of an ORF selected from the group consisting of:
   (a) ORF ID NO:9 of Contig ID NO:5, represented by nucleotides 12592–13197 of SEQ ID NO:5;
   (b) ORF ID NO:1 of Contig ID NO:46, represented by nucleotides 2–1267 of SEQ ID NO:46;
   (c) ORF ID NO:5 of Contig ID NO:58, represented by nucleotides 6565–7356 of SEQ ID NO:58;
   (d) ORF ID NO:3 of Contig ID NO:78, represented by nucleotides 1108–3636 of SEQ ID NO:78;
   (e) ORF ID NO:3 of Contig ID NO:94, represented by nucleotides 951–2741 of SEQ ID NO:94;
   (f) ORF ID NO:4 of Contig ID NO:94, represented by nucleotides 3006–5444 of SEQ ID NO:94;
   (g) ORF ID NO:3 of Contig ID NO:32, represented by nucleotides 1885–1076 of SEQ ID NO:32;
   (h) ORF ID NO:4 of Contig ID NO:92, represented by nucleotides 1753–3276 of SEQ ID NO:92;
   (i) ORF ID NO:2 of Contig ID NO:89, represented by nucleotides 1007–1627 of SEQ ID NO:89; and
   (j) ORF ID NO:1 of Contig ID NO:287, represented by nucleotides 2–871 of SEQ ID NO:287.

2. The isolated polynucleotide of claim 1, wherein said polynucleotide comprises a heterologous polynucleotide sequence.

3. The isolated polynucleotide of claim 2, wherein said heterologous polynucleotide sequence encodes a heterologous polypeptide.

4. A method for making a recombinant vector comprising inserting the isolated polynucleotide of claim 1 into a vector.

5. A nucleic acid sequence complimentary to the polynucleotide of claim 1.

6. A recombinant vector comprising the isolated polynucleotide of claim 1.

7. The recombinant vector of claim 6, wherein said polynucleotide is operably associated with a heterologous regulatory sequence that controls gene expression.

8. A recombinant host cell comprising the isolated polynucleotide of claim 1.

9. The recombinant host cell of claim 8, wherein said polynucleotide is operably associated with a heterologous regulatory sequence that controls gene expression.

10. An isolated polynucleotide fragment comprising a nucleic acid sequence which hybridizes under hybridization conditions, comprising hybridization in 5×SSC and 50% formamide at 50–65° C. and washing in a wash buffer consisting of 0.5×SSC at 65° C., to the complementary strand of an ORF selected from the group consisting of:
   (a) ORF ID NO:9 of Contig ID NO:5, represented by nucleotides 12592–13197 of SEQ ID NO:5;
   (b) ORF ID NO:1 of Contig ID NO:46, represented by nucleotides 2–1267 of SEQ ID NO:46;
   (c) ORF ID NO:5 of Contig ID NO:58, represented by nucleotides 6565–7356 of SEQ ID NO:58;

(d) ORF ID NO:3 of Contig ID NO:78, represented by nucleotides 1108–3636 of SEQ ID NO:78;

(e) ORF ID NO:4 of Contig ID NO:94, represented by nucleotides 3006–5444 of SEQ ID NO:94;

(f) ORF ID NO:3 of Contig ID NO:32, represented by nucleotides 1885–3876 of SEQ ID NO:32;

(g) ORF ID NO:4 of Contig ID NO:92, represented by nucleotides 1753–3276 of SEQ ID NO:92;

(h) ORF ID NO:2 of Contig ID NO:89, represented by nucleotides 1007–1627 of SEQ ID NO:89; and (i) ORF ID NO:1 of Contig ID NO:287, represented by nucleotides 2–871 of SEQ ID NO:287.

11. An isolated polynucleotide complementary to the polynucleotide of claim 10.

12. An isolated polynucleotide comprising at least 50 contiguous nucleotides of an ORF selected from the group consisting of:

(a) ORF ID NO:9 of Contig ID NO:5, represented by nucleotides 12592–13197 of SEQ ID NO:5;

(b) ORF ID NO:1 of Contig ID NO:46, represented by nucleotides 2–1267 of SEQ ID NO:46;

(c) ORF ID NO:5 of Contig ID NO:58, represented by nucleotides 6565–7356 of SEQ ID NO:58;

(d) ORF ID NO:3 of Contig ID NO:78, represented by nucleotides 1108–3636 of SEQ ID NO:78;

(e) ORF ID NO:3 of Contig ID NO:94, represented by nucleotides 951–2741 of SEQ ID NO:94;

(f) ORF ID NO:4 of Contig ID NO:94, represented by nucleotides 3006–5444 of SEQ ID NO:94;

(g) ORF ID NO:3 of Contig ID NO:32, represented by nucleotides 1885–3876 of SEQ ID NO:32;

(h) ORF ID NO:4 of Contig ID NO:92, represented by nucleotides 1753–3276 of SEQ ID NO:92;

(i) ORF ID NO:2 of Contig ID NO:89, represented by nucleotides 1007–1627 of SEQ ID NO:89; and (j) ORF ID NO:1 of Contig ID NO:287, represented by nucleotides 2–871 of SEQ ID NO:287.

13. An isolated polynucleotide complementary to the polynucleotide of claim 12.

14. An isolated polynucleotide comprising at least 100 contiguous nucleotides of an ORF selected from the group consisting of:

(a) ORF ID NO:9 of Contig ID NO:5, represented by nucleotides 12592–13197 of SEQ ID NO:5;

(b) ORF ID NO:1 of Contig ID NO:46, represented by nucleotides 2–1267 of SEQ ID NO:46;

(c) ORF ID NO:5 of Contig ID NO:58, represented by nucleotides 6565–7356 of SEQ ID NO:58;

(d) ORF ID NO:3 of Contig ID NO:78, represented by nucleotides 1108–3636 of SEQ ID NO:78;

(e) ORF ID NO:3 of Contig ID NO:94, represented by nucleotides 951–2741 of SEQ ID NO:94;

(f) ORF ID NO:4 of Contig ID NO:94, represented by nucleotides 3006–5444 of SEQ ID NO:94;

(g) ORF ID NO:3 of Contig ID NO:32, represented by nucleotides 1885–3876 of SEQ ID NO:32;

(h) ORF ID NO:4 of Contig ID NO:92, represented by nucleotides 1753–3276 of SEQ ID NO:92;

(i) ORF ID NO:2 of Contig ID NO:89, represented by nucleotides 1007–1627 of SEQ ID NO:89; and (j) ORF ID NO:1 of Contig ID NO:287, represented by nucleotides 2–871 of SEQ ID NO:287.

15. An isolated polynucleotide complementary to the polynucleotide of claim 14.

16. The isolated polynucleotide of claim 1, wherein the selected ORF is (a).

17. The isolated polynucleotide of claim 1, wherein the selected ORF is (b).

18. The isolated polynucleotide of claim 1, wherein the selected ORF is (c).

19. The isolated polynucleotide of claim 1, wherein the selected ORF is (d).

20. The isolated polynucleotide of claim 1, wherein the selected ORF is (e).

21. The isolated polynucleotide of claim 1, wherein the selected ORF is (f).

22. The isolated polynucleotide of claim 1, wherein the selected ORF is (g).

23. The isolated polynucleotide of claim 1, wherein the selected ORF is (h).

24. The isolated polynucleotide of claim 1, wherein the selected ORF is (i).

25. The isolated polynucleotide of claim 1, wherein the selected ORF is (j).

26. The isolated polynucleotide of claim 10, wherein the selected ORF is (a).

27. The isolated polynucleotide of claim 10, wherein the selected ORF is (b).

28. The isolated polynucleotide of claim 10, wherein the selected ORF is (c).

29. The isolated polynucleotide of claim 10, wherein the selected ORF is (d).

30. The isolated polynucleotide of claim 10, wherein the selected ORF is (e).

31. The isolated polynucleotide of claim 10, wherein the selected ORF is (f).

32. The isolated polynucleotide of claim 10, wherein the selected ORF is (g).

33. The isolated polynucleotide of claim 10, wherein the selected ORF is (h).

34. The isolated polynucleotide of claim 10, wherein the selected ORF is (i).

35. The isolated polynucleotide of claim 12, wherein the selected ORF is (a).

36. The isolated polynucleotide of claim 12, wherein the selected ORF is (b).

37. The isolated polynucleotide of claim 12, wherein the selected ORF is (c).

38. The isolated polynucleotide of claim 12, wherein the selected ORF is (d).

39. The isolated polynucleotide of claim 12, wherein the selected ORF is (e).

40. The isolated polynucleotide of claim 12, wherein the selected ORF is (f).

41. The isolated polynucleotide of claim 12, wherein the selected ORF is (g).

42. The isolated polynucleotide of claim 12, wherein the selected ORF is (h).

43. The isolated polynucleotide of claim 12, wherein the selected ORF is (i).

44. The isolated polynucleotide of claim 12, wherein the selected ORF is (j).

45. The isolated polynucleotide of claim 14, wherein the selected ORF is (a).

46. The isolated polynucleotide of claim 14, wherein the selected ORF is (b).

47. The isolated polynucleotide of claim 14, wherein the selected ORF is (c).

48. The isolated polynucleotide of claim 14, wherein the selected ORF is (d).

49. The isolated polynucleotide of claim 14, wherein the selected ORF is (e).

50. The isolated polynucleotide of claim 14, wherein the selected ORF is (f).

51. The isolated polynucleotide of claim 14, wherein the selected ORF is (g).

52. The isolated polynucleotide of claim 14, wherein the selected ORF is (h).

53. The isolated polynucleotide of claim 14, wherein the selected ORF is (i).

54. The isolated polynucleotide of claim 14, wherein the selected ORF is (j).

55. The isolated polynucleotide of claim 10, wherein said polynucleotide comprises a heterologous polynucleotide sequence.

56. The isolated polynucleotide of claim 55, wherein said heterologous polynucleotide sequence encodes a heterologous polypeptide.

57. A method for making a recombinant vector comprising inserting the isolated polynucleotide of claim 10 into a vector.

58. A recombinant vector comprising the isolated polynucleotide of claim 10.

59. The recombinant vector of claim 58, wherein said polynucleotide is operably associated with a heterologous regulatory sequence that controls gene expression.

60. A recombinant host cell comprising the isolated polynucleotide of claim 10.

61. The recombinant host cell of claim 60, wherein said polynucleotide is operably associated with a heterologous regulatory sequence that controls gene expression.

62. The isolated polynucleotide of claim 12, wherein said polynucleotide comprises a heterologous polynucleotide sequence.

63. The isolated polynucleotide of claim 62, wherein said heterologous polynucleotide sequence encodes a heterologous polypeptide.

64. A method for making a recombinant vector comprising inserting the isolated polynucleotide of claim 12 into a vector.

65. A recombinant vector comprising the isolated polynucleotide of claim 12.

66. The recombinant vector of claim 65, wherein said polynucleotide is operably associated with a heterologous regulatory sequence that controls gene expression.

67. A recombinant host cell comprising the isolated polynucleotide of claim 12.

68. The recombinant host cell of claim 67, wherein said polynucleotide is operably associated with a heterologous regulatory sequence that controls gene expression.

69. The isolated polynucleotide of claim 14, wherein said polynucleotide comprises a heterologous polynucleotide sequence.

70. The isolated polynucleotide of claim 69, wherein said heterologous polynucleotide sequence encodes a heterologous polypeptide.

71. A method for making a recombinant vector comprising inserting the isolated polynucleotide of claim 14 into a vector.

72. A recombinant vector comprising the isolated polynucleotide of claim 14.

73. The recombinant vector of claim 72, wherein said polynucleotide is operably associated with a heterologous regulatory sequence that controls gene expression.

74. A recombinant host cell comprising the isolated polynucleotide of claim 14.

75. The recombinant host cell of claim 74, wherein said polynucleotide is operably associated with a heterologous regulatory sequence that controls gene expression.

76. An isolated polynucleotide fragment comprising a nucleic acid sequence encoding an amino acid sequence encoded by an ORF selected from the group consisting of:
   (a) ORF ID NO:3 of Contig ID NO:78, represented by nucleotides 1108–3636 of SEQ ID NO:78;
   (b) ORF ID NO:3 of Contig ID NO:94, represented by nucleotides 951–2741 of SEQ ID NO:94; and
   (c) ORF ID NO:1 of Contig ID NO:287, represented by nucleotides 2–871 of SEQ ID NO:287.

77. The isolated polynucleotide of claim 76, wherein the selected ORF is (a).

78. The isolated polynucleotide of claim 76, wherein the selected ORF is (b).

79. The isolated polynucleotide of claim 76, wherein the selected ORF is (c).

80. The isolated polynucleotide of claim 76, wherein said polynucleotide comprises a heterologous polynucleotide sequence.

81. The isolated polynucleotide of claim 80, wherein said heterologous polynucleotide sequence encodes a heterologous polypeptide.

82. A method for making a recombinant vector comprising inserting the isolated polynucleotide of claim 76 into a vector.

83. A nucleic acid sequence complimentary to the polynucleotide of claim 76.

84. A recombinant vector comprising the isolated polynucleotide of claim 76.

85. The recombinant vector of claim 84, wherein said polynucleotide is operably associated with a heterologous regulatory sequence that controls gene expression.

86. A recombinant host cell comprising the isolated polynucleotide of claim 76.

87. The recombinant host cell of claim 86, wherein said polynucleotide is operably associated with a heterologous regulatory sequence that controls gene expression.

88. A method for producing a polypeptide, comprising:
   (a) culturing a host cell under conditions suitable to produce a polypeptide encoded by the polynucleotide of claim 76; and
   (b) recovering the polypeptide from the cell culture.

* * * * *

UNITED STATES PATENT AND TRADEMARK OFFICE
CERTIFICATE OF CORRECTION

| | | |
|---|---|---|
| PATENT NO. | : 6,420,135 B1 | Page 1 of 1 |
| APPLICATION NO. | : 08/961527 | |
| DATED | : July 16, 2002 | |
| INVENTOR(S) | : Kunsch et al. | |

It is certified that error appears in the above-identified patent and that said Letters Patent is hereby corrected as shown below:

On the Title Page:

At page 1, under "Inventors", delete "Patrick S. Dillon" and insert -- Patrick J. Dillon -- ;

In the Claims:

Col. 117 line 58
In Claim 1(g), delete "nucleotides 1885-1076" and insert -- nucleotides 1885-3876 -- .

Signed and Sealed this

Twentieth Day of February, 2007

JON W. DUDAS
*Director of the United States Patent and Trademark Office*